United States Patent 12,509,736 (GENETIC LOCI ASSOCIATED WITH DISEASE RESISTANCE IN SOYBEANS) - sequence listing, part 2

SEQ ID NO: 2 - DNA, 2515428 bp, Glycine tomentella (residues 1,257,715-2,515,428 of 2,515,428)
  variation 2518..2998: note = n is a, c, g, or t
  variation 36286..36599: note = n is a, c, g, or t
  variation 36872..36881: note = n is a, c, g, or t
  variation 65098..65189: note = n is a, c, g, or t
  variation 91979..92044: note = n is a, c, g, or t
  variation 103399..103465: note = n is a, c, g, or t
  variation 108489..108498: note = n is a, c, g, or t
  variation 109073..109082: note = n is a, c, g, or t
  variation 110439..110448: note = n is a, c, g, or t
  variation 114969..115015: note = n is a, c, g, or t
  variation 117523..117532: note = n is a, c, g, or t
  variation 119983..120104: note = n is a, c, g, or t
  variation 147407..147539: note = n is a, c, g, or t
  variation 148147: note = n is a, c, g, or t
  variation 148448..148543: note = n is a, c, g, or t
  variation 151690..151746: note = n is a, c, g, or t
  variation 152026..152272: note = n is a, c, g, or t
  variation 155219..155271: note = n is a, c, g, or t
  variation 160392..160454: note = n is a, c, g, or t
  variation 171648..171859: note = n is a, c, g, or t
  variation 177208..177279: note = n is a, c, g, or t
  variation 178199..178208: note = n is a, c, g, or t
  variation 191490..191619: note = n is a, c, g, or t
  variation 194974: note = n is a, c, g, or t
  variation 196069: note = n is a, c, g, or t
  variation 196368..196600: note = n is a, c, g, or t
  variation 208015: note = n is a, c, g, or t
  variation 212728..212812: note = n is a, c, g, or t
  variation 213179..213270: note = n is a, c, g, or t
  variation 233294..233303: note = n is a, c, g, or t
  variation 252827: note = n is a, c, g, or t
  variation 259658..259791: note = n is a, c, g, or t
  variation 262066..262133: note = n is a, c, g, or t
  variation 262439..262704: note = n is a, c, g, or t
  variation 269209..269218: note = n is a, c, g, or t
  variation 270030..270039: note = n is a, c, g, or t
  variation 270849..270858: note = n is a, c, g, or t
  variation 271823..271844: note = n is a, c, g, or t
  variation 277888..277935: note = n is a, c, g, or t
  variation 278275..278284: note = n is a, c, g, or t
  variation 278614..278630: note = n is a, c, g, or t
  variation 283365: note = n is a, c, g, or t
  variation 292154: note = n is a, c, g, or t
  variation 294898..295033: note = n is a, c, g, or t
  variation 303145..303509: note = n is a, c, g, or t
  variation 327149: note = n is a, c, g, or t
  variation 345182..345191: note = n is a, c, g, or t
  variation 345689..345698: note = n is a, c, g, or t
  variation 347234..347243: note = n is a, c, g, or t
  variation 354646..354974: note = n is a, c, g, or t
  variation 355279..355288: note = n is a, c, g, or t
  variation 366049: note = n is a, c, g, or t
  variation 387264..396263: note = n is a, c, g, or t
  variation 401298..401307: note = n is a, c, g, or t
  variation 404653..404702: note = n is a, c, g, or t
  variation 411793..411845: note = n is a, c, g, or t
  variation 414129: note = n is a, c, g, or t
  variation 424879..425053: note = n is a, c, g, or t
  variation 436381: note = n is a, c, g, or t
  variation 438890..439012: note = n is a, c, g, or t
  variation 445443..445813: note = n is a, c, g, or t
  variation 446434..446520: note = n is a, c, g, or t
  variation 448528: note = n is a, c, g, or t
  variation 449746..449755: note = n is a, c, g, or t
  variation 451579..451618: note = n is a, c, g, or t
  variation 451827..453537: note = n is a, c, g, or t
  variation 453971..454045: note = n is a, c, g, or t
  variation 454682..454729: note = n is a, c, g, or t
  variation 454995..455028: note = n is a, c, g, or t
  variation 458579..458801: note = n is a, c, g, or t
  variation 471895..471896: note = n is a, c, g, or t
  variation 473644..473695: note = n is a, c, g, or t
  variation 475540..475549: note = n is a, c, g, or t
  variation 476056..476297: note = n is a, c, g, or t
  variation 476716..481095: note = n is a, c, g, or t
  variation 483544..483583: note = n is a, c, g, or t
  variation 494682..497556: note = n is a, c, g, or t
  variation 500976..501680: note = n is a, c, g, or t
  variation 509293..509775: note = n is a, c, g, or t
  variation 510125..510134: note = n is a, c, g, or t
  variation 511429..511438: note = n is a, c, g, or t
  variation 512071..512080: note = n is a, c, g, or t
  variation 520829: note = n is a, c, g, or t
  variation 535872: note = n is a, c, g, or t
  variation 548634..548716: note = n is a, c, g, or t
  variation 550234..550445: note = n is a, c, g, or t
  variation 556363..556825: note = n is a, c, g, or t
  variation 561399: note = n is a, c, g, or t
  variation 563228..563396: note = n is a, c, g, or t
  variation 569719..569972: note = n is a, c, g, or t
  variation 571088..571199: note = n is a, c, g, or t
  variation 571558..571610: note = n is a, c, g, or t
  variation 574171: note = n is a, c, g, or t
  variation 582944..582946: note = n is a, c, g, or t
  variation 584002..584056: note = n is a, c, g, or t
  variation 595096..595105: note = n is a, c, g, or t
  variation 598699..598791: note = n is a, c, g, or t
  variation 599080..599089: note = n is a, c, g, or t
  variation 601036: note = n is a, c, g, or t
  variation 603263..603301: note = n is a, c, g, or t
  variation 605068..605725: note = n is a, c, g, or t
  variation 612683..612791: note = n is a, c, g, or t
  variation 613113..613122: note = n is a, c, g, or t
  variation 624207..624794: note = n is a, c, g, or t
  variation 627447..636305: note = n is a, c, g, or t
  variation 637524..637692: note = n is a, c, g, or t
  variation 643932..644116: note = n is a, c, g, or t
  variation 646255..646264: note = n is a, c, g, or t
  variation 655076..655353: note = n is a, c, g, or t
  variation 655764..655773: note = n is a, c, g, or t
  variation 664924..665368: note = n is a, c, g, or t
  variation 665811..665897: note = n is a, c, g, or t
  variation 684898..684955: note = n is a, c, g, or t
  variation 686088..686097: note = n is a, c, g, or t
  variation 686785..686794: note = n is a, c, g, or t
  variation 687013..687452: note = n is a, c, g, or t
  variation 696202..696211: note = n is a, c, g, or t
  variation 697137..697146: note = n is a, c, g, or t
  variation 697505..697530: note = n is a, c, g, or t
  variation 698828..699334: note = n is a, c, g, or t
  variation 700134: note = n is a, c, g, or t
  variation 701663..701779: note = n is a, c, g, or t
  variation 705994..706003: note = n is a, c, g, or t
  variation 706275..706284: note = n is a, c, g, or t
  variation 706554..706740: note = n is a, c, g, or t
  variation 739616..739625: note = n is a, c, g, or t
  variation 739984..739993: note = n is a, c, g, or t
  variation 740772..740781: note = n is a, c, g, or t
  variation 747267..747725: note = n is a, c, g, or t
  variation 748024..748033: note = n is a, c, g, or t
  variation 751823..751832: note = n is a, c, g, or t
  variation 752158..752167: note = n is a, c, g, or t
  variation 754755..755332: note = n is a, c, g, or t
  variation 761790..761799: note = n is a, c, g, or t
  variation 770075..773141: note = n is a, c, g, or t
  variation 781173..781238: note = n is a, c, g, or t
  variation 788556: note = n is a, c, g, or t
  variation 798961..799024: note = n is a, c, g, or t
  variation 799264: note = n is a, c, g, or t
  variation 803059..803645: note = n is a, c, g, or t
  variation 806342..806500: note = n is a, c, g, or t
  variation 807057: note = n is a, c, g, or t
  variation 809594..810292: note = n is a, c, g, or t
  variation 810583..810645: note = n is a, c, g, or t
  variation 819075..819099: note = n is a, c, g, or t
  variation 819525..819534: note = n is a, c, g, or t
  variation 823746: note = n is a, c, g, or t
  variation 831993: note = n is a, c, g, or t
  variation 839444..840159: note = n is a, c, g, or t
  variation 860764: note = n is a, c, g, or t
  variation 874264..874670: note = n is a, c, g, or t
  variation 874982..874991: note = n is a, c, g, or t
  variation 875486..875495: note = n is a, c, g, or t
  variation 880231: note = n is a, c, g, or t
  variation 892030..892205: note = n is a, c, g, or t
  variation 900420..900439: note = n is a, c, g, or t
  variation 905126..905135: note = n is a, c, g, or t
  variation 917837..917857: note = n is a, c, g, or t
  variation 918415..918483: note = n is a, c, g, or t
  variation 919195..919698: note = n is a, c, g, or t
  variation 929819..931166: note = n is a, c, g, or t
  variation 936309: note = n is a, c, g, or t
  variation 937617..937679: note = n is a, c, g, or t
  variation 938166..938202: note = n is a, c, g, or t
  variation 948999: note = n is a, c, g, or t
  variation 955232..955301: note = n is a, c, g, or t
  variation 957017..957452: note = n is a, c, g, or t
  variation 957755..957764: note = n is a, c, g, or t
  variation 963372..964799: note = n is a, c, g, or t
  variation 975972: note = n is a, c, g, or t
  variation 980684..980776: note = n is a, c, g, or t
  variation 984316..984467: note = n is a, c, g, or t
  variation 984667..985013: note = n is a, c, g, or t
  variation 985138..985404: note = n is a, c, g, or t
  variation 985808: note = n is a, c, g, or t
  variation 1017314..1017402: note = n is a, c, g, or t
  variation 1021845: note = n is a, c, g, or t
  variation 1037120..1037214: note = n is a, c, g, or t
  variation 1041307..1042192: note = n is a, c, g, or t
  variation 1043052..1043061: note = n is a, c, g, or t
  variation 1061729..1062991: note = n is a, c, g, or t
  variation 1064770..1065153: note = n is a, c, g, or t
  variation 1065481..1065490: note = n is a, c, g, or t
  variation 1068350..1068358: note = n is a, c, g, or t
  variation 1070628..1070664: note = n is a, c, g, or t
  variation 1073221..1073383: note = n is a, c, g, or t
  variation 1073735..1073744: note = n is a, c, g, or t
  variation 1082661..1082682: note = n is a, c, g, or t
  variation 1083652..1083936: note = n is a, c, g, or t
  variation 1084301..1084344: note = n is a, c, g, or t
  variation 1084663..1084672: note = n is a, c, g, or t
  variation 1087587..1087596: note = n is a, c, g, or t
  variation 1088480..1088489: note = n is a, c, g, or t
  variation 1100633..1100693: note = n is a, c, g, or t
  variation 1103210..1103222: note = n is a, c, g, or t
  variation 1103976..1104499: note = n is a, c, g, or t
  variation 1108036..1108083: note = n is a, c, g, or t
  variation 1108391: note = n is a, c, g, or t
  variation 1121455: note = n is a, c, g, or t
  variation 1131796..1131956: note = n is a, c, g, or t
  variation 1139540..1139850: note = n is a, c, g, or t
  variation 1141715: note = n is a, c, g, or t
  variation 1153053..1153141: note = n is a, c, g, or t
  variation 1158773..1158797: note = n is a, c, g, or t
  variation 1159432..1159557: note = n is a, c, g, or t
  variation 1162619..1162739: note = n is a, c, g, or t
  variation 1163190..1163199: note = n is a, c, g, or t
  variation 1166327: note = n is a, c, g, or t
  variation 1171052..1171076: note = n is a, c, g, or t
  variation 1171386..1171412: note = n is a, c, g, or t
  variation 1188088..1188121: note = n is a, c, g, or t
  variation 1188873..1188917: note = n is a, c, g, or t
  variation 1190220..1194815: note = n is a, c, g, or t
  variation 1195112..1195121: note = n is a, c, g, or t
  variation 1210221..1210724: note = n is a, c, g, or t
  variation 1221116..1221723: note = n is a, c, g, or t
  variation 1246582..1246600: note = n is a, c, g, or t
  variation 1247090..1247160: note = n is a, c, g, or t
  variation 1252322..1252399: note = n is a, c, g, or t
  variation 1255587..1255722: note = n is a, c, g, or t
  variation 1256438..1256447: note = n is a, c, g, or t
  variation 1264054..1264141: note = n is a, c, g, or t
  variation 1264542..1264551: note = n is a, c, g, or t
  variation 1265445: note = n is a, c, g, or t
  variation 1270155..1270164: note = n is a, c, g, or t
  variation 1270726..1270735: note = n is a, c, g, or t
  variation 1276069..1276088: note = n is a, c, g, or t
  variation 1285115: note = n is a, c, g, or t
  variation 1292752..1292761: note = n is a, c, g, or t
  variation 1293343..1293352: note = n is a, c, g, or t
  variation 1296972..1296981: note = n is a, c, g, or t
  variation 1297588..1297597: note = n is a, c, g, or t
  variation 1301879..1301888: note = n is a, c, g, or t
  variation 1302658..1302667: note = n is a, c, g, or t
  variation 1315014..1315160: note = n is a, c, g, or t
  variation 1318709..1318990: note = n is a, c, g, or t
  variation 1319334..1319757: note = n is a, c, g, or t
  variation 1321767..1321837: note = n is a, c, g, or t
  variation 1324303..1324656: note = n is a, c, g, or t
  variation 1327754..1327769: note = n is a, c, g, or t
  variation 1348460..1348627: note = n is a, c, g, or t
  variation 1353754..1354201: note = n is a, c, g, or t
  variation 1354501..1354543: note = n is a, c, g, or t
  variation 1361377..1370010: note = n is a, c, g, or t
  variation 1373811..1374519: note = n is a, c, g, or t
  variation 1404036..1404553: note = n is a, c, g, or t
  variation 1408650..1408745: note = n is a, c, g, or t
  variation 1413613..1413642: note = n is a, c, g, or t
  variation 1418003: note = n is a, c, g, or t
  variation 1422061..1422070: note = n is a, c, g, or t
  variation 1435965..1435974: note = n is a, c, g, or t
  variation 1436939: note = n is a, c, g, or t
  variation 1442212..1442221: note = n is a, c, g, or t
  variation 1466149..1466756: note = n is a, c, g, or t
  variation 1488168..1488729: note = n is a, c, g, or t
  variation 1489174..1489183: note = n is a, c, g, or t
  variation 1494640..1494771: note = n is a, c, g, or t
  variation 1495169..1495178: note = n is a, c, g, or t
  variation 1496562..1497374: note = n is a, c, g, or t
  variation 1501256: note = n is a, c, g, or t
  variation 1519233..1519331: note = n is a, c, g, or t
  variation 1530876..1531672: note = n is a, c, g, or t
  variation 1539501..1539510: note = n is a, c, g, or t
  variation 1550168..1550188: note = n is a, c, g, or t
  variation 1559883..1559892: note = n is a, c, g, or t
  variation 1560261..1560270: note = n is a, c, g, or t
  variation 1560602..1560695: note = n is a, c, g, or t
  variation 1568183..1568192: note = n is a, c, g, or t
  variation 1575847: note = n is a, c, g, or t
  variation 1580103: note = n is a, c, g, or t
  variation 1581680..1581790: note = n is a, c, g, or t
  variation 1582461..1582543: note = n is a, c, g, or t
  variation 1598249..1598481: note = n is a, c, g, or t
  variation 1615304..1615306: note = n is a, c, g, or t
  variation 1620936..1620976: note = n is a, c, g, or t
  variation 1622376..1622440: note = n is a, c, g, or t
  variation 1623858..1626107: note = n is a, c, g, or t
  variation 1639782..1639810: note = n is a, c, g, or t
  variation 1657914..1657978: note = n is a, c, g, or t
  variation 1658123..1658961: note = n is a, c, g, or t
  variation 1662215..1662290: note = n is a, c, g, or t
  variation 1662660..1662669: note = n is a, c, g, or t
  variation 1666740..1666813: note = n is a, c, g, or t
  variation 1671811..1672574: note = n is a, c, g, or t
  variation 1673048..1673065: note = n is a, c, g, or t
  variation 1674791..1674800: note = n is a, c, g, or t
  variation 1675163..1675172: note = n is a, c, g, or t
  variation 1678279..1678404: note = n is a, c, g, or t
  variation 1678859..1678899: note = n is a, c, g, or t
  variation 1684450..1685029: note = n is a, c, g, or t
  variation 1690393..1691192: note = n is a, c, g, or t
  variation 1698905: note = n is a, c, g, or t
  variation 1713749..1713758: note = n is a, c, g, or t
  variation 1714429..1714438: note = n is a, c, g, or t
  variation 1721212..1721719: note = n is a, c, g, or t
  variation 1722067..1722269: note = n is a, c, g, or t
  variation 1733874..1733908: note = n is a, c, g, or t
  variation 1743304..1743899: note = n is a, c, g, or t
  variation 1744231..1744265: note = n is a, c, g, or t
  variation 1748110..1748890: note = n is a, c, g, or t
  variation 1759134..1759143: note = n is a, c, g, or t
  variation 1762830..1762889: note = n is a, c, g, or t
  variation 1771366..1771373: note = n is a, c, g, or t
  variation 1775112..1775509: note = n is a, c, g, or t
  variation 1782687..1783942: note = n is a, c, g, or t
  variation 1792376..1792451: note = n is a, c, g, or t
  variation 1802175..1802222: note = n is a, c, g, or t
  variation 1803101..1803115: note = n is a, c, g, or t
  variation 1804607..1804627: note = n is a, c, g, or t
  variation 1807679: note = n is a, c, g, or t
  variation 1815540..1816276: note = n is a, c, g, or t
  variation 1816730..1816739: note = n is a, c, g, or t
  variation 1831257..1831321: note = n is a, c, g, or t
  variation 1840114..1840183: note = n is a, c, g, or t
  variation 1841183..1841192: note = n is a, c, g, or t
  variation 1853078..1853247: note = n is a, c, g, or t
  variation 1866798..1866807: note = n is a, c, g, or t
  variation 1867100..1867109: note = n is a, c, g, or t
  variation 1867744..1867800: note = n is a, c, g, or t
  variation 1868124..1868163: note = n is a, c, g, or t
  variation 1872772..1872781: note = n is a, c, g, or t
  variation 1876847..1877364: note = n is a, c, g, or t
  variation 1880122: note = n is a, c, g, or t
  variation 1885134..1888261: note = n is a, c, g, or t
  variation 1908210: note = n is a, c, g, or t
  variation 1917391..1917806: note = n is a, c, g, or t
  variation 1938336..1943444: note = n is a, c, g, or t
  variation 1943733..1943742: note = n is a, c, g, or t
  variation 1965086..1965095: note = n is a, c, g, or t
  variation 1965460..1965469: note = n is a, c, g, or t
  variation 1972085..1972791: note = n is a, c, g, or t
  variation 1973111..1973122: note = n is a, c, g, or t
  variation 1974857..1974935: note = n is a, c, g, or t
  variation 1975220..1976196: note = n is a, c, g, or t
  variation 1977813..1977865: note = n is a, c, g, or t
  variation 1978144..1978215: note = n is a, c, g, or t
  variation 1988350..1988667: note = n is a, c, g, or t
  variation 1992044..1992053: note = n is a, c, g, or t
  variation 1992564..1992575: note = n is a, c, g, or t
  variation 1993922..1993931: note = n is a, c, g, or t
  variation 1998316..2001666: note = n is a, c, g, or t
  variation 2007006..2007034: note = n is a, c, g, or t
  variation 2022891..2022963: note = n is a, c, g, or t
  variation 2023545: note = n is a, c, g, or t
  variation 2030200..2030333: note = n is a, c, g, or t
  variation 2033148..2033157: note = n is a, c, g, or t
  variation 2033672..2034130: note = n is a, c, g, or t
  variation 2040204..2040649: note = n is a, c, g, or t
  variation 2040932..2040941: note = n is a, c, g, or t
  variation 2043444: note = n is a, c, g, or t
  variation 2044607..2044616: note = n is a, c, g, or t
  variation 2044965: note = n is a, c, g, or t
  variation 2045720..2046417: note = n is a, c, g, or t
  variation 2048728..2048737: note = n is a, c, g, or t
  variation 2054225..2054315: note = n is a, c, g, or t
  variation 2055747..2056110: note = n is a, c, g, or t
  variation 2060336..2062932: note = n is a, c, g, or t
  variation 2064549..2068059: note = n is a, c, g, or t
  variation 2071944..2074388: note = n is a, c, g, or t
  variation 2077276..2077285: note = n is a, c, g, or t
  variation 2077776..2077785: note = n is a, c, g, or t
  variation 2079822..2079963: note = n is a, c, g, or t
  variation 2099994..2100087: note = n is a, c, g, or t
  variation 2101621: note = n is a, c, g, or t
  variation 2111187..2111214: note = n is a, c, g, or t
  variation 2128572..2129569: note = n is a, c, g, or t
  variation 2129891..2129900: note = n is a, c, g, or t
  variation 2136592..2136865: note = n is a, c, g, or t
  variation 2137405..2137414: note = n is a, c, g, or t
  variation 2142352..2142967: note = n is a, c, g, or t
  variation 2152571..2152611: note = n is a, c, g, or t
  variation 2162035..2162044: note = n is a, c, g, or t
  variation 2162420..2162429: note = n is a, c, g, or t
  variation 2168678..2168687: note = n is a, c, g, or t
  variation 2168965..2168974: note = n is a, c, g, or t
  variation 2170448..2170528: note = n is a, c, g, or t
  variation 2172418..2172450: note = n is a, c, g, or t
  variation 2175858..2176004: note = n is a, c, g, or t
  variation 2176822..2178287: note = n is a, c, g, or t
  variation 2183532..2183533: note = n is a, c, g, or t
  variation 2192827..2192836: note = n is a, c, g, or t
  variation 2193136..2193193: note = n is a, c, g, or t
  variation 2226691..2226701: note = n is a, c, g, or t
  variation 2228677..2228844: note = n is a, c, g, or t
  variation 2230490: note = n is a, c, g, or t
  variation 2236754..2236902: note = n is a, c, g, or t
  variation 2237173..2237182: note = n is a, c, g, or t
  variation 2242420: note = n is a, c, g, or t
  variation 2244111..2245118: note = n is a, c, g, or t
  variation 2258246..2258284: note = n is a, c, g, or t
  variation 2262189..2262198: note = n is a, c, g, or t
  variation 2262472..2262481: note = n is a, c, g, or t
  variation 2266513..2266701: note = n is a, c, g, or t
  variation 2272669..2272678: note = n is a, c, g, or t
  variation 2298575..2298993: note = n is a, c, g, or t
  variation 2299347..2299359: note = n is a, c, g, or t
  variation 2307329..2307440: note = n is a, c, g, or t
  variation 2307847..2307856: note = n is a, c, g, or t
  variation 2308269..2308278: note = n is a, c, g, or t
  variation 2323624..2324477: note = n is a, c, g, or t
  variation 2335007..2335040: note = n is a, c, g, or t
  variation 2350282..2350318: note = n is a, c, g, or t
  variation 2369126..2369670: note = n is a, c, g, or t
  variation 2381400..2381716: note = n is a, c, g, or t
  variation 2392901..2392930: note = n is a, c, g, or t
  variation 2402695: note = n is a, c, g, or t
  variation 2411490..2411775: note = n is a, c, g, or t
  variation 2431281..2435739: note = n is a, c, g, or t
  variation 2445436..2449828: note = n is a, c, g, or t
  variation 2452416..2455423: note = n is a, c, g, or t
  variation 2461739..2461937: note = n is a, c, g, or t
  variation 2466912..2466921: note = n is a, c, g, or t
  variation 2473868: note = n is a, c, g, or t
  variation 2476490: note = n is a, c, g, or t
  variation 2486351..2489785: note = n is a, c, g, or t
  variation 2490307..2490316: note = n is a, c, g, or t
  variation 2494031..2494157: note = n is a, c, g, or t
  variation 2496343..2497092: note = n is a, c, g, or t
  variation 2504781..2504819: note = n is a, c, g, or t
  variation 2513626..2513666: note = n is a, c, g, or t
  variation 2514241..2514535: note = n is a, c, g, or t
  variation 2515079..2515133: note = n is a, c, g, or t
  source 1..2515428: mol_type = genomic DNA
ttgttaataaaagaatttaagtgacacactcattaacaaatttttcagctctatatatatttagagacaaaaatgattatttaatcaaaatataatttaatttttctcacattttaatcattacaaacataaaattataataaatacttaaaaaacaaaaaaacaaatataaatttaaacaatataataataaatataatattaattaataaatataatctatttattctccttcaatttctaatttcacattactcttagtaagtgttatctaaagttgaatgtctataaattatttttcttgtgctatttatcattctctagttttgtgttggaatatttgtctcgaatagtccctgctcacaaaagtacaaaattgatggttacatatataatactactataatagtataattaataggtgctcacaatttccagtagttcctgcttgagtatcaaactttgtaatgatacctggatagcaaaatgatgtctgaatttaatcgccaattaaatacaattaaaaaggtgtccctagattttatcaatattaagatgccctatattaattaatcaaccaagcagatttaagacgacgaagaaattttacgtacccagatctttctgctgctccgtcagaactgaatatatctgctaagaggatcacagtccaaatcctacttactaaaataccgcatctgtttaaagaattgtctgagaagttaacattaaaaaaagaaaaaaaaatattgtgcgacatttattttattcgagttaattcttattttgatcctcaaattttgagatatcgtcataaactcataatagttcttgaaattaaaaatggtaaataattttttaaaaattggatcatggagtgtgaaaactaaaggattacaagaggaattataaatgcacatggagtgtgaaaactaaaaatgatatggagataaaaaaaaaaacgtcattttatgtattgaattttttggttcaaaatgttttcaattttttataagattttttcagcaataaataactacatatatgattaacacaaaattaaattattttcctgattgaacttgtttctcgttgatcatgattttaaagcattaaatagtgaacatttaataatatgatgaaatatatgttgagataattagtatcgttatgatggtactcaagacaaaccttccatattttggtcttaaataaataaataaataattactctttaaaaaaataaaaaaataaataaaaattataagttcggtcaaatatttattgtatgtttaaaaataattcaattataaaacatcgttttataaaattctctataaaatatataatcaaatttttagataaattaattccaaaatatatttaatgtgtatttggttgttgttatttaaaaataattattttttatacaatatgaaacattactacagaatattgtcatttattaataagaaaaaatagataaattattatgagtaactccgttaatatatttgttatcaagcaaaattaaactgttagcataaacattttaattttatactaaaattgtcattcaacctaaagttttttctaaactttatcatgatcaactttcataaagcaaaagacccattttgctaaagtttctatattagagttcaccaacacctataattctattcatggaacaaaagcagtccatactatttatttcaacttcttttttttttggaaaattttattttattttataaaaaaattaatgtaatttttttttgttggaaaagcaagttaatgtaaattgtatctcattgtgttagctcatgttattaggcaatacttttttgttaccatattattgttacataatattaataaatttggtgtaattataaatagaaatagagaaaatattagaaaagctcaaaataagtagacagcctttccgttttatcaaagttgttgtaaccgcgtggcacccaaaactcaaaagaaaaggaaacgatcgatactatctgaagacctattctgctattcacgattctattgtataatcgagtgggtagttggttcagccttcaatgcatttttagaggcatattaactaaccacttcatatgctcaataagccattttgaacattgattaatatcaacagccataaggctgatccaaatgataatcgatcactccccttacttggtatttgtattgtcaactactcgtgaacttaacaagaaattaaaaaaattaacattaaaagtatcatcaagatctaaatataattgatagatagttgtaatttctttaaacactttaaaaagtattcgattctttgattgtgtgtataaaaaaaatatattaagagaagtaaaattcactttcactatctttatattttgaatatcttatttccagaaaaaagtaaaactaaccttaagttggtatgattggaactaaatttatattatttaaataaaatctaatgtttgaattttgtcaacatgaaaaaaatagttggaaaaatatgggagtacttttattagtatatatcagtaactaatattaattaaaatatcatcttataagagatgaaaatataaaaggaaattaatgtcttatatatatataaataacaattttataaataaagtaattttgtatttttctcttataacatcataaaaaccaataacataccataagatacaaaaccaattaataatcctaatatcttcaaaactacacaagccccaaagaggttcatttgtcttctatcctgatataagtccaaggtctgtgccttttttcacctctatattttttcccttttatttggaatatctgcatatagtatattcctctttggctaatgtcataactacttaaactatcttctgaacgatcgaccaaatattttaaaaagataattaaaataaataaatgcatttagcttaaaatatttaaagagattagtttttattcatcattattgtaaaaaaaatgataccatcaaatactcaaaaccctcttatatataacttttaaataattattataaaaattaacaaatttattgtacataataatatgtaattagattagtttaaactgtgaaatgtattctaattaaatttgtattcagaacataagaatttaatttgcataaaattttagtgtaatttttttttataatatcaacatcaaattatgttaaatattacttttaaaatagttattataaaaactaaggaaattataatacacggcgatcatatagtataaaaaacattgtatcgagctttaaaaaaacattgtattctaatttggatttaattcaaaatacaaaaatatctaataattaattaagagtgcaattagaaagattggttataagaatataaaactattccgcctccttgtgaacaactttttggttgtgtataaattggagttgtttgccaagtgtttcatttgtagttgagtagacggagcagagtgtccagggcagtttacaaagccaaattttgttccttagttgtttccttgttctctgtcactgatggctgattattcagcagaaactgaatatcgcgaggtagttgtaaatgtaaccaaggacacctccaaaacaacggaatactcagactcctttgtctctgttcctttcttgcagaaggtgtctcctaatcttccttttgtaccccaaaaaccattaaaagtgctcttattacaatttaatagatataatggattgctatctctgctagaatctgctttccttttttgtgtgtgtatatttagtttctttctgaattaatctatttactatattaataagggtggttgagcaggaaatatgatatttcctttagtgttatgtagagttcaagtagcaggtggggtgtcaactttgttgggattccgtatgctattttgagactcctgcatgccacctcttttgattacaaaaaatgtgattcaacagaatgcgtgaattgttgtatatatacttgtcttcgattttcttacagataaaaaaaaattattgaactagaagaattgagagtggaaatgacaatatcatggttttgtttgttgatggatacagttggtagctgaggtggtgggaacatatttcttgatatttgcagggtgtggttcagtggtggtgaataagaacaacgacaacgtggtaacacttcctgggatagcaattgcttgggggctggttgtcacagtgttggtttacactgttggtcacatctctggtgcccatttcaatcctgctgtcaccattgcttttgcttccaccagaaggttccccttgatgcaggtaattgacccttataacctttttcttaacttggttgatctataaataggtaaatgtgcccatttggaatattgtcattttccttcttaaattgttatctccagcaaccccacaaggaagatggatgtctttaaagcccaattatgttagaactgaaattatgagatgccataccatataccaaaaatctaaattatgaaagtaactcctaacttcatgatcgttgccaaaacaaagttgcctctttgcacatgcatataaagctagctaagatatttcatattcacaggaaaaaaaattctactatgaagttgttttaaaattatgtgttcgggcatgtgatttaaattgcaattaattactgttgttaattatgtaggtaccagcttatgtagcagctcaactcataggaagcacacttgcaagtggaactctgaaactattatttatggggaagcatgaccagttttcaggaacactcccaaatgggactaacctgcaagcttttgtgtttgaattcataatcacctttctccttatgtttgtcatatccggggttgccacagataacagagcggtaacgtctctcacattactccctctgcttaaatttgtagatagtagtactttcttatgagatttgggcaccttattgataaagtttgttaaaccagagacaatactaattcatactttatttattaactaaattacactcaatctggttggactcaatgaaaaattttacatgtacgccctttttttctaaacactcatttgacacattcactcaaaggggttagatcatctgttatcaagctgataaataaggtggagagtgtgcacaggggtattcttgagtgagaggtttctgacttgaatcctggtgaaaaaacaaactttggaaatgggatgaataattgatacaagcccttacatgattacctctaagaaagaaaacctgtggacaacatctaaataaaattcatttaacacattttatctctttatttttcttattattacatcacatctctttttacatttattatttctctatttttttttttatctccctataatgggcatatgggttgcaccaaatattaccctaatcaaataattttttttaatccagagacaatatattaatccatagcttacttataatattggaaattataattaaaaaaagtaaataaacgaatttaaacatgatataatatttaatgttgtttagttcatacaataaatatctttttttacggaaaacaaatatcctaaaataatggcctgtagtgttttttttttttctttctaaaggtttcaaaccaatttgactggtttttttgacggtgctttgaaccgttgttttgagtcatgtaaattgaatacttaattggatcgttcatttttttagtgacacgaagaaatggagagaggcatggcaacactgaggttaatggttgacctttcatgatgatatttttgaacataaaaaacttacactcttcttatactaattttaatagtaaaataatgtaaattttttaaaattgttcttacgtaacttcttttctacataatgattcgacaaaaaatgcacaatctaagtcggctaaacgtatatttaggtctaaaatgaaatttaagatgatttttttaaattactttaaatacatttttaaaattagtattatacccatttttatttataagactacctaaattaaaaatgatatttgttcttttttggtttattgcataccctttttttaaaatttttgcctaattttatctcaacaaattaatctgacatattttatcctaactttttagaaacttgagaattttatcttccattattttattcctaacataactacactttttacttccttttttttgacaaattttacacctaatttttgtatttttgacaaattttattccaaatttgggcaaattttacttccaacttttggtttataattcgataannnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttatattgcattttaagaaatacaataaaatatgtatatataaattgtgtaaaactattttttaaactatcataaaataaaccagtattttaatataattttttatacgtgtttaatatgtataagaaaacatatgcttatttatgtatacctatataaatactacattaataaaattaaatattataataatacttattttcaagtttaatattatattcgtttctttttatataggaaataaattataatgtattttacaaaatgtaacttgtttctataggaacaaaggtaataatataatagagaaaaaatatatactatattaacatatattacaaaaattctattataaaatatatttatttagtttttaatacctatannnnnnnnnnaaatatccctaattaaaaaagagagaaattgtatagataaacattcagaatggagatattaatgaaaatgatattttttgaaaaaaagaatctaaatataagcaaatttaactaacttatatgaaaattaagaaagttgattattttcatttaatttttctaatgacatttaaagaataatctttattttttaaagtgtctttcattagaacttgatattataatcacaattagttgaagaatttttatggaatgctatcattaaatagagtcaaagtagttaaattttacgtatatttaagtctagaaatattgttccttatatttaggtatatagatagtataatttaagataaatttatttttattaactaaattaatcagtttcttttaatgataattgggtcttcaaataggtagtatgatttttttcttcataatttaagatagaaatgtttattaaaataattatagaaacttatatattaacaattagtaatatttttaagaacttatatatttttaaaataattataaaatcacgagacttatgaaatactgcgacttaaagtaagggctattggtgtttgatcctagaataatgccctgtacacaatgtttaggtaccatttttttattttaatatttaattacaggagacggctactttgtgagactagattatggtaggggaaaggcttctcttgtttttcatttctacaatgattacgcattaattacatgcctttatgtactttttttttaatatttcacatagctgcctataatattttgttgcaaaatatatattccaaattaaagttcacacatctgtctattttcatttgaaagtatcatccgcccaatgcattgttgccaagttagaacttgtanacttccaatgtttagcaaattaggctttacatattaaaaaaaaaaaaagaagagaaattggtactacctaatttgtatcgttttgaatcgcttgcaagaatcctagaagtttacgttacgaggcatatctcatgagaatcaataatccatccacgaaatattcttcttagactcctttatttattaacttgagtttaaaattgtgcaggttggtgagttggctgggattgcaattgggtctacaatactgcttaatgtgatgattggagggtaatactaattattaaccaatccaaatcttaattagatgcaaaatcagcattgttggagttgtaggacataatattcttgtgaatggttatcatatttggcaggccagtcacaggagcatcaatgaacccagttagaagcctaggacctgctattgtacacggcgaatacagaggaatatggatatatttggtggcaccggttgtgggggccatagctggagcattggtatacaacaccattaggtacacggacaagccattgcgagaaatcaccaagagtgtctctttcgtcaaaggccatgatagctccaaataatttaagcaaatgcaaatggactaatgttagggaaaaagttacatcaacaccttaacatccattgaatacctagaggaagaaaaacaatataagcataatagggtctataatctcagatatgtttagataaatttctttagaaacacttttaaaagaagaaaataagaagaaaaaaataaaataaattttttcataagcaaaaataagttctcaattagttaatttttagaagttcatcactataacttctctaaaagatgagatgacatctacaaatgagctaataaaaaacttattttagcttatggagaaactcattttattttttcttcttctagaaatacttataaagaaacttatatccaagtagacccccgtaataggaaatataaaaaatgaaaaatattggtgaagtgtttaaaattataggatgtttatatataataactcttaacgttatcctcagctgtggtgtggagagtcaataacttcttccttgtaattgtctttgttacaaataataattagaagaaaaaaaattatgcatgaagttactcaaagaaactacgctatgatttttcatgtccttgttatattaaaggtcatgcacttgaatatcatcaccctctttttcctctttatttcgataaataaaagttgatttttgatatatattgttggtggatcttgaagctttgtggaccaagctagttttatttcttgtatgtgagttatgaggagttgaaggcacaagtttatgggctttgttgattcgggtttgagtttaattttgtactatagtgaaccctttgtaaagggatatgcaattggttaatttggtcaatttttcaaaattttaatttttcataacttttccccacttcatcagcccattgaattatgtgatatatatccactgttgtaaggatttggagcattcgtattcaccttagaaaataaggtgcatgtcatgttaggcagaatccataaagacgtggcattaaataattgactttttgaggtctgtagacggtggatagactcggatactgcgataataatatattaatcacataattacatatttttttaaaatcaaacaaaaaaagttaaggttcggtctgttaagagttttgataagtaaaaataagtacatggtaatccatttatatgtctactatacttgtctagtgattagttacatttataagtcgtttaacagatatgatcaaaattagtagattgttttacactttctcataatttacatattaaataatttttccttttaatttcttaataaatatcctaataacactaattaaaaaaccctatttttgaaagctaaaagcacagtcattttggaatggtggaaatattattattattattagtggctaaactatgcttccccacgtgtatagtcgtcatcgctccaaccgcgtcatcatataaaattataaatagttcacattcgactttagtttatttacttcttcactgtcggaaacagttttcctcgttcatttattagctgttctcttcgtttttctgccgacaatggatgagaattcagcaacaaatggaacccatgaggtggttttagatgtaaacaaggatgtctctagaacaactcatgcttcacgctcttgtgtcaatgtttctttcttgcagaaggtgtgtccttatcttttatttttttttttgtgtgcccaatcatatgagatttgattagatgaaatgtattggtatctctgctagaatcttatattttttattgttgtgaaacgctacagtgcatatagtctctttctgaattaatctattgaccatattgaacttgaaaaaatgagattagaaaagacaatatcatggttttgtatgttggtggatacagttggtagctgaggtggtaggcacgtatttcttgatatttgcagggtgtgcttcagtggtggtgaacaagaacaacaacaacgttgtaacacttcctgggatatcaattgtttggggactggttgtgatggtgctggtttactctgttggtcacatctctggtgcccatttcaatccttctgtcaccattgcttttgcctccaccaaaaggtttcccttgaagcaggtgaaccaaccacaaattttttttttccttcaacattgatttttggttcaagtaggtaggaaaattagaggtcaaattagtttatcatgattgaaagagaaattttgtttatattgtattttcacacaacttaattttaacaaataaataaaagagagataagaagaaaaaacaaagaaatgtgaaataagatggatgatgtaagggagagaattattgagaaaagaatgtgttgtatacttatattgcatgtataaatataatatctcaaattaaaatacttatttgccttgacctttttacactagtttataattggtaaacaaaacgcgtgttgaacataggtagcaagaaaaataatggaattagagaaagccttagtcctctttcactacatccaattgtctcattttatcttgaaattattggcatattcacggtgatataactatcaaccatttagcattgtaggttccagtttatgtggtggctcaggttgttggatccacacttgcaagtgggactctcagactattatttagtggcaaggatgcccagttttctggaacacttccatctgggtccaacctgcaagcttttgtgattgaattcttaataacctttttccttatgtttgtcgtatccggggttgccactgataacagagcggtaaagtttcttattccatcattaaattttgtttttttgtttgtttggttacaattagcttttattttctataaaaaaatttattaacacgtgtctagccaaattggctatggctaatcacctcctaaattctgacataaaaaatggagtacataaattgactagttgtctacatatattcgtagcgttttggatcacttggaagaatgctacaagtttatatcacacgagacatcttatacgaaacaaaaatccatataacatatttgaatatttgtctttcttggacctcaattccatggatttcatttatttattttatttggaaatcttgcagatcggtgagttggccgggattgccgttgggtccactgtgctgttgaatgtgatgtttgcagggtattattatcttacccaaagataattaaatacaagtgtaggcacacacattatgacatttaaaacattacattatttattcaaagatgttacaccttttggaagcaaaatagaggtcaaagtatgatctcatttgcgtgattgaatattattggtgtgtataattgttgaactaaattgacaatacttactacattatgttagttattatgtaactatatcttgttaaacataagatatgcgaattgttgtaaatctatttgtttcttttacgtacgaataaaagaatatattatgtaactaatgacatggtttcatatacgacaggccaatcacaggagcatcaatgaacccagcaagaagcatagggccagcgattgtacacaacgaataccgaggaatatggatatatttagtgtctccaactcttggggctgtggctggcgcatgggtctacaatagtattcgttacacggacaagccactgcgtgagatcaccaagagtgcctctttccttaaaggagtagggcatagtggaagctctacgtgatttaaccaaattatgctagaaattaaggtgtatttatgtctcatttacagaggagtaacttcatttggaaagtagttgtctccaaaatttattactactttatcatgtatcagggtcaaagtagaaggaagaaatcaaaatttctagtatatttgtaacttcattagtatattgttgcaaacacatccacagaaatcaaaatttcatctctttgtttttcactttattaagtttatattcatataatcactggattttaggccccataccttgcacagttttttatttttttatttttttttatatatattgcattttaagaaatacaataaaatatgtatatataaatagtgtaaaactattttttaaactataataaaannnnnnnnnnaaattgttcttacgtaacttcttttctacataatgattcgacaaaaaatgcacaatctaagtccgctaaacgtatatttaggtctaaattgaaatttaagatgattttttaaaattactttaaatacttttttaaaattagtattatacccatttctatttataagactacctaaattaaaaatgatatttgttcttttttggtttattgcatatcctttttttaaatttttggctaattatatctcaacaaattaatctgacatattttatcctaacttttagaaacttgagaattttattctccatcattttactcctaacataattacactttttactcccttttttttgacaaattttacatttaatttttttatttttgacaaattttattccaaatttgggaaaattttacttccaacttttgtgtttatgattggataaatgatgaaagataaaattcataagtttcttaaaatttgaaaataaaatacatcaaattaattttttggataaaattcataagttaaaatgttgggactaaaagaatacaattaagnnnnnnnnnnatatatactatattaacatatattaccaaaattctattataaaatatgtttatgtactttttaatacctataataaaatataagtataaacacccaatttcattcggacaatgaaaaataaaaatgtaaattataagaaaaattcaaacaaaaataaaaacagaaaaaaaagaaacgagtataataataataaataaataaataaaaataaacgaaaatcatcatttttcttgatctaataatatccattataaaaatgttgaatttaaaaattttaaattatataataaaattttagaaaatcattctatgaacatgaataaataaactattaatttcagttttggttaaacacattgtctgattttcttttgaaataaaattaaggatcgttgacaagtaaaaaaagataataacaaagacaagtaaattaatgatatggacatagatttggccaatttacattacaattagaaatgtacatactaatttggaaaggaaatttaataaataatattgggaactgggaaggaaaaaagaattgaagttaggatgcctcactaaacaagatatacatgtcagaaagtgctaggttatattattagacggaaaaaaatctcccattattgtcacgatgccttgggaaagaaactagtctccttaatttggggcctgaagattattttgggtaccggtaacacgagcagcaccactgctttgcctggttcttggaataattataggcaaacaacacactagaacgagtagtgactccattatgaaagccatcattgtgatccatacaaatatgcaaatcttccaatgccatataatcctcttgaataagggaagttctgattcaataaccactgatgaatcataaatttgaggaatgccggcaccaggtgaatattctgctcgctgctcaagtgttacttttaagcatgaagtaggtacatccccttcaacaaaacctctcatcttgacattcagtgtctgggtttctgatatatagccagtgacaagtggtacaatcttgaggaatgtcgtgattaggcggataggctcacttgtgaattttaacatgcaaggttgatttgaactccaaattgttttgccatcagaagacaagaagtctaccctgatctatagagctcaaaacaaagcaacaggaaactatgaactttaattatcatcatactaatagttcagattctttaagcagaatgatacaagtacaagaaaatggcaattttaacagagtgcaaatcatgagaggaaacataatcatggaaattttaacaaaagaagtataattgatctccttctttgcctaataaatctaactatcctcttaaagcactcacaccacaatgataggaaacatagtacatagacaaataaaagaaccattctagttaaaagttttagcttttatgtaaaggccagctaagtgtcttagtcgtgacacttggcgtatattgcataagagggttgtgctgataactctaccctgttgtcatccattaaaatttaacaattagataaaggaaccaggaattaaactctcttagccagttcaattccttccaaatgagtttaatggctgacaaatcgttccaataactgcttgagctacaattgcacggccacagtaaaagctattgaacccctaattcatgatattctagaatcatgttttcatcatttcttctaaccaaactccaacaatactcaaataaagcaaatataaagatattgagagttaaaactagcaccaacttgccactcaaaccctttaaagtcgtacgctagtgagtagtgaccacaaatagcccatccaccatcaaaggtccttatgctaacatagtaacattacatatttacacattaatattagaactagtaaaacatcatgcaagcagttcatgtcattttctggattaaaatgactgagataagtcttaagtacctgaaagatgccaagatttgtgttgtattctgactccggcacaaccaatgaaacagtgacgtgtaccttttggttagcaggtataacccttctacccatccactctctaacagcaatgcccttctcagaatcatgcgcacccccaacaccatcacaagacatcacaggcacaaatgcaacaggactctgcttggtgtaatcaaagttcaaaacctgcctcatctgaaacggctcctccaccaaacacctcaccaaaaacccactcaccacaagtgaagaaaccaaaagaccaaacaaaatgcaacaaatatacattgaccacaagaatccccacccacacctaaatgcaacattccacaaagatttgtgctctttgaaccacccttgagctgaagaaccaatgcacccaaaaacaaaacaccaaactttacccaaaatcaccaccaaaagacctttcccctttctaattgttccaaaagggtccacgaaaaacaaaaaagcgtgtaacataaaccacactgggaatttcattaagacaacgaaaatattgatttgaaacacaattgacctaatcaccaaccccgttacataatcgagcaaattcaaaggggagttactgaattccaccgccgagtcaacggaatcggtgacgccgtcttcgttctcggcggtggttaacgtcgattcctcgttcccctcttcggtggcaacgcttggagatggaatgggaataactttctctcgatttgaatcgcatttctcggggaaattctcgtttccgtttgaagttccgagatttggatcgctccgatggttcgtgacgtttccggtggtcgaatagtcgttggaaccggtattcgtggtctccctaaccggtgagttacggagggttgaacggcggcggattgtgatcgccggaggtggggagggtgggttggggtcggagagaattgaagaagaggcggaagattccagcgatttatcggcggcgccggagcaatggtggaaggggcagtgaggaagcgcgtcgaggaaaacgtcgtcgttttggtcgtttgggcctgaaaacgatgagtccattgaagatgacgtgattggatattgaacttccgaggctggttcattttgaagccacaaaattgagaattttttgctttctcaaaaaggaaagtatattttcgaagaaaaaaaattatattccaaaacaatacacacaagtttgtggtataaaataattacatggtttttcgtcacaaaagttaatttacaacattaaattttcttaaaagaaagaagcatatattcattcatcactttgaaaataaaaaccaataagatatgttattttcatcaccattagcattttttgtaattttttttaggatattttttgtcattctttaaatgataacactttatatttcttttttttgttaggtgaagaatgaacatttagcttgaatatttttctctccttttatgatgattcattgttttagattttgtagtgttattatgatagacgcaaatttttagtgttaattttcatagattgttatcatattttggtctttagaataatattaagacattcaagtattatgagatgtatggtgaataagattttttgcattctcctaaaaaaagttttttgcattaaagagtaaagtttcacatgaaaaaatgatttaaaatactttttatattcgaatttggggatgttgcatgctggaaacattaatcacaccatggttatgtttatagaaatttatgttctcatgcacatgatttacattttgattatcgtaaatcttatgcccctacaaatattttttttttgtctttcccatattattattcaatctttaaatcttagtttaattaatgctcctaaaaatgatcaagcctggtgcacttttagcctctaagctctttgcaatttctttttctttatagccactgtctgcatctctgcacagaatcctttgcattattcttgcataattaatgaagcatcattcaataactcctcgtggattctccttaaaagaactttcatggtcattgttgttctcctccgatccttcacattggttgtttcctccaaccattattagtatatgtttcacctctatatataaagggaacttcagctaacatatgacatccattgtcctcatcatattttgcaataacaataaagtgaactttgataccatattataatttgaaaaaatgatacaaatgatatcattttcgcgtgtccacttatcataaagattaaagcaggggagagaaattttataaatatgaaaatgtgattaatataaaaaatatttgagtttcatatttatttgttcacattatctttctatttattatttttcattacaaaagtttgtcaaattaataacatgagagttcatataatattattacacgttaaaaatatggatatatggtgctataatactaaagagtcctatttaacaaattcagaattgaactaaataaagttgcatgtaatagataacaagtatagtatagatttctgaaacgtacaattttttttttatacattttttacaagtaattccaaaatctgagttgttttttcccctctaaatattgataattcctgttggaatatgagcctaatcaactagagtcaatttaatggtccagagtttggagatatattattatatatatcaatataggaggatcggaatatttctccaacattatgtgatataatatatatatatatatatatatatatatatatatattcctttctgatttcatttaaggagttttgagaaacattttcctactaaataaaagctgatgataactaatgacttttaatttcaatttttctgccccaatttcatcgtacatgtagccctcgaagtattatgacaagaaggtacgtagttgtaaaccaggttaccgctaacacctacttatcaattacaaaggataagcataccaagtgttaattccctagctaattaacacaatgtatcatttcactttcgaattcagcattccttcgatgtaggaatttcagcctaaattaaccaagctagcctccctcgtaaagcctcattcctgcaaaataaacgatgcctaggatggttaattaattcttaattggtttcatctatagatatcattcaatcattttgtttactccccagcaatataatcctattaaagacatcacatgtacaaattcacttttattaattataaattactgttgtcctttggaggaatattgaaatatatataagagataaaagtaatctgttccccatctcatcgaaaataacaaaaggtgaacactaaagccnnnnnnnnnnnnnnnnnnnnatatatatatatatatatatatatatatatatatatatatatatatatacatctcaagacgggtaatataatcatttgcaattcattcatgactattaattaataatattattaaccatatggaagatgtaacaccctaactaattttatttaattaattaattatttgcttattttaaattttattattttattcttttgagggaaaatataaattgagataagaacaagaaaaactaaaattttacaagaaacgtgtattagtacaaaaattcttcgttataaaatttacaaaatatgaagattgatacattagtccatgtctctgatataaacatacaagtacaaatctcttttccaaaatccagcctagtacaatgcttcttcaatatatcgatactactccagccttaagaaatctgaccatcatttccatctaaaaacataaaataaatctagtgagaaataaatttctcagtaggcaaatttaaaccaccaaacatgttagaaggttagtaaataaagcaaatttgattcaacatacactttagcagattagtaaataactcaatatatctgaatgaatgcatgaatgtatgaatgcatggaaatgaatgcaatggccacaggtgcacatggtatctacatatcgtactgtatgtagctacatctcgtactgaatgtagacgctgcgatcgtcttacacaaacatgcatgaatttccatgtattagcacctgatctcttgaagtagcataggcccggttgtcacactcgggtcattcttaaaatcataacataggcccggtgttcacaactcgggtcaatctcataaaatcataggtccgatctttgaaaaccagatcaatctcaataattcataatataagaaatgtattattttccttccataaagtatgttagttaaccttcagtaaaagcataccaactagaatttatttgaaatttttacaaactatgtccggattctgagtttatggtatccgtgttcaggatgtccgggttccggatatatggtgtccgggttccgggtacaaggtgtccgggttccgggtacaaggtgtccaggttccgggtacaaggtgtccaggttccgggtaaaaggtgtccgggttctgggtacaaggtgtccgggtttcgggtacaaggtgtccgggttccgggtacagggtgtccgggttccgggtacaaggtgtccgagttccgggtacaaggtgtccgggttctgagtatatggtgtccgggttctgggtacatggtgtccgggttccgtgtacatggtgtccgggtacaagatgtccgggtacatggtgcccgggtacaaggtgtccgggtacatggtgtcagggttccgggtacatggtgtctgggtacaagatgtccgggtacatggcgtcagggttccgggtacatggtgtccgggttccgggtataaggtgttagggttccgggtacatggtgtccgggtataaggtgtccgggtacatggtgtccgggtatatggtgtcagggttccgggtacaaggtgtccgggtacaagatgtccgggtacagggttccgagtacatggtgtccgggtacatggtgtccgggtacaaggtgttcgggtacatggtgtccgggtacaaggtgtccgggtacatggtgtccgggttctgggtacatggtgtcagggttccgggtacaaggtgtccgggtacaagaattaaaattattaaattcctaaattagagattaaagcctagcctacctgtgaaaattgtaatggattgcttagagaactgccgggattattttaagagaaaaggattttacgtaaaagaaagtgtttgagaaagtttaggaagagagtgaaagctgaaagtgtttgtatgtagattttcggtgcagagagtttgaatcttccaggctatttatagtgcttgatttagttaggattaaaagggatttggttggaaagaaacttagttactagaaaatatctagattttcttatgtaagtcatcattactaatattctcttcataaatggtagatgcaacgtggaaaactactgaagcttgttcctgcttatttattttgcctaatgccatctggaaaggtcataagaaaaatgtgcacaaatatttggatagattaggaaaaaaaattgctacgtggctggaggctttatttcagtttaaaaattttcctttattcttttttaaagcctatcaatcagaaacaaaaatatatttttgtgaatgttacaatatggatatccaagaggatttttctagtgattttggacttagctgaaattttcacgtggtcaaagactcaatttttggatgctaaaatttgtccttaaaaattatattttattattataatttagatcatgaatatttatataattatttgaggattttacatttcatccctcctaaaaaaaattttgccctcaaaatttagtaaatacctgtaaataaatccggatacttcttcctcatctctgactctaattcccaggtaggttcttccaaacgtccttgtccccatgctacttttaccaatgatacagacttatttcttagttgttttatttttctatccaaaattcttgtcgggggtaagctcatagttaaattttcttttaactgtattgattcagattctagaacatgacttgggtcggaaatatatttacgaagttgtgagacatgaaaaacattgtgaaggttggaaagatttggtggtaaggctatttggtaggctattgtacctattcttttcagaatttggaaaggaccaataaaacgaggactcaactttttgaccttcattgctcgtcctattccggtaactggagtaactttgagaaaaacatgttctccttcttgaaattctaaaggttttcttcttttatcagcataatgtttttgcctattctgagctgtcactaatttttctctaatcttcttgatttgctccgtggtttgagttaccaagtctggacccaaaagacttacttccccggattcataccaacataaaggagattgacatttcctaccatacagagcttcaaatggagccattcctatactagtatgataactattattataaacaaactctactaatggcaaatatttctcccaagaaccttgttggtctatcgcacaagctcttaacatgtcttctaaggtttgtattgttctttcagtttgtccatctgtttggggatgataagcagtacttaagcatagcttggtcccaaatgctttttgtaatgcttcccaaaatcgagaagtaaagcgggggtctctatcagaaatcagggtggaaggtacaccatgtaatctaactatttcttgtatgtacaagtgagctaatctttccaatgaataagaaatcctaatgggtataaaatgagctgacttagtgagtctatctacaatgacccagattgagtcatgtccggaaacagttctaggtaatcctaccacaaaatccatctatatacttttccatttccattgaggaatttctaaaggttgtaaggtgccaaaaggtttttgatgttctatttttactttttgacatactaggcatctttctacaaattttgctatatcctttttcatgctaggccaccaaaacattcttcttaaatcttggctcatcttagtaactccaggatgtattgtaaaattacttttgtgagcttcactcaaaattttctctcttaatccatcactttgggtacacatatcctcttttgataagtccacaatccatcattatttacctcaaaatcttgcaattttccttcttggacttgtgttaaaatttgttgaaaatctaaatctctctgctgttctagcctaatgtgttctttgaaatcactagtaatttgtatttgactcaaaatgatacttttagaattaacagaaaatcctaaattaagatttttaaaattttctatcaattccatttccttgatcatcattctagatacatgcagagatttcctacttaatgcatcagctactacatttgcctttcctggatggtattttaactcaaaatcataatccttaagaaattcaacccatcttctctgcctcatattcaactctttttggtcaaaaaggtacttgagactcttatgatctgaaaagacttcaaatcttactccatacaaataatgtctccagatttttagggcaaaaactactgctgctaattctaaatcatgggttggatagttagcttcatggggtcttaactgcctagatgcatatgctaccacatttccattttgcattaacacacagcctaaacctttcttggaagcatcacaatatacttcaaatgtaccatgagggtctggtaatactaatactggagtactagtcaaccttttccttaattctagaaaacttttctcacattctggtgaccatacaaaaggcacgtttttcctagttaagctagtaagaggtaaagctatttgtgaaaatcctttaataaatctcctatagtaaccagctagtcctagaaaactcctaatctcagttactgtggttggtctttcccaattcatgactgtttcaattttactgggatccactgcaattccttctttagaaacaacatgacccaaaaattttacttctttggcccaaaattcacacttagataacttagcatacaatttcctttctctaagggtttgtagtactattctaagatgttcctcatgttctttttctgactttgaataaaccaatatatcatctataaagattattacaaacttatctaaataaggcctaaatattctattcatgaaatccataaaaactgctggagcattagttaatccaaaagacatcactacatactcataatgctcgtatctagttctaaatgcagttttaggaatatcctcattcttaactctaatctgatggtatcctgatctaagatctatttttgaaaataccactgctcctctcaattgatccataagatcatcaatcctaggcaatggatacttattttttatggttatcttattaagctgcctataatctacacaaagtctcattcctccatctttctttttcactaacaaaactggagctccccagggtgaaacactgggtctgatgaatttcttttccaataattcctctaattgctttttcaattcttccaattctaaaggggacatcctataaggtgccatggatattggtccagatccaggaattaagtcaatagagaattctatttccctttctggaggtattcctggtatttcatccggaaacacatctgggtattctcttaccacaggtattttagagagttcatcagttgactcagttacattagctgataaaagaacatacccttgaatttcattgttactagaacaggagataatggagttcacatacagacactgggtttgactgttttctgagatttctgaaggtaaaacaatggttttattcgaacagtctaacaacacatggttagctgcaagccaatccatacccaaaatcacactaaacccagtcaaaggaagacaaatcaaatttacagaaaaagatttatgatcaatttgaaaatcacaattaaaacaaatttgactagtagtaataggtttagttgtaggggtagaaactaagagatcataaggtaattgagacaagggtaattctaattgtacagcagtgtcataagaaataaaagagtgagtagcacctgaatcatataatacagttaaaattttgtctttaattatgcacttaccttcgatgagatattcagattgagaagcctccgctgcattcattgtaaaaacctttctagtatgctgaggacgtgtggtgccttgggaattttcagctctataattattagcataatgtcccatctttccacatctaaaacattgaacattgttgcgattgcgacaatcctttgccaaatgtcctatctttccacatcgggaacaagtaatctgagctatagggcatgacctgtttccatggttcttgtgacatttttcacactccctgcttgaactttgccctgtctgaaatttctgctgctgaaacttattcttaaatttaaatgactggggtcccaatttcttcctaaaattattacttaattctcttttctcagcagacctccttttatactcttctattattctacacttatttattaaggtaccaaactccctaatttctaggggtccaactacctctaacaggtcttctcttaatccgccttcaaactttatacatttccagtgctcatcagggttctgttgatagatagttgagaatttaattaactcttcaaacttagcaatatattcagtcacactacttcttccctgttcaagcctaagaaattcaagttccttagaattcctcactgacacaggaaagtacttatcaaagaatgttgttttaaatacctcccaggtaatttctatttcattacttattagaatttgcttgtggctattccaccaatactcggcattagattgtaacatgtacgtagcataggttactttttgttggtcaaaacaatctaacacagtaaatattttttctatttctttaatctattcttcagccacatatggattaaaggctcccttaaaaactggggggttagattttctaaattcaacaaacttatgatattctgtatcagtctcctacctcccatggtttatttgactagaactattatgattgttgttattttggcttaattgcatcatcatttgggtagctgcggctgcttgttgacttgctgtggttgcctgctcttgcataactgctagcatagcatgaagaatatttgtttcttcttcattgccactagttggtgttgtttcacttggacttcgcgaagccatgaattcctattcacttcacaaaaatattgaggtgatcaggctcaatatagagtaaagtgcgttagaattcaataatcacaaatattaacacacaaacaattagaatcaaacagacaatcaaagcacacagaaaaacatagtcagtccatttccctcaggacctaacaagatgaactgctctgataccaaactgtaacatcctaactaattttatttaattaattaattatttgcttattttaaattttattattttatccttttgagggaaaatataaattgagataagaacaaggaaaactaaaattttacaagaaacgtgtattagtacataaattcttcgttataaaatttacaaaatatgaaggactgatacattagtccatgtctctgatataaacatacaagtacaaatctcttttccaaaattcagcctagtacaatgcttcttcaatatatcgatactactccagccttaagaaatctgaccatcatttccatctaaaaacataaaataaatctagtgagaaataaatttctcagtaggcaaatctaaaccaccaaacacgttagaaggttagtaaataaagcaaatttgattcaacatacactttagcagattagtaaataactcaatatatctgaatgaatgcatgaatgtatgaatgcatggaaatgaatgcaatggccacaggtgcacatggtatctacatatcgtactgtatgtagctacatctcgtactggatgtagacgctgtgatcgtcttacgcaaacatgcatgaatttccatgtattagcacctgatctcttgaagtagcataggcccggttgtcacactcgggtcattcttaaaatcataacataggcccggtgttcacaactcgggtcaatctcataaaatcataggtctgatctttgaaaaccagatcaatctcaataattcataatataagaaatgtattattttccttccataaagtatggtagttaaccttcagtaaaagcataccaactagaatttatttgaaatttttacaaactatgtccggattctgagtttatggtatccgtgttcaggatgtccgggttccggatatatggtgtccgagttccgggtacaaggtgtccgggttccgggtacagggtgtccgggttccgggtacaaggtgtccgggttctgggtacaaggtgtccgggttccgggtacaaggtgttcaggttcccggtacagggtgtccgggttccggatacaaggtgtccgagttccgggtacaaggtgtccgggttctgagtatatggtgtgcgggttccgggtacatggtgttcgggtacatggtgtcagggttccgggtacatggtgtacgggtacaaggtgtccgggtacatggtgtcagggttccgggtacatggtgttcgggtacatggtgtcagggttccgggtacatggtgtccgggtataaggtgtcagggttctgggtacatggtgtccgggtataaggtgtctgggtacatggtgtccgggtacatggtgtcagggttccgggtacaaggtgtccgggtacaagaattaaaattattaaattcctaaattagagattaaagcctatcctacctgtgaaaattgtaatagattgcttagagaactgccaggattattttaagagaaaaggattttacgtaaaagaaagtgtttgagaaaatttaggaagagagtgaaagctgaaagtgtttgtatgtagattttcggtgcagagagtttgaatcttccaggctatttatagtgcttgatttagttaggatgaaaagggatttggttggaaagaaacttagttactagaaaatatctagattttcttatgtaaatcatcattactaatattctcttcataaatggtagatgcaacgtggaaaactactgaagcttgttcctgcttatttattttgcctaatgccatctggaaaggtcataagaaaaatgtgcacaaatatttggatagattaggaaaaaaaattgctacgtggctggaggctttatttcagtttaaaaattttcctttattctntttttaaagcctatcaatcagaaacaaaaatatatttttgtgaatgttacaatatggatatccaagaggatttttctagtgattttggacttagctgaaactttcacgtggttaaagactccatttttggatgctaaaatttgtccttaaaaattatattttattattataatttagatcatgaatatttatataattatttgaggattttacagatgaaacaagctcaatgctgttaactgtaagccattaaccagaaattcacccatcaaactattttcaactaaaacagcatacagttttgatgtaattcaagttgcaaaataacgagtcccagaatgaatacataaataggactgtatgttaagagaaaacagtgggtgcttggttattcaagtattgccaagtcataaaaaaaaaaaaaaaactacttaccccattgtcggaacgttatgcgtaggtaaaggagagtgaaattgtacgcagccttacccttacatatgcaaataagttttttccggattcgaatccatgactaacaagttatcaagtcaccaagatacaattacgtgccaagtcataaataagaaaatcttttaaatgctaacgatcaaaatgcgtgcgataaagataataattcatgctattaatttcatcaaactaatgattaatacttaccaaccaaccaatttggatgctttgttgattactccccttgaaacgctagtcttgcaaatacatagacacttgctttgtgatcaaagtgtttcaccttctcaatatatgtttttcaatctccaaaagcaattagcatagaagcatcaaactctttaaagctcgatcgacatcacatgcatcatcaaatagcataaattgggcttacttctaaatcagtttctcacccggagtttgatccactcgtgaacaagttcttctcttttctcctagctctttgataacgtttactcttgagcacatagtacgcatagtaccaagaacaccaagcattataactcccccaacaacagtaacaaacattgcagcccactcgtgatgcctaccaacaactatatgagacgctgatgtgaatgcaacggtggtgcatatagacgccaaccacatcatcttattgatcaccttcactaccctcatctcagactttgttctccctctcacaagtgtgatttgaaccaccacaacagccagcgaagagaaatgcgcaacagcgttgaagatgaagaagatatctaagggtactgtgcctaccatcactgccaccccactatcatagtctccaccgggaatgctgaaaatggccgcaaacgcaagcgtggcaaagagaaccacaaccacctttatctgttggaatgaaattttagaagtgaagaaaatatttgagaatgagagattagaaatgttttggaggaagagggtacttgtggcttgttccattgtttctggtgagttgtatgatgattcagcttgtgtattttaattttaatgtgggatgactttttgttagatattggattataagatagcatctcaactgcaggtcattttacatatttcagttcccctaagggatattttagtgtatgtaatataaaaacaggctactaggttagttatgacaggacatctttccttagtttttcttgtataactctattagtacttgtaaaaaaattccaatttgaaaattcttagctcctcactaacaatgattagcatgggctgagtactttgagtttgagccaaacttaggtggaggtagtccaaccacagccactcttctatactggtttgtgttctcaacttatctgggactaattactgttttatatttgtatgctcaaatgttcaataaaatgacccctttacctgcaacattagcaattgtatcaactcattatctagtctcattagcttgtgctaactttcagagtcatttagatgttgcaaacacggagctttgtaaaatttgttaatgatttcttgggccctttattttcaacaattgtagatagtaaccttcaacttcacgatggtgctatattttacatggtaatctttattgtttaaacgagtttatatatgcataatgaaaaggaattgcagtaggacagctctcttattctccacaaccatcctttattcatatagacgaataatgagcttgtttgtttaatttttccatttcactggtatgagaaataagcataactgtcctgcccttggaatatggaagaatttatgggatattttttacatgaataatattcaaagggaacgaaatggagttgtgctatcttaaattgttggaactctagaatttttcttacacgctacaatttgttacattgtattattgtatgggacttggaaagtaaacatgcttccctatccattgggcaagtcaattatgaataatggcatggctaagctgagtttctttacctttattctgcattaacactaagcttcttaacatttgaaagttgtagttctaatttaaatattttggcaccgttttcttttatgagataattagatctcatgaattttttttcttttccagattctaaaccttgtacagaccaaaaaaatgtaaggcataagataatcgttggagttggatttggagttacagctctattccttgtcattatcatagttggaatcttttggtggaagggctacttcgaaggaataattaggaaaatcaaaggtaaatatatactatcatgttcttaccattctgaaattagtttacttcatttgcttcttaaagatttccaagttcaacttcccaaaaagtcaatcacttgacttagcgtctaggaactgtgaagttagctaggtgctacaagacgtggtcaggtaagattgaattaatatagtacccattatgatagacctccttagggattaactatgaccaaagtgggtaagaaggttaagataataggtcaaaagcaaagaacttgccttgattttttactatggcctccaaggcatccaagaatatgcatttagaaaagtattcattcttggatccaatagcctttgaggattggagataacgatttatctcttctgtgggtggtgttttatgcgtatgaattatttgcatccacttattgccttttatggtgacaagcatttctatgtatattgacacataacaagcatttgacacataacaagcatttgtactttcctcaaatactcttaaacaatgcagatacgtttaacttactacgtaaaatgaaactggatgttcctctggaacacttattttacggctgacatattgaacaggtactgaaagacaagattgtttaacggggacatttacgttaaaacaaattagagatgccacagaggatttcaatcctgataacaagattggagaagatggttttggtcctgtctacaaggtattagagtgaacggccttttttcttccaagcataaaaattgatgttcctccctagcatttaaaattctaaacaactgttggattgcagggtcaattatctgatggtaaattggtagcagtcgagtaacactcatcaaagtcgcggcagggaaaccataattttttgaatgagataggcaagatatcttgtttgcaacaccctaatcttgtgaaacttcatggattttgcatcgaaggggatcaattgatattggtgtatgagtacatggaaaataatatcctggctagtgctttattcagtgagtttctacccaggagtgcaaactattatgtttgtcttttgccttgtcatttattatatgttttgtaagataaggtgccaagtgttaattacttaattatgataaatcacttggagatctgattaatctgaagaagtttgtttcccgcccttttccatttttctggatacaaaataaggaatgaatgagtgctatagctagttgtttttccttccccttttgtctagacaaattaataccgtggttagatttttatactgttaaacttttcctttttcccatttctatcactttagcagctaggcaatagaattttgaaaccgtgattcatattaattcaaccacaacttctttctgcatcttttataggctcaaaagatcaacttaaacttgattgggcaacaaggcttaggatctgtattggcatagcaaaagttcttgcatttctacacaaagaatcaagactcaagattgttcatcgagatatcaaagctactaaggtattactggatgggaatttaaaccctaaaattaacagattagtatccaaagctactaatctgttaattttgttttacagagggtatatggcaccagaatatgcattatggggttacttgtcttacaaggctaatgtttacagttgtggggttgaggtcttggaatttgttagtgggaagaactataagaattttataccaagtgataattgtgtttgccttttagacaaggtattctactatgcttcaatccctgatacatttttggcgttatgaatcccttttgttttggtagttatccaatgcaaatatccatattttcaccattctaaagaaaggtaacaaaattcccattgcaggcatttcatctgcagcgtgcagaaaatttaatagagctggttgatgaaaggttgcgaacagaggtaaacccaaccgaagcaatagctttgatgaaagtagctctcctatgcaccgctgtaacaccttcacgtaggcctacaatgtctgaggttgtgaacatgcttgaagaaagaatcagcattccaaatgctatccaacaaccaagtgattttagtgaagatttaaggtttaaagccatgagggacattcatcaactaagggaaaatcagtttgagtacaagccgaacaaacaatacaacagaagtccttacacttagctctccctaaacatttggcaatgacctggtgttagttcatgatttcattgttgctgaccatattgcaacatgagatatccttagagcatagctgagatttaatcttttgggataaccaactgtaatgatcaccatttttaggatataacatttttcactccgtctttcagagaatatatttacttctagatccgtataaatttctaattgctcttgaagggtacttttttttaacctgggcatttcattttgagaaattattgtatggttcggtgtagtcccagttaatcttcatatatgacacaatcacaagttttcaatttatgaaaacaaaattggcgtgtcatgtggagattgcttgaactaaaatgatctcggaccatataatttctcatttaagaggtgcatatgaactccttttcactggatatacacagtatttggagaaagaatgtacatacgcacccttgaacttgggtgttatagcaaataacaacttggcgaaagaatgtacatacgcgtcttaataatctttgggagactaaaaacccgtttgttatatctttctcaacttaagaacggcaaattgtgtttctcctttttatcaggtgtgtggtgtgtgggttcactgggttggggagttagtgagaatttcaagttcagtgctatgctcagtatgacaatttttagggtaaaaagtaatagtgggtgaagtaatacacctacgtagtgaagaagtgtctgtaaggaataagaaatcaagtttcaacgctgccagccatcacaattatgagaaaagaaaacttcgagcttgttcggattaatttgtaaactaagccaccttccccctctttgaaaatgatttagttaagactgatgtgtataaaaaacactaaattttaaacctctttattttgaatattctactttggaaaaaaaaatgattattaaaaatttttattctcacattaactccaaatttgattctaatccattataaaggtgctgcaaactcgagtataatcaggtattaaaggatcaggaagagacgcaacacaagcaaaaatgaaaataaccatcataagttgatacaaagaaaccaaacatactttaagaaaatataactaaaaagacaacttaaactactaatggttgcattccataatgatcagcttgggacgtaggacgggataatatagagaataggtaacattcatgaacactttcaataatcactgtaggttccaattcggtcaattatgttagatgttagcaacagtttccttgctctcccttaggactttgacactcctctgcagcttttcacgcttcccagaaattgaaggtgactcctccaataacctctcaatcccaccaccactatattggaaatcgacaatcacacacaaatcgaaaaacagaaaagagaataggaaagagaaatatgacacagtattttaccctggttcacccaatgtaggctacgtccagcttgtctgtactataatctcctcaccgccactcgttacaagtcacttggtttacaagggaaatataaataggattaaaagaaaccctaacagtagctattcatgggccctagcccaaactactaataaaagtaaaatattacaaagaatcagaggcccacaacagtacctagcctctacgggcctggggcgctgccccccggacccccgccggggcggcttccccggacccccgcccgctcacctgggagcgggaccccagttggctttctgctgaccccgccaacaagaagggttgtcatctgactgcgaaagatgagccatatccaacacactaggggataacagatcatgaacaatctccttttccaaatccttgttaacaagattgttaatactcagcataagatgtaaggcaatggtgtcaatcaatcttttctgcactatcttccagtacgaaatcatcctcaccttcaaatcaaatgcttgagtaagcacagatgggtattgcctcaaatgaccaacttcaattttgcccacaccttcaagattcacatgcgatggattattcgaatttttcaaaacttcattcagaaaagcatcttgctgagatattaacttgttgtattcctgcacaaactcaggattacaagcgtaatcagtatgcatctccatttcaatggcctctattacatgcttggtggaacttttcttcttcttagaaataagaacctggcttgcacgcctggtagacatcaaaagctgatagtagttttcagaatgacgcgtgataactgaaatcagcacatcttcaaggtagttccacacattttcaacaaaacctataggcttgttggcaattccattcaccttcccttgcaatatagaaagaaaagcagtgcgaggcaagaaatttggaagaccaatccacttagcctcctccagcacctttatctcttgcataagaaaattcttgcttgtatcactttcagcacaagtgtaaagatcatttgagtaggaatcaagcatatccaccaaccgggcagtacaatgcatgtttttgtcttcggggtactcatcaaattctcctctaagaagaatttttctgagagattcttttgtcaatccaataatatgcataaaagctgtcatggcatcggctactgaagccaagtttgttggcaacttttccaactcagacaaattgttagctagcttctcannnnnnnnnnataataataaattaataatggagggagtataatatcaacaatttttttcataagagatactccctcaatcctaaaagaagagttatcttagattgtttacatatatcaataaaaattaataaataatgaaagacaataataattttacaaaagtaactttaatattaacatttattacatttaaaaactataataacatttagtggtaaaaaataattaatattatattaaaattaaaatacaacacttattttaaaatacttttttccaggaactttagaagatatattctctccaaggttgtattattctatatggatcaaacatagatcctccccacaaacacaacttatattgttaacggaattacatctattccattggattgttgaagttttatctattcctatgttacaacatttataagtttaaggtttcattcttaaataaaactataagactgattttaagagttattccattcttcatctaatcatgtatgtatggtttcttttctatagactattgagcatcttattttacttttttttatataattttttattcttttcaaatactatnnnnnnnnnngtacgaaatcatcctcaccttcaaatcaaatgcttgagtaagcacagatgggtattgcctcaaatgaccaacttcaattttgcccacaccttcaagattcacatgcgatggattattcgaatttttcaaaacttcattcagaaaagcatcttgctgagatattaacttgttgtattcctgcacaaactcaggattacaagcgtaatcagtatgcatctccatttcaatggcctctattacatgcttggtggaacttttcttcttcttagaaataagaacctggcttgcacgcctggtagacatcaaaagctgatagtagttttcagaatgacgcgtgataactgaaatcagcacatcttcaaggtagttccacacattttcaacaaaacctataggcttgttggcaattccattcaccttcccttgcaatatagaaagaaaagcagtgcgaggcaagaaatttggaagaccaatccacttagcctcctccagcacctttatctcttgcataagaaaattcttgcttgtatcactttcagcacaagtgtaaagatcatttgagtaggaatcaagcatatccaccaaccgggcagtacaatgcatgtttttgtcttcggggtactcatcaaattctcctctaagaagaatttttctgagagattcttttgtcaatccaataatatgcataaaagctgtcatggcatcggctactgaagccaagtttgttggcaacttttccaactcagacaaattgttagctagcttctcattgatcttttttactatttctggcaaagttttagatatgctcatagcctgaacctgaaccagtttctgtgctagaactggaacacccacgatagactcgtctattttggaaagaagtggatggaactcaaacagtttctgttcttccactctagcatcctcataagactcatcaccaatgcggtttctcacacaaacataaccaagaccaatgttcacatcatcggcagtaactttttctaacaagccctcaggagacttgtctgcctttgtgaccacagccagtgtcctgaggccagttttgtcaacactctgagacattctaatagactcacaagtagtgaaatcaacactagccgaaagaacattcaggataatactttcttctggcttaatgtactccatgatcatgtctttaatctggtcataaatgttctcaggttgaccatgaaccggaacccgagttataccaggaagatcaaccattgtgagatcaggaacaccattcttcttcaccagcaaagtcaaagggttgttggaaatccctttaccatggcctgcaagctcttctgtggcagcatttatggcatgagaaacatttgcttcatcagtggaaacgattttgccattgaactccaagataagctctggggtttgaagagggtggttttggagcctcatgaccaagggcaccctagtgcaaatgccttggccacgtggcaagctgataccagcaagagattcaagaacacttgatttgccagatgattgatcaccaacaacaacaatggaaggaagctgaattccctcctttgtaatgttaaggcgcctgagattttccatagcatcaagaactggacgtatcctctcattgtaagaggacacaattggtgcaacaatagcaagaggctgaggctgttctgcagatgggtcagtttcacattgagaaacagatggtgcaacaatagccttagtgataggtctccttcctccagccattttcaatcacaatcacaatggtaaaaaatatagagagggagtgagagagggatagtttggtatgcttatgcttatgatgagtgagtgagtaaaatgccagagcttaaatgcatatttatagattaaaaaaaaaaaaacttagaggaaaatgaaaggaaaggacagtttggtttggtatcttgaaagttgaaaacaagcgtgaattgagcttttcatgggaaccgcagttacagagccgttggggtcttccatgtttaggtaattgaaaggtttctcgttaaatgcatgcatggtagtaattgaattgccataaatattagtaatgaaaatttcttacattaattaattcaactcaagtagttttagttaaaccaaaccagaaggggaatatgtactaaaaaaaaactgaagggaatgtagttaaggaaaagggacaattcattttataattcatctaaggaagctataaagttttatttatgagtagttattactattgataacatgcttcggcagtatgtcctctctagtctctcacatactatggcatatgtatggtcgtgacctgtgacctgtgacctgcatgtgacttgtgagaaaatctttgggtattgcttttgttgtcttaaaataaaataaaaattaatggtgctatttaattagtatggaaaatggtgaatatatactttgtttttttatgtatttttttgtgtgagggatttttgtttattttttgatgtatgacaggaaaaggaagggataaagagagaaaatactaatagatgataaaagatgcgatggaaaataaataagttttcatcattgataaaacaaaaatactattacaatttaataataatataaagttctcttagtatttggaattttagacttaagatagaaaaaataatttgtttcattttgttatttttaaagaatttaaaatatttaatataaactctaacgaaataaattataaaggtttagagtaattctattctctataagtatgaaattatgagccagctatttttaggagaagaatttttatttttatgacttttagttttcgattaaatcctagtaaaactaaaattttatagtcctgcattagttattcttctaaaatagtaatttcgtttacaaacaaaagggtgaaaaaaataaaaatgacgaaaatacaattccatacaataaaatcgtatttttttatatttttattttatcattgggtgttactattacgtaaatggaagtaaaaaaataaaacacaatgttattatgtaagtgtgcatgacaatcatatttttgttgtgtttttttcttttttttatccgatttacataattgaaacacatttttgtttgttttgtttccattcaagagttggaaatacagctaaaaggcccccacttcgctagtgccaataggcaatactctgtagaatatgcaaaggcccatgattttcattcttctactgggccaacacaaagaacctcgggaccacaattttatatgttcgagttaaacccctttttatggcccatgattttaactttttcaaaaagatatttttaatttacatgtagtataatttaattttagtttaccagataaaatattttattttatttctttcttctataaaattttacaaaaaagtttattcaaaaggaccttaattaaaataaattaactttaactcattttttaactttcaaaataatattcggtaaaacaaaactatcaaaatagtaaagaaaaggaaaaattgtatgagaaattcaaaacaccaattaatcatgactcgtggcatttgaaaaatcacaggattaataagtaagttgccatannnnnnnnnnctcttgaccaatatatttacatgaatcataatcaagtattataatttatttcttataaaatgtgatatttttaaatatgtgttacatataaaaagtgattgggatgcatgaataggtggttgtctagaatcatctaataatttttctttagtaaatagatatgatttttcttgttcaccaatagttttcactaattatgaaataaaataaaagatatttattggacaaaatatgaaaatattgaagataaaaatgttttttaatagttttaattacttattttgatttttggaaaatatttttaaaactaaaaaggttaccctaaacataatataacagcccagtaacatcaagagctggaacatgaaagagaatttgataattaaacatataaatgaaaaacagtacagtaaacggagatgttaaactttattaaatgacacctttagtttttttttttactctaaatcaattaattttattattaaatttaaattaaattcttttaaagttatatatagttaaataattagtttatactttattattttattttaatgtatgatatattttatatatctgccaatatttaaattaatcatctaannnnnnnnnntaataataaattaataatggagggagtataatatcaacaatttttttcataagagatactccctcaatcctaaaagaagagttatcttagattgtttacatatatcaataaaaattaataaataatgaaagacaataataattttacaaaagtaactttaatattaacatttattacatttaaaaactataataacatttagtggtaaaaaataattaatattatattaaaattaaaatacaacacttattttaaaatacttttttccaggaactttagaagatatattctctccaaggttgtattattctatatggatcaaacatagatcctccccacaaacacaacttatattgttaacggaattacatctattccattggattgttgaagttttatctattcctatgttacaacatttataagtttaaggtttcattcttaaataaaactataagactgattttaagagttattccattcttcatctaatcatgtatgtatggtttcttttctatagactattgagcatcttattttacttttttttatataattttttattcttttcaaatactatcactcatttttagtttttattttatttaaattttaaattctaagttcttttatagatatagttaaattttagggttattataatcttaattaatgcaaataaatttattttgaattttagcattatattatatataccaataatgaggatttgtttaaaatgattatgattcatttccataatttcttctccaatttggaaaagtcttatacctataatttattcctatttaatataacaaaatatgttattaattattaaagtactgatattctccttaattttttttcattaataaatttatgaaaaatcatagagtgtaaaaaaattagaaatatttcatccataattgaacaaaatataaaaaaaaaatatactgtcatttaattataaactactacatgtaagataaaattgttactgtttataataattatttttataaattataaataaaatcaagttgattattaactttacattgataacataaatgaaaactacacttaaaaataaaattacaggtatagtaagctagcaaattatatccattgcctgtgtgagtaaacgaacatgacgaatcgatgatacaatattttaaagtgaactgaatcaactcatcttcgcagtcatactattatttagccggctatagcttgctaattgaatttgtaatagattgaaacatcatccaatgggtccaagtgtcaagtgggattctgttctgctaccctacctgaatcgaaaagataatcaataaagcaaattattataattttcaccatcatccaaatttatatattgtatgatgtgatgtgaacgccatgatgtctataatatctgttggtactctttaaattttatgtaaagtgtatgaacaaaattattttctttgtgacattcataacagactggagtttataagttaattaatttattgcccagtcagtattaattacgtactagaccatttttctcagcaaattgtttatttttaataaacaattaatctccaaataagaagttttagtatgccatattttatttttagccgtgagtgattgccaacgattcaaagggtgctctggcgttgattaaatagaaacacttaagtgttgggaagctcttgtcttggatgatcccctagtctttttcttgctggagagttgctttggttacatgcataaccttcaaagaagatttcaaatgcctaatattttatggaacttcttccatgactaaaaataaagtaattaatcttaattttttataagaaaattaacggataattttttttaatatatatgtatgatttgtatatgtgtatacacacgaatatatatcaactttatgttgattttgtcattagcaatgaaaattagttgttttattttctaaaataatcatgtagtttaaattggactacactactgaaaacaagtacgtgatgaatctttttaataaaatatgttttttttatctttataaatatccttaaatttaatttattatgtcctttatttttattttttaaaaataaataaaagacatgataaattatacaagattaaatttaacttatatggaaaaaatagttaaacaatgagatatagattgatcttctctggaaagatggtgatccggttcatatgattcattttttagtcatttttcatcttcatctctcccttcttttattattcttttcgtttatctttttttttaacctcctcatatttattattgggttcatcgatcactaatctcaattaacttgagttaaaaatgttataaatgttaatgttatatatatatatatatatatatattaggacactaaattatgtgatttggtaagaatttaatgttttcttttttattcgtgtgagaatcaaattcagatatcatcaaatttatattgaggcagaatgcacgtatgtagattagattatggtagttgtttctaattttagtgcttgagaattgagtttcactttgttataatcataatttgagatcccccaatctattttggtaggatatagccattttgtactcgtcattatgcttcttgctgacgctgatggaaaactaccttcgaatcttcctgttctagagtcggcgaatttccatgtaaatcaattttatcaaccaagcactacattctccttctaattccgcagaactggtcataagccaataaatgatagtgaccttattaattaattatgaggcatttggtgtgtgcataattatcttttacacatgcattaattgcctaattggatggatgtatgtatatatagggaagagaatgctattcccttgttgtatttgactacttccatttcttttgaattggctattacaagaagttttctacagagtcatggaatttcattatttttgcttcatttgtttatattattgcatgcttgttccttactgttttcaagtttcttgcatgccacttactgcttcatttgcacgcaggaaaatcgtgttgttgacgggaatgtggagaagatgcagcgggaggagagagcagatgagctggttgttcatggaaaagttgattggaaaggaagaaaagctttgaaacacgtacaaacatggggggatgaaagtttcgtacttggtaaactaggattgacatatataatatgagttcataaacagtaattaacatgaaaatgcatgtatatacatatactaattaaggtgtggattaattatactacctcgtagtactaattaaaccctgaagtgatggcaagtccttaatttaatgaccacttaccatgtgtatataaaacaatgcaagtttggtgtggattaattatactacctcggagtactaattaaaccctaatgtgatggcaagtccttaatttaatgaccactaaccatgtgtatataaaacaatataagtttcattacatattgttgtgtctttaatgtttaaagcaattaattaattaagacaagtgtataaccagttacacttagtacattggtaaagaaattaaaaaatatatttttattgaaatacataaaattatattatttataattttttttacattcttttataatttttacactatataaatatattttttaaaattttttaaccaatattctaaggagactggtcgacacaagactcataaattaattgtgcacagtgcatatacactactcgttcattaattgatgcagtacgcaagtgttaatttgggtttgcatgggtgcatgcagcggcatttggtatagagaacgtagcaactctgtctctagcagtgaacttggtgtcatacttcactggtattatatatgcattatgaactagcagatgcagctaacatggtcaccgatgacatgggtgctaattacatgctctccattgtggtggccgttcttgctgatacttggattggtagatacaaatccgttgttatttctggaatcgtcgagtctttggtaagatccaaacttaccttaattccttattgcataataacataagttactaatcgttattggtaaacccaagactatatatattgtttatgtgagtttgaccaaatatagcaacgtaaactattttttaaacccacctttatacctattctctttttttttttttcgattacctcatttattatttttattactttctttcttttatctctcaaagtnnnnnnnnnngtacgaaatcatcctcaccttcaaatcaaatgcttgagtaagcacagatgggtattgcctcaaatgaccaacttcaattttgcccacaccttcaagattcacatgcgatggattattcgaatttttcaaaacttcattcagaaaagcatcttgctgagatattaacttgttgtattcctgcacaaactcaggattacaagcgtaatcagtatgcatctccatttcaatggcctctattacatgcttggtggaacttttcttcttcttagaaataagaacctggcttgcacgcctggtagacatcaaaagctgatagtagttttcagaatgacgcgtgataactgaaatcagcacatcttcaaggtagttccacacattttcaacaaaacctataggcttgttggcaattccattcaccttcccttgcaatatagaaagaaaagcagtgcgaggcaagaaatttggaagaccaatccacttagcctcctccagcacctttatctcttgcataagaaaattcttgcttgtatcactttcagcacaagtgtaaagatcatttgagtaggaatcaagcatatccaccaaccgggcagtacaatgcatgtttttgtcttcggggtactcatcaaattctcctctaagaagaatttttctgagagattcttttgtcaatccaataatatgcataaaagctgtcatggcatcggctactgaagccaagtttgttggcaacttttccaactcagacaaattgttagctagcttctcannnnnnnnnnctttagttatttttttttactctaaatcaattaattttattattaaatttaattaaattctcttaaagttatatatagttaaataattagtttatacttgattattttattttaatgtatgatatattttatatatctgccaatatttaaattaatcatctaaaatttaacaaatatatataattactgaaataataccttatttctctgtcactcggataacagattctagctagggtgattattagacattatataattgcatgtactcatctactgattaataatgatatcaattatttaatttaattaaataaaacgaattagataagaagtattttaaagctattatttaacaacttatattaaagtaaaaagtttaatatctttaatagaagatttcattttaagatcttaattattattttgactaatcctataatgttatattactttaaaattttattcatattttattttaataatatatcttattttaagatcttagaacattttttatatatcctacctacactaataaaatgcaagtcaattttgtgaaaagagtaaaaaattattatttttaaatggatactctaatagtcatgcactaacattatacattgtccaataaataaatcagttatatatatatatatataaccaataaacttatcacatataatatacaaatgttttacatattatcttttttctcttaaataaaaccaattgaaagtaagcccaatttatatatgcaactaatttactttaaataattttctaaagcttattgaatgtgttgtatggactggcattgcttacgatacaggcacgcgtgggtagcctgacaccacccatttgcaacctgtactatgtgagagatgcacattgtgaaaagcttagtgggaagcaagaagcatttctcttcattggcctctacttgttggcctttggcagcgcaggtttgaaggcttccctgccatcacatggcgctgatcaatttgatgaaagagaccccaaagaagcaatgcaaatgtcaagcttcttcaaacggtatctttttagcactttgcgttggtggtgcagtcagcttaacatttaatgtgtatatacaagacaataatggatgggtctggggctttgggatctccaccgttgctattgttttgggcaccattatctttgcctctggattgccactataccgaattcatgctgcacatacaacaaacggaatattggagatcattcaggtatacactcttttgcaaaccttgttctgcatgtgctgtatatatttcaatttgaaaatcatatttttttttatacttatgatattagtgtgaaatatttattgattttattgataatcgattaatctccatcggaaaacctagttgatcgctttaagtttaagtagctctttcctctccaccatatttttttcatccataaaatttaaattcaagagtattacccagaataaaatttgttggttgaaaaagtatatttttgagttcattaggcatgcattatgaaagtaaatttttttttatacaaattgttaaccaattaaaattgattcttagtatgacttttaaatagtatattataaaaagacaaattaataaacttttatgaaaaccctttacattgttggtagatatattacttaattctatttttatttacttatagtctgattctgatacaatacaatagttgaagtttttaatttagctcgatattgcaatgatcaagcgcattagttttgaattcttcgcgtctattttccaggtctatgttgctgcaattcgcaacagaaaccttccccttcctgccaatcctatccaactatatgagattcaacaggacaaagaagccgcagtggaaatagagtatcaacctcatagagatattttcaggttcaatccgacaatgtctaatatgactgaaatactatatgttaattgttgatagcttaagtattaaagagtaatgataaatgtatataccatggagattctccacagtgtctacctgtcacacatggctaaccatgtgtgcaaataaatatgattaattgtatacaattatccatttgaatttatattgcttgtatttaattaactatatctgcaagtggttaatagtatcacgaagttatgaggttattgaaatgtttaacgttggttaactttacctaacaagtcagaaatgattaataggaaatgaacttgtatatataattatcattatgtactattgacacaaataattaaatatgtctcacaagtgattaattttcttttgcacagtttcttggacaaagcagctatcaaaagtagatctaatgagcaacctgagaatcaagagactccaaacccgtggaaactatgcagagttacccaagtagaaaatgccaaaatcattctaagcatgctcccaatattctgctgctcaatcataatgaacctttgcttagcacaactccaaaccttctctattcaacaaggctcaaccatgaacaccaggatcgccaagcattttaacatcccacctgcatctataccaatcatcccagttgccttcttaattgttttcgtccctttctatgatcgcgtttgtgttccttttctaagtaaattcaccggtattcccaccggcattacacacttgcaacgcataggagtaggcctaatactctcttccatctccatggcagttgcagcaatcatagaggtcaaaagaaaatgagctaggagacaacaacatgcttgattccttgctgtaatgtcttggatttaagcatgtgattaagcctatgattaggatcataaccaggccttagagtctcaaaaaggaaagcaataggttgttctgaccatgtggcgcgacccgcgtggggtctggcccaatccgcgccagatgtttagatcaggccaattcttacggccttctgacactattagcgtggacatggtgctactctcgtggattgttcgagcctgtggcgcggtcagcgcgagatccggcgcaatccgcgtggaagacttgaatcaggccaatactggcggccatctcacgttatccgcgtggctttggcgctaacagcgtgagttgctcgagcctttggcgcgatctgggcggaatgtggcgcgatccgcgcgggacccacgggcaggcttaaatacaactcattctgggctgagagaaaaagagaaaaagagggtgaaaatgaccattgatgaccctgtaagcttcatatcttttttatttctcatttaaacacctctgacccaactgagaaagtgttcagagcctcgagataagctagagacccagctttattctcgacacgaggcagtaaacggcgagatcgagtttatctgggagaacccttgagagctcgaaacccaaggttgaaggaagctgtgtatggttgatttgtcttgggaaaagtgattccctggtcttccttgactgcatagaggtaagaaactcgagctctagccgttggttctgtgtattggattttgggggattttgagtaccttgagaggtgtttttggaggtgttagagccgttattaggcttggacactgtagagttttgtattcagagggttactctgatgaagttagagccttgagtcatcattattgataaagtttgattttaactctgagtatgtatgagcagaggtaaaaggctgattatttgactagtatgaaccttagagtagttgacaaagttgttcatgggataatatagatgttgtgtgtgagctggaattggtgataatgagaagcttgaaattgatctggataaagcagggatatgttttatattagcctgatcagagtcttagaagaggttctggagccttgtgtaggctgagtaggatccttatgagggtctgagaatcacttgtgaagtgattgttcttgtgttatgtagaaaggattataagtttcctttcgttataaacagcttaaaatcatatttgatgagtatgtgttgttcttatgtaggacgtgagcttgatagtcctagtggtggtgaccacgaggccgggagagccggtattttgcctagagcaggtaagctcttggttcttgcatgtgcgtcctttactgtgttctaccatgatcctgatagggtgatggttctgttgtgattacatacatgtatatgaaaattgtatgttgttatgattacctgttgaatggtgttctgtaccctgtgagagggcaattgatgtgaattgatatgagatgcttgacctgtgagctgcaccctgagatgggtggttgatgtgtatgaccataaattgtctagcgtatgacttgcatggttgattgttgaatcctatggtagtaggatagatgacatgagattgagtaagacctgatgtgagatgttcctgtgatatagacgtaacctcccgaatggagatgttcctatatctacagatatagcctcctcaggcaattgtattgagataggttatgagatgttcctgcaatatagatgtagcctcctgggtggatggagatgttcctatatctgcagatgtagcctcattacaaagagatgttcccgttatatagatgtagcctcctgagtggagatgttcatatatatacagatgtagcctctgatagatgtattgagatcctgccatgagatgttcctagtatatagatgtagcctccctgggtggagatgttcctatatacatagatgtagcctctgcaggatagtgatgtatgtgatgaatgactgtatgccatgagtatagcctgattgttgtcaggtgaacgtgcattgatggtgcatgatgattgattgagtgatttactgatgttcatattgcttgtttggatatactattttcatgtatatgtatgaaagtgaatcgggggaaggaaatacctccaagggccctgagtttcctgggattttatatttcaccccttttgtgggacttatgttttcaggtgaaccctcaggaggagcagatagatcccaaggcaagaagcctatgcagggatagctgtattttgaaacattaggcatagatgacatgagcatgtggctctgatgttttatattttgcctttggtttggttttgttgtaccctaaggggatatatttgtacagttttgtacttaaaatagagatattatgaggtacagtatttatgttagtgacctttgatgaagtcactcttagtttatgcttccaaactgcttaaactctgatgattatatgtgtgattgttgattaatgtttgataatgaccctgatgattgaatgggacgttacacttgccagtattacagccattgccaattagtatattctggatttcttttcagtattttgtatttggctagctgacatgttaacctacgtggggcttcttgagtttttctattcagaggcaccaaaaagccttaaatccacagcaacatgctttctctggtgtgctatggcccttggctattttctaagttccataatggtgaaaattgtgaatagtgcaaccaagaatattactgcaagtggaggttggttagaagggaacaatatcaacagaaaccatctgaacttgttctacttactcctttccatattgagcttgatcaacttctttgtctatttgttcgtttcaaagaggtacaagtacaggcctcaacaccctgcagttactggtggcaattcagaggagtgaatattgggagataaaggtttagcttaatatgattaatatggagcagtgaagatttagtgggttgtactgttcttcgtttgtcaaaaatctatgtgagtaaatagatagaggactgcacctttaattattttccttgtaatgtcttgaattagagctatagtttccaagaaatccatgtgaagtttttattttacctttgcctttggttacatttgatttctattttcacttttgctagaaatttttaaaattcatgaaaagttgtattttaaaaccaataataattgtacaattaaatttaaaatagttattttgaaaatcaatacattagaatttaataagattaacttatcctaaatagaaaaggacttatatatctaattaatgtcttaagatttttttggattaatatgtagtgtaaagttcatttgtatgggttgtgtgtgatttattaatgaagatctccctaatgttttatccattgttttcctaaaatcttttttttttgacaaatcctaacatctatttcatcataattttgatccatgattaattgattaaagcttattaacctatttttaaggtttaaatatatttattagttcctcaaatttttgaaaagttactttttattcaatagattcatggtttcacaatttataataatttttaatcaccaaaatttatttttaaatttttaaaaaaataatttttcacaattttaaaccgacaaaatatttaactctatgacttgatggccattgtttacatattgtgtttgttttgaagaaaaatatagttgtaaaattgtcataatttttaacaaattaagaatgttttaaactatcataaatcattttaacaaattatgacagtgacaaattgtgaggtattaaaatagaacttcagttttgcaatattagagtattacaattatgacagcgacaagttccggagggagaacggaaagagactttttggaatgaccgaagcaaaaacagaagcggctatatatatatacagaatcccttcatcgtgcaagcaaaagatattgcttcgtctgagccaagtaaaccagtaatgttacacaagaaatgatagttgaaagtactgaaaaacctaaatgtgtatcgataatatgatgccaaaataaaaacataatctagataccaaggatcaaacaaaagggcaaataacatgttgcaccccaatgatcagctttgttcataataataaataaataagtgaaaacttttcaagtcagtaggtagaacatctaatttaaaagctaaaacacgaaaaaaaattctataggcgttagggttcacaactgtacagaaaatcatacaaagtgtcgtgagagcagcaaaggaaccaaaagcttagaagatttcatttctgtgttttttgaccgaattgaccttagaagtagagacggaatatttttgcagtcgctgatgaacaaatatttgtcaaatgcaatttgagtagttctttcattaaatagttctaacagattttattttatttaaaattttgtttgattttgaggtattaaaatagaacttcagttttgcaatattagagtattataattctgcatatgaatatgttttggccataacatatttatttttcattattgtatcccctgtatcattcttacttgcaattagcacatttaaaggttcaactcttattataactcaccaattttgagtgttcaacataatttgtccgactaattaaaaaaagatatatttatccgtacattacacggaaaatcgtattaatttatcttaaatttatattttttcaaattatcatgataattaatgttccttttttaattgcttgacaacacattctctcttattttaattagcaatattctattataaaaataattaatataagaaatattataaattaaatcttataaaaaaaaccattgttttaaatttagatcttctaaataaaaataaagtatttaaagatagtgtataaataaagtatacaagttgttatttgattatccttaattgatggtcaagaggactctattacagtcttataaaacccggtttagcccggtcgattgtaccgtgaaccgtagatgtatctgggccaagttgggtattgaaccggccatgcatatggcccgatttggtccggtgaaatccgactgattttgttcaaacctgggaactcggccagttattgaaactcggaccggattgtgcttgaaaaaaaataagctgaaaacggtgtcgtcatcgttgccgcgccattgtccagtctccttcatgccaacgccatcacaccttgcagtaggaaggaacgaaggtgcagcgtagcagcaagcatgaggctgtcatatatgttgctggtcccttatctttccgtcccttgaatgctcacagactcaccactaatgtctcaagcaattacctttgaccatgcattgagattcatttgaaggaggaaggtgtgtagcatccggcaataggaagaaggaggaagcgcagcagcaacttaaaaagaagaaggaagagctggataagatatacatatagtgggaattgattaggttttccttatttgggcggggattgggccatatccaaacgtttactttctgtaccccacttattgctttatgcagtttctttttttgctattttgatttcgataattgttatttacactcgtttttagtattaatatattttatttgtattatcaactttaatacttcaattactattttggatttttcagtatagaattatgaatgaatttttcttaatcaaataatgttagttatatacgtatatataatataattttgaattttttaatataaaccggatcaaaccggaccaattactgacccactagttggaccacggatccaatgactcactacctcgaccagatcaatgatcagaccgattttcacaactctactgtgttggttaaaaaagacacaacacttattatattgtaaactctctcccattattgtcagttctgatgaataaaaaaaaaatctttaattgatcatgttatattgacttcttaagtgaggagtgggagagaagagagtatatacctggaatatgcgttatgccacatcacatggttccatccaagcataactaaccaacacagtcgattccaaatcctagtcctaatcaatctggttccagtttgagttgcgattatggcaagccaggcggtgtattcggtgtgggcgattccaccggaagacgtgggcgccagatgcgccaacctcatgaccgccctccgatccgagttcggtgggccccacttccacccccatatcaccgtcgtcggagccatcaaactcacccctgaagacgccgtgactaagctccgatcggcgtgccaagccctgaggcccttccacgtcaccgtggaccgcgtggccgccggcagcttcttctaccagtgcgtgtatctcctcctccgccccgaccctcacctcctcgaaaccagcgcacactgctgcacccacttcggttacaccaattccactcgttagtgcctttctctttctctaattaattattcttcgttttcgaaagaaactttagttcgcgaatgttgatgattgattcctttgcagcttacatgccacacttgagtcttctatacggagatttgagcgatgaagagaagcggaaggcgcaagagagggctaatgctatcgatgacacgctcgctggcttgacctttcagattacgcgccttgccttatacaaaacggacactgaggacaaaacgctcaaatcttgggagaaaattgctgaatgcactctcactccaaattagtagcttcttaacttcaatattagcaaaatccacaactctgatgaagtttttggttttctacactctctagctgtcttcttagtctttctgagtgctactgctatgtgcttactgcttaccaatttccaaactcttatacataatgatgtcaaataataaggcactagtacttcttgttgtttctactttttttaggcccataattatgaaggcattattaatctgcataagttttgctgtgggtaaaagattgttagacacccttggaatgtagacatcaacatagcgattggaagagagaagagatgagtaattgttataattagtgatgtgatttgataagaagtattgaagggtagtgccaatcagtggcgaacccagaaaaaattatttatgttcgcatagttagtgacgagagatagtggcgagagttcatggtgtcccggaattttttttttaaataaaatttaattaggtccagaatgggtagtaaatgatccgcattatggtaaaacacaaaacgaaaagaacaaatggaatgctagctattgtttccaggatccatgaattttgcaatttcattaacaaggttacggaaaagattcaaaggaatgtggtcacggcctcagaggaccaaggtcatggttcatgcattttggaatttaaaaaagtacccaatatgtataaaaatctcataatagaatttgcaaattttcagcgtccaaatgactattttcttgtaacaacattattgacaattagaattatggcagttacatacatacagtaagttttgctgcggcaagagaaatgcttgcaacaaaatctcttgtactctagtttcaacctagtattttctaatggctcaaattcatgtaagtctcattaaatatatacatctcatttctcatttggtaggtctcatcctcaagctaatcagacttgagtgaactttaactaacaagagaaagtatgctactagtatacacactaagttataacaatatacatgcatactgcagctccgtacagttgtgtaatcaaatattgttatactagtttgattatatatatgccaagagccttaatacaagtagcaacactaggtctctttaggtattgcttcatgcaccaaagccgcttttgcttcactagagctttctttatccttaaaataccccaaggagggcagggctaatagaagagtaaaaggtttccatgagatatatttgtttgaaaaaaaaataaacaaaactattagacctgtattataccagaagtctccgttgtggaaggtggtagtatggattagataaagatgttgtcacagcggaacaacagagcagttgcaatgatgttggatggggcaaagctccatgtggttcaatcaggtttatggttcctaaaataacctcaccagtccattaaaaccaggatgccatgaataagaactgtacactgtttcttatgcacgagccgaagcaaaaaagaaaaaaaaaaaaaaaagctgttaatctcaaaagaacagaatatatattctttttaagtacttaatcaacacttaccatgttttttcatttcttttctcttatcacatcatataacctataatacttatatatatttttttttctctctctctcactaggtgtcatatattgaatgtttatagattattttccaatctcagaatatcccattaggcatatggcgactattcttgtttctgttttgtttatatatctgtcgagttctaaatataaccaatcttctataaagtttaaactaatttgacataaaacattttttagatatttcttcctttttttctttttatgaacaaaataattctcttatgaccaattaatttaaatatcaacagaatcttcaaaattcaattcgtcaatcacgtggggtgtagcagtgtggcacgttacttgaactgtcattgttgtgatgattaacacaatcgataatttcgttatccccacatctttcgtatacaaaaaaaaaatgacaacatgatggttaataactgcggctaccgtaatttaaactctttatttgttaactgctaaaccaagcccaaatgcccaatcactgaaatcaacactgatgacttatgtagacctaaaacagcttagttagcaaacggacagtaagaagggaataaatggttaaacagatcaaacttatattagtagtacaattttccatatcaccaaaagacaaagtagtaaaattttccaattaaaatcaatattacatctggtttcacgcttccatttttggttactagatgaaattagcaattactaagatgagaaccactataataatacttaatgggtactattactacatttaaaatttgtactaattaatcaattttaccgtatgaactataattgcggagtgttggtggttctttctcggcttttttacacaaatgagtaaatttaaaattaaaaaaacactgtagattttgaaaatattacgggtatgagcaagtcgtgttttaaaacactacttcatctagagaaagatcaaagacgtattttaaaataaggctttaaaaactcactttttgtttaaaataaaaaaaataatgaaatcacgttaacaactttagtattttttttcttttttaaatattgaagttgtttattaaatcacaaatttaatctttttttttattttttctttcttttaaaaaatattgaagtcgattgttaaatcatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttctaagattgtattttaaaacatgactttctttatataaaatcatattttaaaatacgaacttataatattttcaaaatttatcattgttgtaattttttaaaataaattacccatttatgtaaaaaagcctgctttctcagtataagtaacatgtgcttgattagggatagaaataggccaggtcgcctatcagggcctttgacctggtctgtttaaggcctggtctggcctaacttgtttataataaaggtcagacttagactttttaaaaagtctgttaggcctaccaggctagcctatatatatatatatatatatatatatatatatatatatatatatatattaaaattaaaaagatataaatcaatctttttaaaaaagaaataaaataagataagataaaatctaaataatctatcttacttaaaagataaaatataaaataggaaatttgaaatctttgtagtaggtttgtaaaaaagcacatatatatatatatattaaaacaaaaaatataaatcaatctttttttttaaataattaaaataagataagttacataatctacttgaaagataaaaaataaaaaataaaatgtgtaggtttgtaaattgtataaataggcttttcaatagactcgtaggccaagccagacttttaaatagactaaatcaagcctaaaaaaaaagcctataacaggtaaataggttaggccaaacttgatgtttttaaataagatcaaggtcagacctaactaagcctgacctgccctgacctatttccatccctatgcttgatatataactgcctttcaatgctatgtttaacatgttttgtgccacaatgagtgatgaggtacgatccatgaatagaccaaactgtacccactaggcaatttcacttgctatgtccaatcaagtgaaatatgtgggagttgcatgcctagttggggcgtggatggatggtaaactcaggttgggataagctacaatctgtaactatgcacaaaaaaggaattaaatcaaatagccaagatcaaatcaactattgttagaaatgactccatttgtcgtatcactcgattctagcacacaaaattattcttccattgaataaaattagaatgaaacaatccatcctaatcaacgttcaggaattaacgctgtgttcgatttgcaagagagaaataagagacaaacaaaggtaatggggactgagtttggttggcatgattttggagagagagtaaagttataatttgtggggtttatagcttaaaatttccgtctttggaataggggtagcactaagtgggagtttaaaattttcggtaaaaagataatagtaaccttaaaaaatcaattgtttatgcaaaaaaaaaaataaatagattttcttttttggctatcatactcataaatgacaaaatggattatccaatccaagatcgatccaatgtgggatatggattataatgaattagataaaaaaattaatttaatttaaatttaaataataaaacttaagttctgtcagaggctgacttttgtggacttaacctgtattgaaccatgattgatttgtcataaagtttgcatttaatttgaactaaaaattttaaacacaaattctaggttttatcatatggatttgggttgattgggctagcccaatctatttttgtcacctttactcatggctactcccataaacataataatatttttgtctctatttaattctttcttttccatatatatcaaactcctttacaatattatttttactctatttctcacatatttttcttaaaccagactaccaaacatatatcttcatttctctttttttaaattatctattttctattttcatctattatatttctctcttctaaaccgaatacaacctaagagatgaaattgtattgtaaaccattacagtactgtttcgcacatagataatcaaattgaaattatctactaacatttatgtctaacataaaaaacattcatatttgtttatatgagacgaatatacattcttgaaatttgaaaataaggtttgatttattttagattttaacaacaaacgatgttgttgctcataaagaagaagaaaattgttaattttacgagactttttaaaaattctttgagattttaaatatggataataattgtcattctgcatacgcttatcaaggtatgttaaaatacaaaactaaaattggagcatgcatataaaataaagtatgaaacaaaaaaatgaaagtgaaaatttaaattttaattaaataaattgaaagtgtaatatctaatcataaattatgctataattaagaatttttaattttataataactactacaaaagtcttatttaaaaatgagtttttattagttaacggtgtattatgactaaattatttaaaattttaaatatgtataataattgtcgttgtgtaaaaacttgtcaaaatatgtttattttatacaataacaagaatatgaggattaaatcctcatctatttaaccctcgtcactaacccagtggattactttacttatcaaagtatgttaaggataaaaaaaaatgattttacatagatcatgcaaataatatcagtataatgaataagggtgacctacattacttgtcagcaaacaagaagcagcagaagaaggaggtgagtggatgaattaaatcaggttgtcacattcacatggcggttgccttcaacttttgggccaccgcatagaggtacaatgtgctgtcaatgacaatgacgacgaaagatgtccaacagtataactaatacaaattccaagattaaacatacatatttaaatacaggtttaatatggtagtcattgtaaatattagtagaagatagaaccttcaaaaaggactaaaaagaatgaaaccgcgttgttcatgattgtcagtttgttagaaaagttaatacgatacttggaattaagaatgagagttgtttgaagtccttgtatgtagaatacccaaaatggaaaatttggaacatgatgcattaaatatgtgtagaagttaaaggaaatttatacttggaagaacacgcctattttcattttctatcttttttttcccactctaatttgtaattataaaaaacgccttatttttcttttgttccctatttttaaaaccttgtataattgtttctcataatttattttaaaaacaaaaaattaatatttttgtaactaattacattaatggtataaatcgcaactatgtatccagaattcaaactctagagttttgattatgttgaataatttcaggttaattaataattgttcaaaaggtttatttcacaattgtaaataatgttaaataaaacaaaagtaaaaaaagtttagagaataataattgtgtatattttttcaataggaatagtttatttataggtataaaatataattaaaaaagttacaaaagataaatatatataaagaaattaaaaaaattataaaataatgaaatatatggacaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttctaagattgtattttaaaacatgactttctttatataaaatcatattttaaaatacgaacttataatattttcaaaatttatcattgttgtaattttttaaaataaattacccatttatgtaaaaaagcctgctttctcagtataagtaacatgtgcttgattagggatagaaataggccaggtcgcctatcagggcctttgacctggtctgtttaaggcctggtctggcctaacttgtttataataaaggtcagacttagactttttaaaaagtctgttaggcctaccaggctagcctatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattctttctaatagtagtaacatatttttaagtacaaaaaataattgaaaagttacataagataaatataaataaggaaagattataaaatacaatgaaagatatgaagaatcacaaatagattattcataacaaataattttttaaacttttttctataaaaaaaatcatttgacattgtgaaaaaaaaaacttttatacttacatagtaaattaagacactagatatcaattaacaacatattatattattctttactttagattttttttaaattaaactgaattttaagaggaaaaacaatgtttacacaacatactcgttagttatggacaaggttaaattttttaaaaaactgtttgtctgcaacaacaattacaatggcaacatcaaaaattgagtcatatttgttcacaattttcacaatatcaagaaataatggccagaaaaccaccaccacaatttaaaacctcacacaagatacacgagagaaaagaggttccactgactgaatcatttcatggaatatctcttgttctaagtttccaacttcgctccacgtgtctttcaccccattaataattgcttccagatctctctctcatgccctacttccctcactagctagtgcatgaatttcttaaaagtaaaaaaaaatgttaacaaaattaaattaatttgattcacctcaggtgattcaataaataaaaacaaaagaaacaaagaaaagggaataaaatatacacagatgcagatgagtgtgtgtatccatacacaatttgtttcatatatgcataaaccattatggaagaaagacgtttttcactttataaatacccatttttggccactttgcttgcattttctgatatctcctgcctgatctgctaagtggacaaaagtgagaaaaatatatacacactattcttctaagggctggaacttgctctcctgtcctgaatataacttctccattttgtttgctcaccaggtttgtggagcaaaatactgaaacatcatctaaaatgccttctcaatggttcacctctttttggggtaaatttttcccttgaatccaagattttgcaacacatgaactagattgcaatttgcaaactagccattacaagcaaatgaaactttttgaagctaaatatatataaatagctaatgatttaaatgttgaactaagttcttgaggggtgaagaggttgttccaagctttcattttcttctacatttcttttcagattcttccccaacctgacaaaaatagctgaaagatcaaaatttacttatgtgttttgtcaagaaatacttttttttttgtgtgtgtgtgtgtgtttatacgaggacaataaaatgataagatcttctacttgattcagcttgattaagtcttgagggatattccaagcttccatttcctcttctttccttttcagattcttcacctgacaaaaatagctgaaagatcaaaatttacttatgtgttttgtcaagatatactttgtgtgtgtgtttatatgaggacaataaaatgatgtgatctttttacttgattcagcttgaaaacatggctcttccaaaccaatccatgtcatcagagtctccccagagaaagatgggaaggggtaagattgagatcaagaggattgagaacaccaccagtcgacaagttaccttctgcaagcgcagaaatggcttgctcaagaaggcatatgagttatctgtgctttgtgatgcagaggttgctctaattgtcttttcaaatcgtggccgcctctatgaatatgctaataacaggtacctgcttttcttcaatctcttcataaatattttgggaacattgaatttatataattttgctcatgcaaaaaaaatcttctgaaggagttaagcacaaagagcctaatcactgttgtgatgcagttagaatatggagttaatttttcctctttgttttctgtaatcaacggttcccttgtcttttttttttttttttnnnnnnnnnnnnnnnnnnnnnnnnnnnnnnnnnnnnnnnnnnnnnnnnnnnnnnnnnnnnnnnnnnnnnnnttttccttctatgagcttttaacctcattctcctcttttttcttcttctgtttatgacaattattttcttagttcttgatttggtgggcacatagatctggtgtaccatatagacatagaagcactatggttgttaactagtagcaagaggaaaggatttggggatgttatgaaggtctgtgagatcagccaatccctagaactcataaactttctgtttcctttttcctctttcccttctctctctttctttactcatctaaaaactaaagctgtcatctttccattagcccaatttccttagtaacaaagccagttgattagacaaaaaagaaaaagaatcacagtacactttcaacaaattgtcaatgactgaatgagttaaattggaataaagaaacgagtaaaaaaaataaaaatggatatttgtaacccatcacaacaagatcttctcagaaacattgacatttaaaaaaaaatcaaagtacactttcaacaaattgtcaatgactcaatgtgttaaactggcataaagaaacgagttaaaaaaaaaaaggctttttgtaacctatcacaataaaatcttctcagaaacattgacatttgacacccacttgcaagatctcgtactgggttaaaaataaccctagaaattagggttttattagggactaatacatgagctgagcatagctaattagcaaagggagaagaaaaaagaaagaaaccgttttctcttctcagcatgaccagaaaatagtcaaagttaatctcttaatatttattgctcgttgattttccccattttaggaaatggagtttggcaactatggttagggctttaaggaaaataaagggtggctctagactaggattttcttttttgtcttggttggaagaatctttgaacacgtcacacgtgatttttcagttcttgacttttgaaaaaagagtttaaccaagtaatagttggaagatggaattggtatctctttaactcttgcatctgaaccctaaagttggatcttctacaacacccctcctatgggaaactctctcttcagcatagagtaaaaaaattcttttacatagtttggaaaacagcaaaagacaatgaaagaaagtcatgaaacaatgagggtccaaaacgctgcatcatcataatttcactggtagcttttggagcctctgcatttgctcaagatcttgaactttacatatttgtgaaagttgtagtctgagaaagaaaaagaagggttttaagctgaatgagagagagagagagagagagagagagagagaggtaaatggggggcggggcagagagccaatgagagagttctgagcattttggcttcttccatgcagtgtacaactactgcttttgcttgctgaaaatttgcggtagctgaaatgaacggctgtgatgtacacacactttcacacagaaaagactatttttttaaaacaatatatggtatcagattcagtaaatgtgacttaaaaatcttgcacgaaatttagatggctagaaatcgaggtgagcaatgaggagtggttgagagcattatccactgtgagatgcgtttccttgaagtggcagagaaaaaacataggtctagaaatggttgaaccaatcatattgtgggaacctgtgccgccgtggcagcagcagccaatcagtggctcgaggatattaaggtatcagttcattgcaatactgaaaaggttttcttcttttcttttcctttttcatccctaattttctattattattatggaaactaaatcattttgttattttaagattttatttttatcacatctaatcagactttgactccagtcgaggtttctgaataatgagatcatgtgatgtttattacttttgtgaatttagttgcgtttgaggttcggttaactgaactagttggatgatttgacattaatttcaaccttggacaagctctatggttaacctcaaattaatatcgaacacagttgttcctttttaatttcttttatttttgtttcttttaatttacgcacaaagtaagaaaccgagttaaattggaagattcggatgaagacgttctagagactgaaatgtatcccttagagttagtgataaaatgataatactgttttaaaattagttgtttgcatttatagaatttaaagttattaatcagttgtgaatttctagaatttactaactacatttttattactagttatttacactttattattctattgcactataaagtataaactgcagaagatatgaatctattaataaagctgacagcttcacgaaagagataaaataaacgaataaaggaatataaattcaaaagatgtgatatatataataattcattaataaagtttagtttatattataactttcattaataatgttatcctagtaatttatacactcaaaccaagagataaatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactggattgggtttatgcactttagaaggtaaagtgcacaaatcctaatcattcatattaataaatgatttagataaacacaccttcattaaaattgccacatcaaatttttctttaacgaaataaaacttattaaattaaaatagaaaataaaaaaattattttggcttgcttcacctaatcatcttcattggttacacagaagaaaagcccccaatacagttgttacaaattattcttcttaatctgcagctttatcttaaaatttcttactactcttaattggaattttttcttccaaccacttatccagcaatgtagaagccaataacggaagaaggaaaaaaaatcatttgcctaattaagagccaagtagcaaccagaaattagtagcatcaagaaaagaattagtacgagcctaaatagtggcccctctgtccagaagatgttgtctccagcatgacctcattggtcgatgcaactagtttttttttttttttttcattttgtgataagcacatatggaatcaattgagagagagaaatcacgttgaagacatggaggaaaaaaaattcagataaagcaagatttagaataacaatgccgcaacaattgtttttagggtttttgttcttttgtatattatgaagatgatcaagtgaagcacacgagaatattttctatttttatttaatgataaaaaatctatacgacaattttaattgaggtgtatcaatctaaatcatttattaatatgaatggttaggatttgtgcattttatcctctaaagtgcatgttgcactttagaggagtccaaccggggctagtcataacgaaagctagtgcactgtttgatttagctaagattctcaaaaaatccttttataatcaattaagttgcagggtttaataataatcacaaggaacctaaagcctttaacataactatcctagttagatgattacaaattttgtaagactaaggcatcctacaagttattaagattaaatatttgtttatctttcagaacttttttattttccaaaaaaatttgttactggagaaggagattgaatgctataccggaaatttggtcgtcaatcatgttctttgacttttgggttatgcttatataatcttgtaacaggacaacttgtgaatctatataaggtttttttataacaagggtcatactcttgcagattattagataaaaaaaataagtaattttctgtgcttatataatgttctttcacaatgatcagaaaaagtcctttatcacttagatgatgccactgtcatatcacttagcacaatgatcaatataatttataaataatcctactgttattatagcgtcaaagcttcaattgagaggtacaagaaagcaagttcagattcatctactggtggacaatctgcttctgaggctaatgctcaggtattaattcattattccttctctacattttttcaagagaaactttatttgaaactaattaaacaatgatagatacattaaattaatatcatgcagaaaaggaatttgaatgtaattgcaatgaattataaactaacatttttaaccatgatttcaaatctcagttctacgagcaagaagctgccaaactgcgggtgcaaataagcaatctgcagaatcacaataggcaagttgcattagtaaaaatttcactacaatatcgaagaaaaaaaaaacatatgaagagatctcaagtattatttcaatatttggtaaaaatgttttgaatcgcagtcaaatgatgggtgagggtttgagcaacatgaatggcaaggatctcaaaaacctagagactaaattagaaaaaggaatcagcagaattcgttccaagaaggtatttgtatttctagtaacaagaagtttctttctatgattttgaaagaataaagtatgcagatttactatgttgatctaattttatactttcttcctttgtttgcatgtgctacttcccaaacacctacatcagaatgagctgctatttgcagaaattgagcacatgaagaagagggtaaatgttttccttgtattcttgttttaatttctaaggtcatttttttttttttttgcatttattatctaagtggctcccattacaatttaatcaagtttcttaagtttagcccaatggtctctagttaagatttcacaaatatctgtattagggctctacaattgtttttcatattctgtttaagtttcctcttggtcaaatttggagatttccaaagatggtagtgaggatatatagatcattccattgcatgagtattattcatgatagcttgagtagctcctagagcctaaagatgaatcatcttaaaaagatgccactccataaggtctaaggcccccactcaataagatctagaaagaaaaatgaaaatttgtaaggattcaatcttgtgtataaaatataaatgtgaattgtagctgcaaatgttgtcacaaataaataaaacagaattagatcatataattattaacttgagtttggaattttttatttatacactttataatattatagactatagagtttaatttattttatactatttctacgcaaacatttttcaatattttcaagtagtttttcgagagaaaaaataaatttaatctgaatgttattaaaccgctttaaataaataaaaacacaattgcacaataaaatatcaattttaaagcaaatatgtgagacactgataactaaccatatcacaatattgtagacggtgtaacgtttgacattttgtatatgatgaaactttggcttagactatatgttcattcttatccctaaataaatctatatataggtgcctataattataatctgtgtttttttttgggagagggggtatacaaaatttcttctacaatgactttcaaagtatacatagtaactaatatgtacatttcacaggagatacacttgcacaatgacaaccagcttcttagagcaaaggtttgtcattctatcatcaatctacactctttatatatatatatatatatatatatatatatatatatatgaagtttgtattgnnnnnnnnnnnnnnnntatcaattttctttttttttttgagtgtgtagatagcaggtgagaggagtcaccataatgttaacgggttgtctggaagcataagctatgcatcgatgcaatctcagtttgactctcgcggcttcttccaagtgactggattacaacctaataataatcagtatgccggacaagacaacatgtcccttcaatatgtgtaagtttctcccttgctaggtttcacattcattctataacttgatatgtatttgtttttaattccttaatgttcaaatcactagttactacctattaacaaatctcataagagtcatcatagctttatatggtcatatcatagttccattgggaaagcagatatagaataaatgaagcaaatagttttatggatagatattaacttgcccctatgtataatatggtgaaaaaagggtaaaaaatgtgaagcacaagcccaaccaaggggtttagttgagtagtgttcgtctgagttcaatttctataaataaataaaaacacaaaaaaaaattataacaaatgaatctttcaagatacaaagggacatgcttgtggacatagttgttcttcacacaaaagagtcaactacaattatgatttcagaaaatcccaatagtcatagcatgtcaattaaaaaaggtaataatagaattgaacctctagtaaagatgattcgtgaaagaaattgggatttgtatatatgaaggaaaaaaaaaacatatggctaaagaattgctttagttggctttaaataaatgttttctcaacataaattgaaatttagtttcaataatagcttgagttagcacatatatacccgtaccatgacttgatttcgggcaaaagaacctaaataatacaaattaaataaaaaattacgcatttgggacggttttgaaactatttacaaatctggggcagtgggaaccgcccagaattgggcagcactggaaccgcccaaatccaggtggtaccaagggggtagaaccgcctggatttgggcggttccagtgctgcccaattctgggcggttcccactgcttttaaaccccaaaattttactgttcacctacatttgcactattccagcttctctctaaaagctctgccttctctctaaaagctttgccttctctgtaaagattttgcattgggttttaaggcgatttaacacgccgaaatagggcatgattaaacacgcccaacaaatagaggcgtcaccagacacgccctaggttaggcggcacacaaaagggggtcacgccaacatttgggcgtcactgacccttatataagggtgaccatccacaactcgtcgatatcaataatatggcattcctaggagaaacaagcagtcagaccatagctaattcaacattagccttcatttttccaaatggatcgatgaaacacaacgacacaggtgtttattttgagtgtccctctccaataccaatgcgggttcctgatcattgttcttttcaaacactgaagagtaggatgtccgacacccttatgctaagccgtgaccattttctggacgaaatctactatagaaagccaactgtacgtgtaggtcagcaatgtttttatcattctgctaaacttaccaatgataacgatgtttgcctaatgttaacgtgcaatgaacaaatgtcgagcgttggccctatagaaatattatgcagcatcaacagaacacctgacggtatactcagcctacttgaatccacaatcgtcccaacacatgatgcagtgctatattacaacggcaagtggaacataccacggcaaggcgattttgtgggatatgcattcactggaacaaatccaatcagatttgacattccttcaggatgcaacattgaaacactgaaggatctaatcaagcaagttgtgcctgttggccttcctccttatggaattaacaactcacaggtggtaagaaaattattttttagacaaccaacccattacgcttattcagacaacacaatcgaatatcacataaaagagttgataaccgatgcagacgtgttgaaggtcttagctgaatccaactattggaagcgtttttgcccaatacacattttagctgttttagcaagcccgttgcccaaatggaagaagacatgtctgctacacaacatatgtgaaactgctaagtaatgttgttattttcgtatgccattattgttattgttagtgttatttgtatttgcattttggtaaacactgtttattaagtgtggttaggtcgtgtggttattttaattgttattgttaactcaagtgatgtcgttattgtatttttcagttgacaaataatgaaaggctcaaaagttgtaaaacaaatttgcaattcgttagaatgaaatacattaacatccaagtacttaagcaaacatcataaaaaattcatgaaacagcacgacgatccggacaagctctccgattatgtccaacagccttgcaaattccacatctgctgcgtctttgactggtttcgatttcgtccatctcgtttcgaattctggtcgcctttggacgaccctttccacgcaacatttccctgtcgggtatgataactggaccatcactcggtggaatagcaccttcattaccaattggttgccacggaaatgagtaggcgtgcaccaaattacttatgaggaacacatcatccacgtactgaaaaggattctgacgcacatgtaaagcagcagctacggcgtgactacatgggtatttgaaggccttaaacttgccacattggcaaaaacgctctccaaggttaactgaatatgtggtctcgcagccctcaaacacctcaaattgtgttcgctcaagattatatatgctgacgtggtggcctgtaccaacggtctggttatgcctcataacatccatcacatttttgcaatatggcattgaaggatcaacttgtgaaagagctgcctgacccctagtcacaaaatattcaaccaatctgctgtacgtgtgcttcaccagagcagtgataggcatgtttcttgctcctttcaacaccctgttgactcattcggacaagttagttgtcatatggccaaatcgcctcccctctacatcatatgcacgtgtccacttctccttcgggatgctatcaatccattctgcaaccttagggctgctatcacgaaatcgtgctaacgccacgtcaaattgaatcatacagggtgtataacctgcaaaacaatcatcccattaacactaatctccttacgcatatatccatttaatatattcacagaattgttaatcatacctaaattcatcagcgtcttcttcaagcgttgatttctgaacttttgattaaaattactggcaatatgacgaaggcaaaacacgtgatgagcatgaggtggttgccaaccaggatgattcaccacagcatacagtatgcttcggtgcctatctgaaatcagacaaatattttgcctttgagtaacatgcaaacgaatgttagccagaaagtatgaccaggcttccaatgtctccccgtcaactatggcaaatgctagtggcagacattcattgttgccatcctgagtcgtggcaatcaacaatttccctgtatacttcccatacaaatgagtgccatcaatctgaatcattggtttgcaaaaattaaatgcctcacaacactgtctgaaagtccagaacatgcgatgaaacacgttttcctcgtacgagtcgatttgccacaaaataatctttggtttgaatatcataaaatgaacctggtgaaaaacgaagcatgtagccacaccaccggggcaaatatgcatatgattcttcccaattcccataaaccattgccactgctttctgctttgcaaaccaggccttacgatatgaaactctaaatccaaatgaatgggtgatcctttcctgaaccaatgcaatcgacacagacggctcctccctgatcattcctaacaatgcaaatgtaacatttactttaaaattaacaactttaaagaaccattatttaactcatatacaggaaatttaaaaaatacgtacctactacaattgatgcaataacatcagcatcaagctgtctatgaccctgtgaaatatggtcatttaggcaatggtgattgccaccccatcttgaaacaatccacttctcaccgaacgccggtttaattattctaaccctccatgggcaaccctcgttatgagcaacacacctcatgttaaacttgttgggcttgctctcaaccacatatgcttcttgatgctccttcatcaggttccgcttacatgcgatttgtgcgtcctttttggaggcaaattcttgtttaacaaacaacggatcccctaattgccatggaccctgaactgaaccggaaccggaaccggtaaaagattcttcttcgcttggatgactccaatcaatgtatgtgtagtgaggaattccatcccaaaaaggagtcacctcagcacctacaaataccaaatcaattgaataaacataacatgcacactaaaataatataacatacagatatataaatgattttagtcatgttacataccttcaacaggttcttgtgattgtctacctcctacgtccggatggtgatggatttcagacgaccccgcagcagtgcctgcttggaattcagtcacatccacaccagcattgtcatcattatccgacgcactagcatcctcttcaagaagacgatcttccatggcaatgttctcatcatcgtcatcctcttcgtcgtcatccataacccaggttgggtcatgtgaatcttcctcagacacatttacaaatggagcagcacatgacgcagccacatctacaactggagcagcatatgacgatctacgcctactaggatttaaaggaattgacctaataggtaaaacatcatctgccacagtatactccacgtacaactctaaaaaatctttcgttgccaacttaaaaaattccaccattagcaactctacgtcttcgtcgtccacaacttcaaaacccatgtactcttcacgttggcataatcttcccgtaatacgtgtgatacattggttgtcttgcagacctaatttttggcgtatcttcacatgtacatcacctattgtcgagcttcgcttcatacgtgtctgccttttttccccttcaaaaacaacaccttgtctcccttcaaatatccttccattataatataacacaacacggacaaactcctcaccacctgaactcatttgtttcactcaacaaaaactacataagttgaaaaaaattatgtcagaatatgttgttaccattactcataaaccatagaccctaccccttacactatcaaattttataatataaacactaacaatttcataatataaacattaactaactaaaccctaaacattaagtaaattcaattgaacaaaaccctacttagaaaaaccctaactcgtaaccctaattcaattgaacaaaaccctaattcataatccctaattcgtaaccgttaaccctaaactgaagtcactaaattgacaactaaactaaatcctacaacctaacattttttctacaacatgaagtaaccaatatggctctaacaaatttaaaattcaacaacataatatattaaataatactcataagttaaataatttaacttacctgttggcagagagaggtcagacaaaaaagctttagagagatgtcagagaaaaaatttatagagagatagaaggcgcaacaggttatgtctgaaaaaaagtaaaaagaggaggatttaaggcaggtggaaccgcccagaattgggcagcattgaaaccgcccaaatccaggcgattctacccccttggtaccgcctgaatttgggcggtttcagtgctgcccaattctgggcggttccgactgccccagatttgtaaatagtttcaaaaccgccccaaatgcgtaattttttatttaatttgtattatttaggttcttttgcccttgatttcgtaaaacaaagagaagagataatggggagtgaatgagtaaacaagtcctaatataaaatacaaaatatatacagaaccgaactaatttgcattgcaaaagttatgttttaatattcaagttattttgtccgttgacaggcatatttgtgtgtcccatggagacttgacttattgtatatttggaattaatgaacataaatctaatgcttgttcttttatcttgtactctatcttgtgcagttgaagagtttaagcttaagaaggagaaagacttagatttcctattgtttgtatttgacatctagtatgatatatagaaatgctaaagcctaggaagtatatatccagaactcaatggaggcaattcatttaagtattcccctcagtactatgttatgggctatttagtatgtatacaggtactctgattacagagatttgcaccatgtcatattttgtcaacttttgtatacttttcatatttctcctgtaataggcttctatatatgtctatttcatatttcacttactatgaattcaacatcttactcatacatgcacctgttcttgagtatgatttttttaggaagatcattgttatttgtgcaaagtatccactacattttgaatatgattaatttaagatttaaatacattttagtctttgtgatttatcatttttttatattttttccttacaatttttttacttgttttgttttttagataattaacgcattaaacagtaaaaaaaaactatctaaaatgttataaaaacaaaaaataaaacaaacatttttgtagagactaaaaaaaattataagaacaaaatgcaaaaaaaatattataagaactaaaaatatatttaagtacccaggctaatttccagcattgttaagcatatgcaagtgcatatcggcatcgactgcttcaacatctacatactcagctctatgagaaagcttgaaaggaatgttgtgatctacaaccataatgtttctttcctgttagtaaaaattgttccaagggcaaaagcattaacaaagtgagaaaataaaactggaaaaaataaaagcactcaagtatctgcaatatcagtataatatgtattatgtgtatctgaatgctaattaatcaagtttgttagattaaaagttgagagaaacaaataaagaaattagatctattgatatatatatatatatatatatatatatatatatatatgcgcaagggtaagtggtcataagttcgggaaacagtttttttgaatatgtaagagtaaggttgcatataatatttctcctccttacttgcgcataacgtgcaacctccgggtaataaagtatgtaaattttttatatatgcaaggataagattacatccagacaatgaaatatgtaatttatatatatatatatatatatatatatattgtgggtgagagagacaatctttgaactttttaaaatatataaaaacaatgacacgagctgatcaaaagggtcgtactgatatgcaagatgagaaaggtggaatgttagacaagataaaagctcaaaatagacaagcagggtaagaagaatgattaaactcagtgagaagtgtcacatgaaaataagcgaattgagaaaggctactgtgagtgtgaccatcctacttagcttcactgcctgacaaagtcactttcttgatacagtagtaaccacttctctaacagcttgtttgagtattagagcctcacagaagtgttctaagcttcatgtggttatattcaaagcttataaataggattacaatcaattaaaacactgttgggcaagttgagaagccatagaacagttataaactgttttctctgccactctgctcaaacaaactgagtagcatgaaacttttttcttgtgtagtgtatccctgctctgcagtaacttttgaccctttcctagagtgttttccagtgtagatatgatacacattcaacaacttatacaacaattcatgcaacattacttttttgcgtctatctctctccatcatcctatcatttattatatttcaaattcaattttcctctctttttctctattggttgtacattttgttgtccaagtatcatttctcattgttttaattcagtctgtttgttgagctctatctttttttcactcttccattatttatacctttgacattgtgaccgttagggcaattgaatgttttcttaaaactcgttttcaaactcagcttgatgattaaccaaatcatcactttagttaaattttttagaaggatactattttgcaggtgtttatttcagctataattaggtaaaggtttcaagtattgggttgctgtagcgaatacacctcattcttataggtctacaacctttatttatatcttaatcttggtgataaccggttataaccataaatccaaaaaactaacaattaacatttaccaaaaaaaaacaataaatccaaaataaattaaacataattaatgcctataccactatatacaacaacagcaataaaaactatgaaagatactggatagttttccctttccttgagggtaagtggcccttggcaactctgatatctgtagattcttttttttttaaaacttcaatttctgtgattagttagaaaagatctggaacaaattaactactattcaaactatcataaagaagttcttgatctgcaggaacaaaagtacaccaatacatatgacatgaaatagctatatataacaccacaatattgcaaatgaaattccaataattgattgcaattaatctccttcgtctacaatatgattattataagttctagcaaaaatcaggtacatccttaaataaatatggttgtaagagtttccatcttcatgttaacttaacaagatgacagatatccattgggtgcgcgatggttggaatgggagcattataagcacttcttgcactgagttggttggccatctcagtaggatgaaatgcatcaaaaaatacgtgtaggtttctgttcttgcatggcttctcattagggatacactgcccattcggccccactttgcagcacataacagtttctgaaatccctacatgcatggggccaccaacgaaagttaatatatttaataaacaacatatctatttacttcaatttcttaaaacgatatgatcataattgtattaacataatagtaaaaattgaagacatgcatgtgcatccttttggtcatagtttcaattatacaaattcaatttagccaatcttttgtggaaagtacaaagatacattatatatgcattttacaagctttctgctacgaggaaataacaaatacgttaaaaccattttagatgaataagtgtttgaatatatacaggcacagtaaattatacaaaatccatacttgctggtatatcatatacatcaattgaatcttagtactactataattttggctatgaaaagaagaagaaaaaaaaaattgttaccttgtaactttgaggcgtgtaatgagaccacagcactattaatgaagataaatttggcatgaggtaattctttattgaaacgatcaactactggtttaagcttatcattaaaaatgagtgctgctctattttcctcgtcaacacataatgacccatttttcccatgaatagagatttcatgcggaatgcagcctataagcccgaggcctatcaaaacaaacttccttgccccaagtgcgtgcaaatcctgcacatagaaacaacaaaagtagataacaaaccattaatttggtgcatcatgtatattataaatgttacttatattacgtctgatcctttttttaagaaacaagttttagtgtattttatactaaaacttgtttctgatattatctttttctagaatttgaagtaaaataatacctttaaattccttgcatattcttggacaagggccacagcatactgttcaggagaatactttcgacttgatgggtaatgctccggtaagaagtagttgtttaagtagtcattgctgcctatattcacataatataagcacttatttaggtggtggtgtgcttggtcagggcctccaagtttctgagtgatttgggaaactatgactttatgattttgcaactgcaatcccaagctaatatcctcacccttcaattaaaaattaagtaaagtaaggtttttgctccattagcatgagaggataaattaagtaatacatccatgatatattgtgtatatacacctaatatcaatagctgattttctaataaacaattgaaattactttacctttaaagtgcgttttagcttgtgagttgttcaatttaaagaaatcagattcaattaagtaaatgaacatgtgatttgatttaatgcatgaaacaaatgacacatcacacaaatcatgacaaattaaatcacaaaggcaaatatctcaaaaccaaattataggtaagatgtatatatataaattagatatatgtagtaaaagaatttgacatataccaaatgtaacccggtctcgttgcgaatccccgctgaaccggatgcataattcacgcctttgagtatgtctgaaccaccggtatttgcaaagggtgggataaaattttccaatcccaaaagctcagctgcaataacataattttatattgaataattaactgaaaactcatctatacattaaaataacatgaaaacaaatcatgttaatctatggaatttattcttttcaagttatcaaacttaacgtgacaaaatcattgttttttttattagaatttagtttggattccttaacaaggattcaaattctagtctttttatgaaaaaaagaagagatcttactaaaaataatttctgaagagatcaactatggataaaaccggtaaaacatcttttgcacctataatccaaaaaaacttgattgacaaaattaaagatcacatgtccactttcattaatcgtgtctcaacactcaagctcttcaaatgaaactccagacaaaatattttttgtccatgcccaattgcaactatgtgaaagaaagatatatacatgttgagaactgaattattactgattatatcaactgaagtacggccgttggtaaatcttccagtggggccaagtggaaaatcaatcccataaggcaagttattaactttggcatctgtttgtagattgttgttgtttccactatcagataaagagtctccaaaaatgaaaagacaaggtacttggggcttcccaacaacacaataatgttgcatgtatgttgcactgaagaaaaaaatcaccactaaccataacttggtttcataatccatatcaaagaaaaatattaagagggcgaagttcagatccaaaatattaggggtccaaacacaagggtgactagataacatatatatataaagggagagagaagtgagagaaaggaaggtatgacccagtttaatttgtggagaaattcgttgaaataatttatctatgtgacacattgtaaggccatatgttgattttagtaagtgaatttcatgcacacactattagaaaattactggaacctacatacggcagaaactagaatttcgccaagccatgagattgtaactatctcaagttttcaatttggacaaaatttaaatgaagttccttatgagtgatttttatttattttatttacttgtttaagaaatttggaggtaaaaggagggaaaaatgagggagggttaaaatcactaccttttaatttctatctccctctcaatgttggtagagtaggaaaatgatttataattttaagactatgtgacttaaattattttaatattttattgtatcccttttttctctattatcatttattagatataactgcatatattatcagtttaaaaaaattacatatattctctagattttttcttttcctatacgaactaaagaaagtgatctttcatgatcactaaatcaaattaaaaatgacctcttttttttcctcctcttttctctgttaaaatttctctcctccacctttactcccttgaactaaatacactatacatctttgtattaaatattgcagtttaataattcacacaaatatttatataaaattccatgatacatatatttattatttataaaaacatctaaatgtcgtcatttaaataataaaaaatatagtaataaagaatttaatttaaatcctggtttgtttgaaagaagtcaaatgaaagcaactataaataaacatagaataaaatttattcataaaaattaaaaataaatattagaagatttacaacactatctttatcttactcaaataacgaaatttgatcactcattagaataatatttcctaaaattataattttttacaaaattttcacaaactgctcaaggtaaagtttgaatttaatagataccaaaaattgaatttaattacatgagttgtttcattaattaatttagattcaaccacttacaaaacaagatacaaccactttttgaagttttagatttttgcccatttgttttgaagcatttgcttttctctgatacttctgctgctacttttgttatagattgcagctagttttctgttttacttttattttttactagctcaattgattaaatatgatatatgaattattataaatcttttattagttcttacgaataaaaaaaatacaacacttcactgtttgtattttctaatacaaaattacatataccgccggcagctcaatggtaattgtggaaggcagtaatgctcaaagccacatagcatgccacgttaattctaggtcaataccatcgagctactacacctcttacaaaatttgagctactgtgttactcataaatataaatattgtaaatcttcacaggatcctaaaacttggcattggaaaatggttttgggagcttccacaacagtcgacgttattgtgttcaaggcaattctgcgtcaatcaagccaccaatgaacatcatatcctcatctccaacggctagtattttgaaagaaagaccaaatcagacttcataacgtccagcaaaatccaagctaaagagtatatttggtaatgagaaaataaataatataaatgaaaataaaaagtggcaataagtgagatataaaatgataatttgagttgtttagttaaagaaaaatagaaaaaaaataagaataaataaaaaataattcaaatgaatcgcaccattctaaaacttattttcgcactttccttcaaagtttccttcaaagtgcagtgagccgaatccaaactctgattgtatatctctagcaaaaataacaaaactctgtttgtatataatttgtccattctccataaaaaaatagttacttaaaaatagtaaaatacgtactaactctgttttttttagtgatttactctgcatttttatttttaaagttcttattttaaattttaataaaagttgggtcaaatataggcacacgttttttataatgtgacatatcatttatattttaatttctttttaatttaaatttatttttcttaaattaaatataaatactctttataattttagttttcttatttgtattttttaaattttatatacaatataaaacacacacacacgtattataatttatatgtttaaaaactatttttcttttcttgatgccgtgaattccatttttttttaattaaagtaaaccttttaattttctactcagttaatttatactggaaatatatatatgtatatatatatatataattataaattttacatgcattaacgatagccgtaaaatatataaaacccttgccaatttgacttctaagtttattttgtcatcaattatttgtattaattttttttaccagaaatgttaaagcaaacagtttgttgtgaaagttatcttaatcattttggaagaaacattcaaaaggagaatcgatcagccaacaacatatatactattattcactataattaaataagcaatcttccaaaactttacgacaaattacacctgtacttgtgaacccatgaacatttagcatatatgaatatgtaagagaaagagagaaaacttaagactcttatgccttaaaaggaggagaaattcttaggtgcacctggagtaagacatttttcttgctctgatcctttcattatttgtcatgtcagtattgtgggtcattgttgtttcttacattaatgacaattgttaattttcctagatagattaatgacaatttttattttttctaggtagattactgacatgacaaacaatgaatggattagagcaataaaatgtcttgctccgggtgcacttaagaatttctctaaaaggagtaacacattcgaagaacattgaatatggttgtggcacagcttaatagccaccaccctctggaccatgttcattgttcagagatcatatctgagctaagcgttggatatcaaaagggtaagcatctgatgcagattgaacactgtaagctctctgagccacaacaacattgccagcttcagtaggatgaaaagcatcccaaaacaagtactctctcctgttttggcaaggtgtttgcattggaagacatgtaatttgaccattgttccttccaaacccacagcacccagcatttgtaacactgaaacctgaagattgattcatgtcaacagaactttgtgagttaatattatttgatgctaaaaaaaagtgacaaaaatcatgactacaaaataaaatgcattggtttgaaaataattaccatagactgaagggttgtttataatatcttgaaagatgtcataacagttaatgaagatgactcttgcatcaggtagtttgttgttgaattggtcagtgagacctttcagttttttgttgaatatttggattgcagaattgatcttttccacacatgttttaccatctgggctgttttgggccaattcatttgggctgcaacctaattggcctattccaaacagcacaattttccttgctccataattgtacaaagtctgaatgacaaacacaaacagtcaatatttcaatttgtggaaagcttttcaattttcaatttcattcctgactttataattgaaaattaaatggctattttgaacactgcatgttaccactatattataatagaaaaattgaagatggtgaatatcaaatggtaaaagacagagagagctaaagactaacttttagtttttcagtatatgcttgaataagaacatcagcatactcatctggtgagtactgcctgctgctggaatagaattgaggcatgaaatagttgttgaggtaatcattgctgcccaacccaattgagtatatgcacttgctcaagtaatttgcagctgagtcctcacttcccagtaaatttaccacttgagacactatgttttggaaattttgcacctgcccactaaaactaatacgccctccctacaaaatatatgaacaactttatagcataaataccttaacaaatgaagattaaaaacagtgatgttgcatgaagcaaaaggaaactataaaggggtacaagttgctgcccagtttcctctctaattccagcagcagcagatgcataattgactcctttgagtatagcatcgacgctagcatcagcatatggaggtatgttatcatcgaatcccaaaagttcagctgttaaatttcaacagaaagttaaaacaagagtgaaacctttctatggttatatacttacaagaatcaattttatgtgccagatctacttttctcttgttcctgtttgtttttaccaaattagttcttctgataagtaaccatctggccagaggcggagacaagacacggggtcgccccccctaaaattttattatatatatatatatatatatatatatatatatattaaaaattaaaaaataatttgacaataaaaaaaagttacattgcataatataataaaatataatattttttaatattatattaaaaaaatagaataaaatattttttaggattgcattcaaaaataggatagaatattttttaatattgtattaaaaatatttaatattatattaaaaaataggatataatatttttatgattgtattgcattatataaaatatttataagattgtattgcatattataaaatatctttaagattgcattgcataatatgataaaatatttttaggattgcattcaaaaattggttaaaatcatatgtttaaattagtataaatagaaatgtgttgatagcatgcatttcattccaaataatattagagcgctttagagagtttatatttgcatcattaagagaattgctatgagattatatagaagtgtttgacaagtctgattcttaactctctatcagaatttaaaggtacttatttattatcatagtggagttgtcaattggattaattatccaatttgaacgtagtcattttttatccaattggatttttcacgctaaaactgattgtgtcttctttatctcttatctccatattattactttgaatttgattttaaattgtgaattattttattaagactcactaaactttgccagtttattcatcaacccaccctatttgcaatttgtctagtatgtggtttgcggtttacatctttttgtatattagatttgtattgtcttcaaagtacttttatttatgatataattatttttatgttcatttcctctcaataaaatttttgtctccgtcactgacagtaaattttcctatttctttctttatctgtaattctagaattctacctctttatcaatgaaatgaactacacaaaactctaatcttaaattacatattcaatgcgggcaaacagatccatgtaaatggaatttaagggtcagtcacaaacctttttgaggggtaactaactcagagtagtgccaactctagtgtcaaaagttttactttttttcacggatgacatctgcatgttacgccttttttaatttttttatttcaccggtaaaaaatattaatgcatcttaattataccctttccttctaggtggtggacatttattgtctgattttagcataatacagcttgccatccaatagaaaattatgcatgcatatattaagatgcttttagttgcagttaattgataggttcaaaaatagggaagaagaacaacagttcttagaaccattttgatgccattgactcactataactatgacttttacaatgacgaattgatgattgttataagtccatgcatgtgaatctagttttaagaccatgcaaagatgcaaacgtgtataaatttcaactaaaatgctgcatgccatgcaaagtttataagccaattaagcaagtgcaagctcaccaattgcatcaacagtggttttcccattggaaaaccttccggaaggtccaccagggaagtcaatcccataaggcgcgtaatcagccctagccaaagattggagctggttgttgttcccattatcaaccaaagaatcaccaaaaatgaagtagcaaggcacttgtggtgcaccttgaacaccactccacaaaccaagagaaacaacaacaatgagtgccaacatgcttattgtgagatccaatgcttccattggagcaagaaacggtgttgcttgcgaggaattgaagtgaataatctaggtagctaaggaagataggggcatgtgtgagtgattgaatgtggaaggtttgacacgagtataagtatatatagtagtagagagataaggctctatactagtagtagctatagtgtagcttttacgattgggagtgttagttaggtgcattaaatggacgcggatataatgtgagattgaatgaaatggctccactaccaattccactgtaccaccccacctcattgatgaaatctgatcattgatgtgatccagctttaatttagagttgcatcttgcagggatggaaatttggacattacaacgactagttaaaacactcaggtattatgatacgacactttttatgtttttgttttgagtttttccggaatgttagattaggaatgttaaagtttcgttcagtatgggagtttttaaaattattttcaggaatttaacaagtctggaaattggttttcaaataagtttcttactggtttcaaaaattaagtttcttcctcaattttttctctgagaaagggtggaaaattcaagttttatgtaaaatagaaaaagttttagacacttgtatacgtgattttgtcgtgttcaacagaacgagctccgcagcacgagggcctctatatgtctagatgctacatcgtctccctatatgtatccatagcctacccgtcagagttgtccaaccattaatatttgaagttcattcccaagaaagaagacaaagataatagtattaacaagttaaaaaaaatataatcactactataaaactgtattttactattccaatcgatttccaaaaattgttttaaaataaaatgcgatgtgttaaaatatattaaggtgacaattttgtaaataggaatgtgcaaatcacgaaaatcacgacggttttgttttgcgcgctcaatttactatttcatctccaacttaacgtattcactcactcaccctcattgtggtttccctcacttagctcgtgctcatgccttccctcattgtcgccgccgtcgaagatgtctccattttcgcgtctcctccattgtccccaaagcgcttactctatctcgtccctcccttctctctctccctcttctctccacgcgccgcctcaccttcgccatttgcgccgaatcccaaaacggcgccgacaccatcaccgcacactacgacttccacctcttcaccatcggcgccggcagcgacaacgtccgagccgctcgcttcgctgccaactacggcacttccgtcgccatctgcgagatttctttctccattatctcctctaaaatcaccaaaggcgtcggcgaaacatgagtttcttattttcaatgtttttcaatttcgctttttattgaactagggtttgtcgttgtggaggctagtgaaacagagtttcgtgtttctgaagatttgttaggtagggttcaggctaaccaagctttttcaacaagctaatttgtagaagctcatttgtttgatatattctaacggatagcattctatcattggttctgcttattcttaatagttttcaatttaatagtttcccacttcccctacatctcttttgctatatatgctactagtcaattgttcaggaatctcattgaattataaatttatatatccatattaaagtaaagagctattatagtgaaagtacgttgttcccaacttctattttatttattttaacatgtcctgcatattagaattggtttctgatagaacataataacattattttatccatttagtttatggcttttggggtggtagtttgtatattctgtataaccctctaatcccatatatattttccaacttttctgcacttgataactcttgaaacaatgctttgggtgtatgaaacacatgcccgactggcactggaatctggggacctgtttgagtataatcaggtttgttctgtatattttttgaagaaaagagacttttatgttttaattcattttagtctttgattacttttttgtacttgtttttgcttgttatgcttctgtttcttttgttttcctgagatcaaggattaatatacttcattaaaggtaatcaatgctatgaagtagtgatttataattttaatcaacgagtaaaatttggtcccatctttgcttgttttggaaatacgaatgatttattatagaagttgaagatgttattaaccttgtaattggactttagatattgacgccatttgagtgaatgtagtgccaagtctcagttacgaactctttatgccgaaggcattgaggggtccaataataatataattaatgataagatatattcatattttacatcaacttatatgttaatctgatatatcttatattattattatcattattattattattattattatttgtaatgtttacactaacactatataaaatttttgttacataaaaatataacaataaaaaacttaatgtgaaatcgttaatatatgatttcgcaaaaaaaatcattaaatatatgatacttttataaaatcttgatattaatttttcaatacaaaataatgtaatataagttttacataaatgcactactaaaaaaaagctctttcatctaaaattttaaaaagttaatataaaatttattttaattattaaaaaaagattaattcattttagctgatataattaattaaattgactcataattattagtttattttaacaagtttcaattattaatttactttgactttttaataattttacatttacgtgactaatttgtattttttatattttgtagtgatttggtgattaaataccattattagatatgaagatcataaaagaaattaaaagaaatgggcagcatattttttagaagttaaaaacaagcgatttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgttgggtttgttataaaacaaaggtaacattttaaaaaataaacaatactgatttctagaaaattgtcttaaaatgtttactttttaaggtgattttttgaaaaatcatctttaaattgtcacatgttttttaaataacatattttacgacgatttctaaaaaaaattgatatagaaatcgagattgtaagacgacttaaatatcgttgtagaaagtgttgactttctacaactacaaattcaaagacgattggaaattatcataaaaaatattcaataataatctttaaaaggattttttataatagtaaataagagtgaaatagtattttaagtaataattttttttattttttttaaaccttatcattttattatccctctatttctatcatatttttcttcaaccaaatcatctcttttgtattcaatttctcttattttctcttttcatttatttttttttcgttctctccttttaatttcatcctcacaaccaaatgaccccttaatgaacacttaggagataagcaactgaattatacgctggaccaaataatgaattaataaagtaagatgttggtatttgattttgacagaatagatgtatttttttagtggctgaaaatagatgtatgtgttaataatgtctacttggctgccttgcaaatcatcgtagtcatctcgcgtattaatttaattaaataattggtcatgcgaatggcaagtgagttacaaatgaaaattactgtcaagttaacgagagagtaattaaaacgtagaaaaatgttagaaatacttgtttttcttaatctttgtgagagaaaagaagtttaaacatcaataatttgagatggaggaagtaattataacttgcaaattaaaagagaattgatcccgaataaagaagttacattatctgacagcgttcaatatttctgagtttatgcaaagatatggatatgaatgcgttgtaaaatgattagatcatctgaaaaccacaaatataaacttaacttataaattataatcgaaaattcattaaaaaaaaaacttatatcacatatatcaatcattagatggaagtgcatccttcatacagttcttttatggaatcttgaggatacgtttcctgcattaatattacgttggagatatctacatgaaagtaaatgtcaattaattattgtgaataaaagaaaaatcgaccgcctattattacctcaaacatgcactagaggatattgaaggacgtatttcacaccagctttaactagcaataactaaaattaaataaataaactttaggccaaaatataagaattgcttttaagaaatattttttataacataatttatttctatattataaattcgattttttaatttcaaagaaaagtattactattttgtacagcttaacacatagatcaataaatatataattatttcaatttatccaataattttaaatttaagttttgaatacataagttaaatatttataaaatcagaggtatctaaataattataagattgataaagtggttgagggaaaaaaggagaaaaaaataatattcgttatttaatcacaaatcaccatttaaatatatatatttttatttaaataactgtataaaaactttttagcatatcggtgtataatcttttttcttaaataaacaaactaacaaacatccacagataaaaagaatcagaatcacccaccagattaattgacatgaacaatagcatgcagcagctagggtaggaacagcatctacaaattaacgactatgaatccggtctttccaatggatgaactggttattagtgattatgatatatggcccagcggcacatgctcagaataagaatgtctttttctctggatctaccccttttgggtttcatgtatgggatggtaatttggaaagctggaatgatcaaattataaatatgccccttttatttgtctccttgattgtccctctacacataacttaatgacacggaacgaaaaagacaacgatttgatatataagcatatatgtcttaataaattataaaatcacttaatcttttttattatttaagactctcagtattaaaaaattgtatcactacaagaaaaagacctgtttccgataacatatttccgaagcattaatattccgtcggaaattgcgttttttttttgtagtgtatatattatgactcaactaatttaaacagttattaaggttaatcatatttttaaatataataaaacatatgacgactgatcaaattaattgggactaccttttcagtgctaatgtgatcatctaataaaaagacaagcaaaatattagcgacaacttgttattaattagcattcgataacacttatttaaagtttttttattctaacagtttgatccatcctatgaaatcatatcacccatgaaagttgttaattaagattcttctatctagcaacaccttaattaatatggcataaccttaagagtttgttaaggattagattcaaagggccgggaaaagtatttatgatgaataccttgacaatcaaagacagaaaacagaataataacggacacttttttattagccaaaagagatttatttataaggtaccggcaaacgccaaaaaaatgatgatgatttacaaagacctaccccttgcacatatattcaccagcttagcaatccaactcgaccaattgtgtctattcccaagcccataaatatccaacccgagacatcaacatatcgcatattacatgttgatattcatccaacaccagtttagacccgatttaagccatctgatctcattttcctccccattacaataattcccatccatcataaatattgtatacaagacaaaggatttgataccactcaaaataagagaaatgaaaagctttaagtttagcctccaaccatgaccaagacttatattttgttacctccatgacagaaatccaagtcaagtaattgatagcggaagatgatgttgtttctatagcaccataataacggacataattaatgcaagggggaattgaaaataagcttaaaaacttctttaaaaaaaaagattccataattttttggggcaaataaacacattcgtccataaaattgtaaggcgtcacacaaatttattcttaaaaaacgaaaaaatcaaatttagtctataaatgtgcaaaaaatgcaataaattaatcctacagacaatttaataacaaattagtccttaaactttataatttaatgtcaaattgatcctcaaaaaatataatttgtaattaaattgatctttgaatattataacttaatgataaaataatttcacaaatttaacgacaggactaataatttgatgcactttttacatatttagggattaaatttgtatttttcatctttcatttcatagatcaatttattatttcattacactcttaagataaatttgactatttttaaatttttaaattttttaattttataatggtgaaagtgaattttgaactacttgtagggtcacactagcttattaaatggacactttcaccccctaactttaggacgacaagtgctctcaagagtcaagatataaatttggtcttcggaagccatgcaatactttgtagctaactattcctatatgacggggtctagcatgcgaaaggcaaacatgtttcgtataatacaaaagtaaggagaactgttggatttgcatcttcgcggtacccttggttttttttttatttaagttaggcacagtacagtatgctacaccttgttgaatgcaccctatggtccacagggatttagtctatttgcatcagattctaatgttgaccgtattctttgtgtcttcgaatggagggagcaaacgaacaacaacttagtgaagtagcaaaaatattaaaaggttattaaaagactggggttagaaaaaaaagttgatggtttaagttttataataatggtgggaaaattatgataattgttgaaaaagatgaatagcaaagaaaaaaaatgaaaaaataagaaaaatatttaatttatttaaaaaataccatatattgatgttaagtaattaatacaattaatgatgctgtaattttgtaaggttgtgattttagaattttgtgtttttccataaaataataataatataaattatattaattgattaggtaaatgtatattaatgaaagttgtgttataagtttgagttgatgtaaattattatgaaaagtgaataataaaaatattaaaggattttttaattgattggtagttttgtaaggttggtaaaataaaaaattgtttttttagaaaataataataattgaaataggatgtttgtataaatggaatttttgttataagtttgagttcggcattgaagtaaaataatatgaaaacaaaacaatgaaaaaatatagatgaggccataggtggggccatatttttaattgggaagtataaaatgcaattattaataaactaaaatttatgcttattaatgaataggccagtcgaagcaatgccttaaacaggtgaggccataggtgccttaaataggtgaggccataggtccttgacaaattgtatgacatatttccacctgtaacgagggtatcccattagaagaaagtaggaaatagttattattaattgtaaatatgaatttaaaaaatgtgcagtccttaagaccgtaatgttgtcctatttaaacgacccaaaaatcaactgttgaagaggtttacacattttattagaatcattttaatgtttaaaagagtttaattcctataaatatagatagcgaacaaaaatttgagtttttatttttggagcttaaatgacttaagtagactgtttttatttttcatattttatgcaaaataaaacaaatatgaaattgatatatcaatttaatgatataatatatgtataatagcttaagtatatattaatttaatgatatatatataagtatataactttgttgatttatgaattaatcaagtagagatataaatagcataagtttagataattttttaaagagtctaactttgactcaagttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgttaaagtttagcttagtatgggaatttcaaaaattattttctggaatttaacaagtctggaaattggttttcaactatgtttcttactggtttcaaaaattaagtttcttactgaaatttttctatgagaaagggtggaaattcaagatttatgcaaaacagaaaaagttttttttccataattatgtctttcatttctgaaaatattttagacatattaaatatatacatataaattataacagtcttttagaattttcttactaaatattataattttcaagaaacatgatnnnnnnnnnnnnnnnnnnnnnnnnnnnnnnnnnnnnnnnnnnnaaacttataacaaaaattccatttatacaaacatcctatttcgattattattattttctaaaaaaacacaattttttattttaccaaccttacaaaactaccaatcaattaaaaaatcctttaatatttttatcattcacttttcataataatttacatcaactcaaactcaaatgaacttataacacaactttcattaatatacatttacctaatcaattaatataatttatattattattattattttatggaaaaacacaaaattctaaaatcacaaccttacaaaattacaacatcattaattgtattaattacttaacatcaatatatgatatttttcaaataaattaaatatttttcttttcattttttttctttgctattcctctttttcaacaattatcataattttccaataaaacttaaaccatcaacttttttttctaaccccagtcttttaataacctcttaatatttttgcgctgttgttcgtttgctccctccatttgaagacacaaagaatatggtcaatattggaatctgacgcaaatagactaaattcatgtgcaccatagggtgcattcaacgaggtgtagcagaatgtgttatgtctaacttaaatataaaaaaaaaaaaacgaaggtaccaattctagggcaatatgaaaagcgaagatgcaaatctaatggtcctccttactttcatattatacgaaacatgattacctttaacatgctagaccccgtcttcctatatacagaatcatcgatgctttgatattaaattgaagaatttaatgagtttgtctaagtcatacttagtaacgtgctttgttttgagtactccattattatgcatttatagcaaaaagttcacactccactctcttcaattcatggatgtttatccaacattgcaagttgtcgttgacgtttgcctagggctagaggttagcttttttggatggctcttggcattcaaaccaaatctgcaacccgtgatccttagtaatgatcaataatcgctcctacaattttagcaactagtaccagtagtatttgtttttaaagccaaacctcttactattataagaaagaaaaaagtaactaactaactcaaaatgaaattattttttagaactaatttatagtataagaatttgttttgacaggcactcttttttaaacatttggataattattaatatcttataaaaaaatggatctaatatgtacatatagatgttcgtttcctggaaattctcaagcgcatattagttttgaggtaaaatttgctgtgcaaaaaattatttaaaagttagtatttttcttctaatctaacttttttcatatatatttttttttctccttttttagtttccatttccccttcgttttgctagatctaaaggtatgtaattatagggattgttgacttatttaattaatggtcgcaaaaattttcaagtttaaatgtttataataaaataaaataaaataaattttagttaaaagaagtttgtacaccatacaattagttaagagtaaattataaagtactagctagtaatataattttatatgaatagggatcgttgacttatttagttaatgatcggtaccaaaacttttcaaatttaaaaataaattaaattataatttatttaagataagtttgtaccaaacaaagtttaattaagagtataagaaaaaatgattatatactaaattttatacaattatccaatcataatttaatgtgtctattaagtttgttgaattttaaaataattcaaataattacttatggttacatgatcatgatattataaaaatatttgacattattactgtattaacattaaactccaagatgaaatataaagtataaactaatataattttataaatattgtaactcctcacaggatcctaacacttggcattggaaaatggttttgggagcttccacaacagtcgacgttattgtgttcactgttcaaggcaattctgcgtcaatcaagccaccaatgaacatcctcatctccaacggctagtattttgaaagaaagaccaaatcagacttcataacgtccagcaaaatccaagctaaagagtatatatatttggtatgagaaaataaataatataaatgaaaataaaaagtggcaataagtgagaaataaaatgataataatttgagttgtttagttaaagaaaaatagaaaaaaaaaattagtataaataaataaaaaataattcaaatgaatcgcaccattttaaaacttattttcgcactttccttcaaagttcccttcaaagtgcagtaagccaaatccaaactctgattgtatatctctagcaaaaataacggaactctgtttgtatatataatttgtccattctccataaaaaatagttacttaaaaatagtaaaatacgtaccaactctgtttttttagtgatttactctgaatttttatttttaaagttcttattttaaattttaataaaagttgggtcaaatataggcacacgtttttataatgtgacatatcatttatattttaatttctttttaatttaaatttatttttcttaaattaaatataaatactctttataattttagttttcttatttgtattttttaaattttatatacaatataaaacacacacacacgtattataatttatatgtttaaaaactatttttcttttcttgatgccgtgaattccatttttttttaattaaagtaaaccttttaattttctacccagttaatttatactggaaatatatatatatatatatatatataattataaattttacatgcattaacgatagccgtaaaatatagaaaacccttgccaatttgacttctaagtttattttgtcatcaattatttgtattaatttttttaccagaaatgttaaagcaaacagtttgttgtgaaagttatcttaatcattttggaagaaacattcacaaggagaatcgatcagccaacaacatatatactattattcactataattaaataagcaatcttccaaaactttacgacaaattacacctgtacttgtgaacccatgaacatttagcatatatgaatatgtaagagaaagagagaaaacttaagactcttatgccttaaaaggagtaacacattcgaagaacattgaatatggtttaatagccactaccctctggaccatgttcattgttcagagatcatatctgagctaagcgttggatatcaacagggtaagcatctgatgcagattgaacactgtaagctctctgagccacaacaacattgccagcttcagtaggatgaaaagcatcccaaaacaagtactctctcctgttttggcatggtgtttgcattggaagacatgtaatttgaccattgttccttcctaccccacagcacccagcatttgtaacactgaaacctgaagattgattcatgtcaacagaactttgtgagttaatattatttgatgctaaaaaaaagtgacaaaaatcatgactacaaaataaaatgcattggtttgaaaataattaccataggctgaagggttgcttataatatcttgaaagatgccataagagttaatgtagatgactcttgcatcaggcagctggttgttgaattggtcagtgagacctttcagtttgttgttgaatatttgatttgcagaattgatcttttccacacatgttttaccatctgggctgttttgggccaattcatttgggctgcaacctatttggcctattccaaacaacaccattttccttgctccataattgtacaaagactgaatgacaaacacaaacagtcaatatttcaatttgtggagctagctagcttttcaattttcaatttcattcctgactttattgtaattgaaaattaaatggctattttgaacactgcatgttactactatattataatagaaaaattgatgatggtgaatatcaaatggtaaaagacagagagctaaagactaacttttagttgttcagtatatgcttgaataagaacatcagcatactcatctggtgagtactgcctgctgctggaatagaattgaggcatgaaatagttgttgaggtaatcattgctacccaacccaattgagtatatgcacttgctcaagtaatttgcagctgagtcctcacttcccagtaaatttaccacttgagacaccgtgttttggtaattttgcacctgcccactaaaactaatacgccctccctacaaaacatatgaacaactttagaacataaataccttaacaaatgaagattaaaaacagtgatgttgcatgaagcaaaaggaaactataaatgggtaccagttgctgcccagtttcctctctaattccagcagcagcagatgcataattgactcctttgagtatagcatcgccactagcatcagcatatggaggtatgtaatcatcgaatcccaaaagttcagctgttaaatttcaacaagttaaaacactagtgaaacctttctatgggcatatacttacaagaatcaatttatgttccagatctgcttttctcttgttcttgtttgttattaccaaatcagttcttctggtaagtaaccatctggcagtaaaatttttcctgtttctttctttatctgtaattctacaattgtacctctttgtcaatgaaataaactacacaacactctagtcttaaattgcatattgaatgcggcaaacagatccatgtgaatggaatttaaggatcagtcacaagcctttatgaggggtatctaactcagagtagtgccaactctagtgtcaaaagtcttgctttttttcaatgacatctgcatgtgactccttttttaatttttttatttcaccggtaaaaatattaatgcatctttccttctaggtggtgaacatttattgtctgattatagcataatacagcttgtcatccaatagaaaattatgcatgcatatattaagatgcttttagttgcagttaattgataggttcaaagatagggaagaagaaaaacagatcttagaaccattttgatgccattgactcactataactatgatttttacaatgatgaattgatgattattataagtgcatgcatgtgaatctagttttaagaccatgcaaagatgcaaacgagtatatatttcaactaaaatgccgacatgcaaagtttataagccaattaagcaagtgcaagctcaccaattgcatcaacagtggttttcccattggaaaaccttccagaaggtccatcagggaagtcaatcccataaggcaagtaatcagccctagccaaagattggagctggttgttgttcccattatcaaccaaagaatcaccaaaaatgaagtagcatggcacttgtggtgcaccttgaacaccactccacaaaccaagagaaacaacaacaatgagtgccaacatgcttattgtgagattcaaagctgccattggagcaagaaacggtgttgcttgtgaggaattgaagtgaataatctaggtagctaaggaagataggggcatgtgtgagtgattgaatgtggaaggtttgacacgagtataagtatatatagtagtagagagataaggctctatactagtagtagtctatagtgtaccttttacggttgggagtgttagttaggtgcattaaatggacgcggatataatgtgagattgaatgaaatggctccattactaattaccacccccaccacctcggatctatcttggagagggggtgggccaatgcatcatctcatttcaataaaatcattaatatttattcaaagatattatattttacacctcctaattttataatttgtactccctaattttatatatttgaacttttttacctgttcacatgtaagaataaataaatatatcatcttattttaataaaaagtgcacacatatttatcttaaaattttatattttatatcttttattttcatgtttgaacgtaactatttcatatgataataataattattaattttttatttttttaaataaattgtcccactgtcccataatcctatatccaccactgatcccatctcattgatgaaatcttatcactgatgttatccaactttaatgtagacttgcatcttgtagggatggaaatttggacattacaacgactggttaaaacttaggtatgatacgacaatttttatacttttgttttgagtttttcctgaatgttaaagtttagcttagtatgggaatttcaaaaattattttctggaatttaacaagtctggaaattggttttcaactatgtttcttactggtttcaaaaattaagtttcttactgaaatttttctatgagaaagggtggaaattcaagatttatgcaaaacagaaaaagttttttttccataattatgtctttcatttctgaaaatattttagacatattaaatatatacatataaattataacagtcttttagaattttcttactaaatattataattttcaagaaacatgattttttttagtttattacgtagtacataatattttagaaatactacgtacatatataatattttggacatctatatacttgattttgccgtgttcaacagaacgagctccaccgcacgacgacctctatagatctagatgccacatcgtctccctatatgtatccatagcaaactcgccacaactgtccaaccatttgaagttcatgcccaagaaagaagagaaagataatagtattaacaagttaatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgagagattcctcaggcattgtgtgtgaaagtcctgagttgagagattcctcagacattgttagagttcagtgaggttctgggagaattgtgtttatcagatgatggccccaggcgtgggactaagttccagagaacttattccctggatatgtgtgacacctatgatgaatacatatagacatgagatgagaaagccgagatggctgatagttttatatgagataagggcacaggccttgttaggcacccataatatttagtatgggagaaatgcttgatagtgaaccagggggaggtaagacctccaagaaccccgggcttactgagattttatctcaccccgtgtggggtttatgttgcaggtgcgtagaatagaggatagatccctggggagaaaccagtggagtcaagcagggtaactgtttggattagcatctgtgagcttggagctccctgtggcgtatacatagtgagatagtttctgtctcctgtcatatctatattgatatggttgttatctgcccggttcttagttagttttgtttatctagatcaataagggctagttatagttgtattgtgatactttattatgtctctgttacatgctatacatatgtatcaagaaatacgattcttacatgcttccgcagcttattttatgagattctgatattataatgatgttaacacactgggtgcacacggggtgttacagatggcattctatcattggttctgcttattcttaatagtttttaatttaatagttccccacttcccctacatctcttttgctatgctactagtcaattgttcaggaacctcattgaattgtaaatttatatatccatattaaagtaaagagctattatggtgaaagcacgttgttcccaacttctattttatttattttaacatgtcctgcatatcagaattggtttctgatataacataataacattatttgatccatttagtttatctactgggaagggcttttggggtggtagtttgtatattatgtatatccctctaatcccatatatattttccaacttttctgcacttgataactcttgaaacaatgcttcgggtgtatgaaacacatgcccgactggcactggaatttggggacctgtttgagtataatcaggtttgttctgtatattttttgaagaaaagagacttttatgttttaattcattttagtctttgattacttttttgtacttgtttttgcttgttatgattctgtttcttcttttttttcctgagatcaaggattaatatacttcattaaaggcagtcaatgctatgaagtagtgaattataattttaatcaacgagtaaactttggtcccatctttgcttgttttggaaataggaatcatagaagttgaggatgttattaaccttgtaattggactttagatattgaagctatttgtgtgaatgtagtgtcaatctcagttgcaaactctttatgccgaaggcattgaggggtccgatatggattttgctgcttaaaacttgctttgtgtcataatgcattcaaataataataaagatcttgtagcaaggttagccttacatgcttgcttgattctttttttcaaaaaaactattagagctgaattatgtcatgtgattcatctatctgaatttcgtgatattattgttaaaatcttcattattgaaagttaccagattgagtcattttggagttatattcccagaaacatgctttgataattgtattatgtttcaccatcagaatattgtgctaatattattataatctgcactgttggaattttctagtttgggtcctttgggagttcagttccctgaaaaatacgttgataatttggaacatgttattaagaatttagaaaatggtttgtgagggaaaggctcaaatcaggtcctgataagcaaacacaaaacgggatcaatatatatcaagtctttcaatggctatacgtaaatatatttccttgaattattgtgataatagtttaatgatatagtctcaaatattttgtcatgttatcatagaatgtcacgaatttgaatgtttagtgtttgtcaataccaggttatctcacgaagcaaagaaggatgaagctgtaaaacatgcgtttgccattcgtgctgctgtaacttcagcaaattatattgcattctttagactgtacaaaacagctcctaacttaaacacctgccttatgggtgagtatttttaattaactggtttttgtagcttgttggtaacacgtaacatatatgttaagggggataaaatgaaatgaattttttaatatccacagatctctatgttgaaaagatgcgttataaggctgtgaactgcatgtgccggtcatatcgcccaactctacatgtttcatacatttctcaggttcttgggttttcaactggcctggccacaaatggagcaagtgatgagagagacacagatgcattggaagagtgttcagaatggttaaaagcacatgggaccaacataattactgataacaatggagatatgttgctagatacaaaagtatgtttgatctctatcttttgtattcattgtcctgtaggtgctaatttgctctgtgaattagttaaccgttagttaacccatacaaatctagaattccctagttactagtcaactttaacaagtgttttcttaacctggttaatggttgtggattggtgatttaatgagaaatgtttaattttgcaggtttcatcatctactctgtttgtgccagagccagaggatgttgttggtgttgctacctgtcagaatatatcacttataaaacatgtatgcaaccatggatgatacagatattgaattgttacagcttaataaaccttcttcacattcgaattgtgaactatgtctgcagattagagattttgtttcagaacaaatgtctgtaagaggtattgaattccataccgaggagtctccccaagctatcacaaagtcagctgatggcaaattctctttaaagaaaccagcgggtgcctcaaggtaaggatggagttttgtttcttaaaagagttaggcacatactgcatttaattttttaatggtgaataagggcttcgtttgagaagaaatgctgttttcatctctagttcgccacttgttattatgatctcatagtcgttgttcatggcagtgcattgtgtatagtaaacttggaaaccacttttgttttgagaactccatggtattcaaatcttcccacattaattgtcttctatatatttatatctataacatgtatattggagtccaagtaatgtaaaagatataaagaaaagtgaaagtgcgtgatatatactcgtaaaatatacgaagtatatcattatactaattcttcagtatcttaaatatttttagactctttggtaaaaataaaaaataaaaaattaggtattaagattgtctgcataatatagaagattataaatttatactaacaatataatatattatattgatagtataattaatgataacatatattaatatatgtttatctgatatatatgttattattattattatttgtaatatttacactaggactatatataatttctgttacataaaaaatatagcaataaaaaacttaatgcgaaatcgttaatatatgatttcacaacaacaaaaaaatcattaaatatatgatacttttataaaatcgtgatattaatttttcaatacaaaataatgtaatatacattttacataaatgcactactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatccctctatttctgtcatatttttcttcaatcaaataatctctttaatttctcttctcatctttttctttttttcgttctctccttttaatttcatcctcacaactaaatgaccccttaatgaacacttaggagatcagcaactgaattatacgctggagcaaacaatgaattaatgaagtgagatgttggtatttgattttgacagaatagatgtattttattttagtgactgaaaatatatgtacgtgttaataatgtctacttggatgccttgcatatcatcgtagtcatctcgtattaattaaataattggtcatgcgaatggcaagtgagttacaaatgaaaattactgtcaagttaacgagagagtaattaaaacgtagaaaaatgctagaaatacttgtttttctgacagcaatatttgatctgagtttatgcaaagatatggatatgaatgcgttgtaaaatgattagatcatctcaaaaccacagatataaactttttaacttataaattataatcgaaaattcataaaaaaaaataaaaattatatcccatatatcaatcattagatggaagtgcatcctacatgcagttattttatggaatcctgaggatacgtttccggcattacgttggagatatctacatgaaagtaaatgtcaattaattattgtgaataaaagaaagatcgactgcctattattacctcaaacatgcactagaggatattgaaggacgtatttcaccccagatttaactagcaataactaaaattaaataaataaataaattttaggccaaaatataagaattgctcttaagaaataatttttataacataatttatttctatattataactttgattttttaatttcaaagaaaagtgttactgttttgtacagcttagcacatagatcaataaatatataactatttcaatttatccaattattttaactttttttttaatacataacttaaatatttataaaatcagagttatctaaagaattataagattgatcaagtggttgaggaaaaagaggagaaagaaattatggacttgaatttttcactaacaaaaattaatagaattaatatttatgtattaataatatataaaattattttatattgtcattgatattgctgtatagcctttttttttcctcaaattaacagactaacaaacatccacagataaaaagaatcagaatcacccaccagattaattgacatgaactatggcatgcatgcatgcatgcagcagctagggtaggaacagcatctacaaattaacgactatcaatccggtctttccaatcaatgaactggttactagtgattatggcccagcggcacatgctcagaataagcatgtctttttctcgatcctgacctaccccttttgggtttcatgcatgagatggtaatttggaaagctggaatgatcaaattataaatatgcccccttttatttgtctccttcattgtccctctacacataactttatgacacggaacgaaaaagacaacgatttgatatataagcatgtcttaataaattataaaatcacttaattttttttttatttaagactctcaatattaaaaaaattctatatattatgactcaactaatttaaacagtcattaaggttaatcatatttttaaatagaataaaaccgttttttggtggattaaatataataaaacatatgacgacgactgatcaaattaattgtgactaccttttcagtgctaatgtgatcgtctaataaaaagacaagcaaaatattagcgacaacttgttattaattagcattcgataacacttatttaaagttttttttttattctaacagtttgatccattctatgaaatcatatcacccatgaaggttgttaattaagattcttctatctagcaacaccttaattaatatggcataaccttaaaagtttgttaaggattagattcaaaggggaaaatgatttatgatgaataccttgacaatcaaagacaggaaacagaataataactgacatttttttattagccaaaagagatttatttataaggtaccggcaaacgcccaaaaaatgatgatgatttacaaagacctaccccctgcacatacattcactagcttagcaattcaactcgaccaattgtttgtattcccaagctcataaatatccaacccgagacatcaacatatcgcataacgcatgttgatattcatccaacaccagtttagacccgattgaagccatctgatctcattttcctccccattacaataattcccatccatcataaatattgtagacaagacaaaggatttgaataccactcagaataagagaaatgaaaagctttaagtttagcctccaaccatgaccaagactttatattttattacctccatgacagaaatccaagtcaagtaattgacagcggaagatgatgttgtttctatggcaccataataacggacataatgcaagggggaattgaaaataagctttaaaaattctttaaaaatccagaattttttgagatgaataatcgaattcgatcatgaaattgtaagacgtggacaaatttgtttctaaaagataaaaatttaaatttagtctctaaatgtgtaaaaagtgtaataaattagtccaataaataatttaataataaattaattcctaaactttataatctaatgtcaaattgatcctaaaaaatataatttattattaaattggtctttaaatattataacttaatgataaaataattttacaaatttaacatcatgattaataacttgacgcactttttacatatttaggaattaaatttatattttttattttttatttttcatagattaatttattatctcattacatttttaaagataaatttgacttttttttttataatggtaaaagtgaattttaaactactagtacactagcttattaaatggacactttcaccccctaactttaggacgacaagtgctctcaagagtcaagatataaatttggtctgcggaagccatgcaatgccgtgtagctaattaactattcctatatacagcatcataaatgctagtgggtcgaagaatttaatgagtttgtctaagtcatacttagtaacgtgctttgttttgagtacttcattattatgcatttatagcaaaaagtccacactccactctcttcaattcatggatgtttatccaacattgcaagttgtcgttgacgtttgcctagggctagaggttagctttttggatggcttttggcattcaaacccaatctgcaaccgtcatccttagtaatgatcaataatcgctcctacagttttaacaactggtactagtactagtagtaatattttttttaagccaaacctcttactattataagaaagaaaaaaagtaactaactaactaactcaaaatgaaattatttttaagaactaatttatagtataaggatttgtttcgacatgaactctttttaaacatttgaataattattaatatcttataaaaaaaatggatcttatatatacatatatatgttcgtttcctggaaattctcaagcgcatcttagttttgaggtaaaatttgctatgataaaaaattatttaaaagttagtaattttcttctaatataactttttcatattttttcttctccttttttagtttccatttccccttcgttttgctagatctaaaggtatgtaattatagggattgttgacttatttaattaatggtcggtaccaaaattttcaaatttaaatgtttaaaataaaataaaatgatttttatttaaaagaagttgtacatcatacaattagttaagagtaaattataaagtactagctagtaatataattttatatgaatatggatcgttgacttatttagttaacaatcggtaccaaaacttttcaaatttaaaaaaaaaatagaatttatttaagataagtttgtagcaaacaaagtttaagttaagagtaagagaaaaatgattatacagtcatctcatctaatcacaattcaacaatattaattttattgacttttaaaataattattttaaaataattgaagcgattagatgatagtgtaaaaattttatagtatattgacattaaattctaagagtaaatcataaagtataaactaatataattttatttgaatagtttatctaattaatacttttaaaagatgtgaaactgctttggctagcgaactaacaatatatagtactatttcttacctaatgtctaatattcagcacggggatagaagaattagtgtttgatattttcctgtatttattgactgtatcatccccccaaaaaatactacaatagtactataatattgcaagaaaacgtatggtgcagtaagatgcttggaggttgtcactgaattgaaagcatcctgcatgttgaattacgtttgttatttcatgaatatgcacggaaaaacccacatggcagtgacaattaagcagaaattttctttatatagtacgggatacttttatcagaattaaaaattcccccctctttgagaattgttctacattaatttgatcacattcgcttaaaagttttttaatattttttctgaaagaagtgtcccagctgtgaatcttgatgttgatcgaatcatgagccatgacaacgaatagcactcattagcatgtgattacaggctgactcggttgtttcataaataatccatctgcctttatgtgtgtttcccttttttgcaaatctctaagactattcgaataagacatgcatggtctccccattttttgagatgtaaaccagacatgttcaaatatggaacactcaagtaaaaaaatgatagtttcttttttaacaagtaaaaatggaagacattatcataagatttgtaaacatcatgatcaatcaattgaattatattctcaactaaaaaaaataatcttttatttataagaatcaatgacaatgtcataaaaaatttataataattcacacatctttattcaatcagttagatcttcttcggacaaaaaaaatttaatgactaaggagacatgtattatctattttataagtttacattcaaaatttgagttaatatttacgttatacattactttactgatatttaaacacataacacactttgacttataaaccccataggattagtattagagtggagtaagacaaaatcttcttgtatatgaatatgataattaagaagtttcttgctaatagctatgtagtatatgaatgttcttttgcatgtatttcatgggtatgaaccaccacatgggcgtaataatgagccattgcccaggggaaatgtgctgtaacgttttcttcagcaatgctaggctgttatacgcgcgtggtccaacacaaactgttaaagcctaaattaaatcctaatcgtctctagtctttaatgttcggtataatgtctcttgacttttgtttcccttggaagatttgaactacgcgttccatcatagaatgtcgcatcctggtggcaatagacttattttattcatatagccttttactattctttatgaatagtaatggcaaaagttacaataatactatcataactttaacctagaattcttctataaaaaaacactgacctagaattccgccataatattgggccaatgaggttctttgtttttacagagccgatgagtttcaagatcaataaattaggttattagttgactttagaaaaagtaaaaaattgatttcacaattattaagaaaattaattaatttcattaaattatattatttttaattaaaaaataattttttttaaactactcccattggaacttgatatatctcattaaacgaaggaaaagtagtaaaagagaacaaaaaaaattgtgtttttgtttataaaagagaatggaagagacatataagaacattaatgatttttagcttgatatctaatttttactaaatcttctaataaaggagttgaagaaatctctaatatggataatgagttattatagaaaatctcttaaaatctgcatattattccaaaaagaataaattttatttctttttcaatcttcctaaaatctcaaaataaaaataccattaaagaaaaaaatggaagaaatcttgaaatttttttaatcatatatgacattatgggatctaccaaaaaatagtcaaagatcctaattggatatctactactaaaaatactctaatacttgttataaataaaatttcacctaaattttacaaatgtatattaaatttcagtttaaatcaaatttatatttctttaggttaaaaaacgggtacatgactccctctaactactatcagtactttgtggtgtctgaccacaattctttttgttgggactctgatccctctttttgctcccattaattactatgaccgcaatttcaatgggcttcttaaatacagattttgctgaccttccatgagtttcggcctgttccttctatgttctgttattgttctttctcttttttctataaatttgggttgggttttgatagagtatctttagactaaagggtatcaacatagtgaaatctgcttcctacaccattttcgtaatggtggaatatccaaaatatttttcgagttatgcttcatacatattcgcataataagttttttttttatggtctcgaacctgcgaccttcacgttattaatacgatgctccaattaactgagttaatagactaattatgttgatacatataacactaaattttttaatatatatatttaatatacatataattttatataataaatttgtaacaattaattttaatctaataattaatttatagtttaacttatctataaattttgttttgtaacatatattgttacgaaataatttatagtttaatcgcatgtttgataaattaattattagataaattaaactataaattaattattagatcaaaattaattgttacaaagtctattatgtaaaattatatgtgtattaaatatacattaaaaaatttagtgttatatgtatcaacattaattattttttaatataattgacctattagctcatttggttgtatgaattatgcggatccgtatgaagcataacacgaaaaatatcttaaataacagcacaagtaatccaacaaaaaataaaagagagaacgtgtgtgtttgttttaagactcttgaaatcttcccctttttattttcaaaacttgttttcaacatatttttatattaaaaaaatatgtatagattttaaaaacaaaacaaaagaaaattttatttgttaatttctttttcagaaaacagattttaaaaagaattgtataagataacaatatatgtcaattacataatcattattacatatctgacatttaacaacatttttttgtctaatatttattaaaaatgttactaaatttttttggcaacattcaaaaaatattgtcaaattatcaatgtatgttactaatatgtttttgcaacattttatcaaatgttgtatagctcatattgctaaaacctaaaaatttcacaaaaagactttagcaatatggactatatgcaacatctaataaaatgtcacaaaaacatattaataatatttttttcataatttgacaacattttttgaatgttgtcaaaggttttaaacaaaatttttattaagtgttagacaaaaaaaggttgttaaagatcatatatgtagtagtgattatacaagatcaaaagggttctttatttattacaataaagcatcaaacttaaaactaaaactacaaaattaaattataaatctaattggcatgcatgcaattgatctttttctaagagttcaagttcttttaaggccttatgttcaaagtagagaatgaactctttgtttaagtgagtaatgacttcagtgtgtcttaatgctcaaacaatggcataaaattcattgtcatgcataaaatacttaaatttgtcatcattatataattaagtttctcataaaaaagaaaaatataagattggtctagtagttaaaaaagagatgaaagaagaaagaagaaagcaaagatcacgagtttgaatctctcaactaatatttctaaaactataaactaacatttgtcgataaaaaaaaaagtttctcatgaaaaatatgccatgacataaaactcattgccatactaaaaaagaaaaacacttatagcttcatttccctcttatcttggtcaactttaccaagtagcaagggtgcttacttgattttcaactcatcttttataaagaagcaattgtttgcataattgttatacaatgctcgatagtcttattgctcaagtctcccaagaagatgacatgcatcaaaggaaataacatcacatcctatatgattctatgatatttccaagcagatgaaaaatatacaatataacatttagaaacttttaccttactttctttgttatgtcattgaaacttgtatggaagtggatgtttttgtgttgataacttattcaccatgtagttttatactacattttcacaccctttgtttattgtaatactagtatggtaccaaattcaatctatagtagaatatttacaaaaagataaaatttgaatttcaaattgcacccacaaatgatataaatactaccgttgcaatagctttacttacatcaattgcatatttctacatgaatctttcaaaaaaaggactagcttattttaataaatacatccaaccaacccaatccttttaccgactaacatctcagaaaatttcacaaactcttatctcttagtttttgacattttggaaatatattagctgatgaattagtaaatgttgttcttgtttctttagtacctttagtagttcctatacatgtcatgctccttggattattcacaagcggtattcaagctctcatttttactactttagttgcagcttatatagataaatccatggaagtagaagaagctctggtgggatcctcacgtatagaaaaagattgtagttagtttgataaggatcgagtgacattgcttctttgatccgaaccaaggaatcccttaaatattattcaagataaatcttattctatcattgatcaaaggtttctctatgaaaaatacgaatcggagtttgaagggggggagtcctcaacccacaacaaatagaggaggatttttcaatcacatagtttggtctcctagaatatggtgcccttaagacttcctatttgaggggttaacttctcacacccagccaatttcccatacacccagccatgaataagggaatttcgaaaatgcccatcttaaaataatgcataaagtgggtgtttcaaattttttcttatacacccagcagaccaaacgctttctttgatcttctcagctccgttctcctccgctccgctgcgcccttcgtcttctccgttcttctcagctccattgactcccatcttgtcgtcattgtcgaatccgtgagttctgcgttttatttttttcatttctgctatggttgatttggatatggaattgttttgatggatacggattcccaattcggtagaagaaatggactaatccgtaagaagacgtcgtatccgtaaccctatacggattggcaatccgtgaggtaaacaaaaggcttatcttttaaattaatgcatttgttagagccccaatgatttgagatttctctattgggccaagtcatttagggagaagtggatcatttatgataaagaggatgagttttaagagaatgatttagagttcttgcatggcagaaccatgcaataccagacacgagataaatctttcagagattagagcttttttcaaataagccaattcatttgggactcatagattcactctttttcctattaaaagataagccttttgtttatgtgtaaagttagtgaatataataatagtgtgtagtcttttggtaccaaagatgagtagtagcaggtctactgtataaagttgatgtgaaccaaaaacacttcaaaaccaaacatatcttgttgatcaagctagtacttgtctgtacggtaaagaaattgcaagataaattgttttgtatataataatataatgttatatgataaattaatctaataaaaatatgtgaattgatcaaaatatttttcttttaaaatttaaaaaataaaaactaaaagatatattttaatcttatctaaatatataattatttaaaacaaaaaaatgtataagttattattgtgaataagcatgacaaacgcgtgggagatcaggtatatttcaagttagtttgctaagaagttagttagaaatgtttatcaaatcaatgatcattcaatcaatttatacaatgttcttatatgatactcctctactatatttcaaactttatgggtatgatgacattatgtttgtgctagttgtattttttttcaaaccatttcatctcaaatttctaatactaatcaatattggttaacgcttcaaaaccaccactacactccggaggagtattttgtaagctacatcaccagtaatataccaaaaaaatgtgttcgtacccggaaaaaaaaactaaaagtattaacggttcattgtttacaacaattcaattttttttaatatcattttttagatattttagtttacaaaagaagtagggatatgtcacttccccaaaaatatattcaagaaacccgaacccgtaggtgcagatcgtctttttatccattttctgaagtagaggtgttgatatatcacaaaaaaaggtgttgataaaatttaatttagatgatcaaatgcattaatttaattttggagatgaacatcacaagggggaaagaagtcagttaaggacgtacgtcttaaaaacttaaaaagaaaaagaaaaattccatattccatataagataatattggggtacccaaaaaaaaagagatgatattattaaaaaaattcttattataattataattttaatttactagaagttataagagaatataaaccaaattaattaaaatattcaatgaattcctaattatagtaaatgcatagtaatttttttatttatgagaaaaaaaattctagtcaataatcaaccatttatttatgacaaataatatcgtattaaatatttttatgttgacaattgttatcttccgtgatagaaaattttaaattgaaattataattcttaattcaaaatagggtttgggttaagaattgattgcaaaaatctgtgtcataaatacaatattgatttaaatggtcaaataatcattaattatattttcaatcaaatcattatgttcaaatttaagatagtagtatcggttttacgaaataatcattgctttagaaattgtcatgtgtggagttttcttcttctttttttaaacattttacttttttatagaacattttactttttttaatgcaataaaacattttactttgtatatagtaacattttctttaacagtgtatataataacatagatagaattcacaaaaaaaaagtaacatagatagatttgttatctttgacacgtatctttttttttagggattttacacgtatcttaaaacacacccccttcccaaaaaaaacctaaatcataatggacaataattataaaaataaaatataaatcataagggacaattttttaatatcctacgttgatgttcactaattaaatcattctccaatttcaattcattgtattcgcatgcatggctagtctttgattggacgagaatgaatagattaatctaacgcattatactctttaatgtatgctctttcaaatacatgatcttcttttcccccttcaagccaattacctcgtctatgccttttatctcttcattgtatgggtaatcttccttgttctatcatggccaccacccttttgatcacttctacaaaaccacggtgtgaaaacaatgtggagttgtggtcagtaatgtgaagcgaaatcatctcacgaaatattctacattcttataattatcaggttacaccctacctgtaatgggcatattttggctttcaaaattttcaacaaaacaatgtctcaagtaggtatattttgttgtctgcgttataacttgcttgtgttgcctggtgtcattttatccattattgtaaatgatttatttatttaacacatgaaattttgcaaaatctgctataggcatgttaagggtattgttaaagatatgattagatttgctgattatagggatttatttccctctttcccttattatttttatcccttcagaacacacaattccagcaataatacttttttttttgtgctgaccggcaatacttgtttaggtatttttgaaacagtattttgttttggtagtcattcaattgttatgaattttaagtacatttcaatattttgttcacgattcaatttcaggaattttctgatccttgtcttgttatttgtctaatgtgatgagaagcattgcgattatttttatgcctgatggttactttacgcatatatcatcagtatgatttttacttcattgtcaatagagaagttgttttagcctattgagacatacaacattgactaatgacaatacaatacgtggatcaaagcatgcatgtgttagttctctagagtgcattttcccatttggtaagtaatagaaatgtgggaaactggaaaaaatatgtaacaaatgattggagtgtgcaactattcccgtgtttatttgagaatgtgattgagcattatccattgttgaatatttgaaggtaggaaaaataattttaccttttgagtaagaatgctgtctttgtaggaatcaaataagtgaaaagacttaacatggaaaatttcaggccaagcgtatgccagggaacaattataactgcgtccctttaacaccaaggtctagattggaaaggcttctgagggaaagagagctaaggaaatccttcaagcttattcaaccaaccgaggaagcaagagatggcagcaacgagggagaacaattttatggtgattcatgcataagtgagaacgaaatttcgggtattcataaagaggaagagatcacggaaacgaattttacagatagaagccaaaggcaagatgagaggccaagcaaacaacgtttgttggtggtagctaacaggttgcctgtgtctgctgttagggagggtgtggagtcatatcgccttgagatcagtgtaggcgggctagtcagtgcacttctaggcaagaaaattttgtcaccttgcactaattgtttctttggtgtgttttgttaatttatttattgtgaagtttgtaattgcaactcaactttgctaattagttacctttcttgatgatctcatagaggtcacaacaatgatagttatcttcacaacattctaataataatctattacttataggaatagattgaatttttctatttttaaagtgaaggttgtatgaagcttgttgtttttgttgaaggtgttaaggaatttgataccagatggattgggtgggctggtgtgaatgtgccagatgatgttgggcagagagcattgacaaaagctttagctgaaatggtattgactcaaatttataactcacaagcatgtggccactgatcaatgtagtgaataatgataatctagcaactcttctctttgcaataccaaagacacacacaaaccatcagtaattatgcgttgttaactgcagcgatgcataccagtatttcttgatgaggagatagttaatcagtactataatggctactgcaacaacatcttatggcctctgtttcattaccttgggcttccacaagaagatcgacttgctacaactcgtactttccaatcccaatttgacgcatataagaaggcaaaccaaatgtttgctgatgtagtaaataagcattatgagaaaggagatgttgtttggtgccatgattaccacctaatgttccttccaaaatgtttaaaagaatacaatgaaaaaatgaaagttggttggtttctccatacaccctttccttcctcagaaatacataggactctaccgtctagatcagagctgttgagatctgtacttgcagctgacctggtggggtaagttattctcatgcatctccaacttgatgttgattatagtagcaactagtacattcacaagctaaatttctttggtatataggcatcaagggcatgcatttagaacaagctagtccatctttagtcaaaaaattatcttccaccttgaaatttactattcttgcttgttgatggcactatttagtcaataatatcaagtggtatgttgctgcttgctaggatatttgagaactctagacattttgtttaatgttgtgattttaatattttcattggtctgcatcccagattccatacctatgattatgcaaggcattttgttagtgcttgtactcgtattcttgggcttgagggcacacctgaaggagtagaagatcatgggaaactgactcgtgtggctgcggtatatctgcatatattattttccctttctaattctatacatctaattgtgaaactggaatttcatcttgtgttgtatgtttatcagcattgaatagctttacgaatcagtatgcagtatctgatttcattctcatgatgacaatgttttattttttgggagtgtgaaacttcagtttcctattggaattgactctgatagattcattcaagcccttgaactccctgaagtccaagaacacatgaaagaactgaaagaaagatttgcaggccggaaggtaggagccatatacgccaaattttaatgttcaacaatttgagaagttgagattattcctcagttctgttctacatctgcctttctctgaaaatgtgaatcattagaatcactttatgtttcttatcaaatggacaggtaatgttgggtgtcgatcgtcttgatatgataaaaggaattccccaaaaaatcttggcatttgaaaagttccttgaggagaattcacactggcgtgataaagttgtcttgctgcaaattgctgtacctactaggaaagatgttccagaatgtatgttatttctctagaaaagttaattatcacttgaagcattttcatccattgacttagactatgttttatttattttgtttctcgtcttatcatagttattggcgtttttcatgactgacaatattgacttaatgctttggcagatcaaaagcttacaagccaagtgcatgagattgtaggacgcatcaatgggagatttggaacacttacagctgttccaatacatcatctggttggtgttttaaacatctacagcatatatgtgttgtttggtatttgacgatgcaaggatcatgagtgtggatgctatctattatttgggatctcattgaaaatattaaatttctcatgtcactactatatatgagttgatccccgttactacgagatttgaactattcatcatctatatattgtctgtgttctatggattgtccatttgatcattatgctgccaccaaaaagctgtaaattcaatgtctgggttgatctacttaattcaaatttgttattctcaatttgtgttgttagctacattctctgctagctgttttacaaaacatatcattatcacaaacatattcacgatgtctcatttcttcatctccattatttgatcaagtgatataagacaaaagtgcaaacggaataaaaaagggaataaccattctagcagatgaacaacaaacctactagacagattctcctgaaaattaccaggaaatgaggaaagtcctctgaatcataagtgataaataggagttgcattttatcacatcttattttttacatagcaaccttttgataacaagacttgattgacaagtaaagaaaacatacctatacaaagtactctgatgggattttaattctatcaaaatttccgtaaaattacctccaataacccgataaaattataaaaattctttgcaaaattacaataaatcttcaatagttgatcttcttttgtcctgcatcaccaaggaactttcaacctattctttctagattaccttgatattattcagaatgtggagcttttctattacacaatcacttatttgtgtaatgtggtcaaacgaaaaattatttcccttccatcaaaaattaaagttatatttattttttaaaaatattcaagtaactaccttgactgttctttgcacacactgaccatgcattttgtctcgttgattacacatccttctcttgaattgctaaaatttttagggcaaagtaaatacattgctaatcttcccagaagagtgacaaatgaagcgaagtcatatgtttatttatcatacagaaaatatttgttattgttattctgttgaccttgtaatgatttctggaacatctctttctatgattacaggatcgatcacttgactttcatgaattatgtgcactctatgctgtaactggtaatcattttctgctataacatacaagatttagtccatgttgtccttatttattcaaagtaataatattttttatatagaagtagtatcatatttcaccattggattggtgaaatactcaagctgtaggacattctttcttgttattgaaaaagaaatttcattatctttgcagactctttcacttttctttaatatatgttccacgtgatttaagtcctctgcttgtaacatgtacctggctgtaagaatagattgaactgattgatatttatttaccaggagatgaggaaagtcctcaagaatcatatttcttgatttttaattcatcgagaaaagaataattgaagtacaatgacttacagttgtttctttatattcacatttgtaatatacttctgttttatgcttaagatttgacaactattcctgggaatcagaaaatggcaacaggctgcagcatatcttctttataatatattataaaatccatcttaagtagttttattgaactaagtattcagcacccatgatatgtatcataccagtctgactcacatcgtatttagatgtagcacttgttacatctttaagggatggaatgaatcttgtcagctatgaatttgttgcgtgtcaagcatccaagaaaggggttctcattttaagtgaggtaattcagttttttaatgttctcatcatttattttggctgcatctcttggatactctgaatgtatttgagcttcatatttgagaacgtgatttatgttttactaagatcaccaacatttcaaatgattctgccattaagcatagtaatgttgaggtatatgtatttagctattttcataaaacagcaaaacataaaacaaatttactgtcatttaatgaataagactttcctaaccttaactaggtcaagctagcaagtcctaagaattataaacaagtttgtttttcctttatcaccatatattaatctatagcaccgcacatagtctttttttattttatttattttgaagtgtttacgcatcaatggtgttaaagtttttctagtctcaagctcacagtttggcttgttggaaaaagaaaaaaaaactagcctagttaagctgagacgttcagctttctttttttattttgtaacctgaattgtgtatagtttgttaggcttaactatagagaaaaatcatcagtatgttgtatctgtttcatcaatcatccgcgtcgttgttgagctctgtaatgacaaggtctacttttgatggtaacctggttatgctataatgtgttcataagtatactatggtttcttgaatattgagaaccagaatttgtttttgtcaaaaggctaacatttgttgaaagacatatgtcaagagaataagctagggtaacatgaaatgattgcttttgatgcatggaattgtggttgctgatagactgaaatttaaataattataatcatcttcccctatcattatcattctataatccacgatgcaatattgatgtatatttatttttcttttaaattaactatgatgtccgtgttcttcatcttatcaccatcattgtgaatgttaaatatacgaaatgatcaatctattcaaaccaatatattttctgttcttagttgttttctatgtacagcccatgagtgctttacaaaaactggaatatttgtgataaagtgacagatagaaaaggatagggttgatactaggcttctagttcaagacttcagtaggaatgtaagatcatactgtagattatattctttataaagttattgtttgtctggaaatatcatcttgtttaaataaaaacaaattcttatatgtccaattattttattatcacataattaactcctaaaatcactaggctttcagtataattcaaataatttagaattctttatttggtatcagtttgcaggtgcagcacagtctcttggtgctggtgctatcttggtaaacccatggaacatcacagaggttgctgcttctattggttatgcgttggaaatgtcagctgatgaaagagaaaaacgacatcagtttaatttcaaacatgttgagactcacacatcacaggaatgggcagcaacttttgtgaggttttaatcgtataacactgcttgcattttgtttttcttggatcaattttgttccatattttatttttcttgtaatatgaaacagtcagtcttacacaagcatattagatcgaccactaaagctagtttgaaatagtgtcaatgggaaaatggagaaaaatggaaattctgtctttgaaatagctatattggtcggtctattgctctagattttgtcctgaccttctatggtggtctgtgccacttatgcttttcatgattatttattctaaaaacaaggttttatttttacagtgaactgaatgataccattgttgaagctcagcttaggacaagacaagttcctccattacttcccaacaaagtggcagttgattgttactcaaaatccaataaccgactaattatactggtaagctgtttgttagatcatcaaacactgaataaagggctgtcgcaaattattcaccctattttgtgcaataagtattaggcttacatttataaatggaaaccaacatgaccttacttatacaagtgcaccgcacgtgtttaagagaaacgcacatgaggacttatttgtttccacttgttttttgtgaataagtgagaagggttgccttctcaccaacttatgtagctccttttcactaaaacaataccattttgcctcatctgcactgcagggtttcaatgccactttgaatgaaccagtggatgcccttggaagggctggtcaaattagagaattggaacttaaattacacccaaatatgaaggaacctttaaagaagttatccgatgatccaaagacaacaatagttgttctgagtgggagcgatcgagcagtcctggacaaagtactatcaagaaaacttcatgtgtttttggattttcagcaacatttgcttttggactaacaactactttatgcagaacttcagtgaatttaacatgtggttagcagcagaaaatgggatgtttttgcgacgtacttcaagtgagtggatgacaaccatgcctgaaaatttaaacatggattgggttgatagtgtgaaggtaaattagctgcatgaatacaagtgtttctcttattaagttcctttagtttcaagtgtgattttttgtgatttttttttctcatattttttataaaatttcagcatgtttttgagtattttactgaaagaactccaaggtctcattttgagcttcgggagacgtcagtagtatggaattacaagtatgcaggcatgtgaaaattttctgttaccatcttcccttttaattttcaacctacttatttttttataggactaacatatgtttttatccttaataaatatttaaatttgtttattttttgataaattttttctttatattaagtctttaataaaacaacaatttattttttatcattgtcacttttttttagtctatgataaattagtaaattttggatttatttcttgataaatttttttttattaatcttttttcaaaggaactaatatcaaatgagaaaaaattatcagaaaacaaatacaaaattcactaatttgtcacgattaaaaaatgtcaatgatcaaaaatcaaatttttattttatcatggaacaaaaataaagaaaaactttattaaaaaaatataaaatttggatatttattgaaagatcacaaacatattttaacacatcatctctttactcccttcccagcaaagtgggagccttctatggttaattgctaacttattgtgactgcaattaacactagatgttgagtttggaaggattcaagcaagagatctgcttcaacatctgtggacagggccaatatcaaatgcatctcttgatgttgtccaaggtggtcgatctgttgaggttcgcacagttggcgtgtcaaaggtataagcaatttcagctggctagtagagtctctcacctatccttttctgttcagaagctttatttcctctacatgctagcacctgactttttttggtatagggagcagctattgatcgtatccttggagagatagttcataacaaaggcatgaagacgccaattgactatgtcttatgcattgggcactttctagccaaggttagtgcactttatttgattttctattcttagttcacttgagactttgttattgttagagtggcagagcactaagaatgactagattgttgccttttggcagtctggtagcaatgatagaacaccaattgataaggtaataaaatataatattgaaaactgaaatcacacacaatacagcagtacacttactttcccaaagacaagtctccggcagagagtacccaaactgcaaataactacacccttcttatttacacaacttactaccaaatatatactcttaatagataactgtcagtagttagttattttatatgcatgcagattctaatatggaactacctccaattcattaagggtcctttcctaaccaacttggatctcagttcccatcacctaaggactcaactgtaaatattagaatgaaatttctaaaggagcattgattttagattgatctacatcagaaaaagttacatttctaagccttctataatgattaaggcaaataatggttggaaatgaactgtttcaggatgaagatgtgtatacattttttgagccagagctcccttctgaatcacctccattaccaagagctatgctatccaaatctaattcttacaggccatcatctctgccaaaattaccagccaccaaaaccgggtcgaaggcagctcaatacaagaaacaacgttcattgtcaaacatagaaaagagagaaattgatcaatggagaccaatgtatagtgataaaatagcattgcatgagggttcctcagtgcttgatctaaaaggtgagaattacttctcttgtgttgttggacggaaaagatcaagtgcacgttatcttcttaaaacctcagatgatgttgtcaacctcttaagtgacttggcagaacattcttcatcaccaacttaactgattgtctttttgttagattgtttttttcttggtaaagtgtctattcatatcatttgattatgcaatgccctacatgtctcttgtgagttgaatgaatctcaaactggcaacgtacttccagcatgtttggaactctcaaaactgtgtttgaaattctaacttaattttgctatataaaaaaattagttgtttgggtgtttcttttagaattgcttttagttttactcatagcacgtttaacagaaagcaacaaaaaaaaatgtagcttttgccttagattgagattttacactaaagtccactgttaacttgcgtaaaatcaaaatatttttaagttggtaaatttttaccaaaacattacaggaattgaatgaaggagtcccactcaatcattttcaaagattggttttaattttaaaaccagatatgatccaaatttaaagtagtttaaattaaatcagtttttttgttttaccccttacgtatttgttttaatgtgagaaatgaaaaaattttaaatatatatattaaaataataaagaataagatggcaaaaacaaatactataattttataacataatacggcgatatgctaattccataccaataaacacttctattcttcaattgatattaataaatgagaatacaaaacatgggggcatacacttattcagtgacatacaaaatttagaaaatggccgcctaaccaaagctttcactgtttaacaatgctcttgaacttttgaactaagttttacactatatgtggtattaaatgaagaaaagatgactaatccctaaatgaatgggtggatacatcaagaatacaatttacagctaccaaagaaaaattaactcaatgcaggtcctggttggggcagaatggtgttcaaaatatgacacaaacctcaatcaagtttagttccccttaaacaactcgaattaattcccatgagctattcttctagtcttggtttgttttggcacatatgcatattggccgaagtccacagtttttattggcctgagttaagacaagcaggacacaaatcatggtgttgatacaaaagtataagggataatgaattccagtttggcagaaatgcattacctattatcagaagtgtttcgaacatctttcagaggagcacggagaccactgacacgagtgccagaagtgcatctaaaggatgatatcacggagacaaatctttccatagacttctcagctatttctgaatactggcccagatgggaaatgtttgtcccaaatttttcttcttcagcattattctctgtaaatggcccgtcaacattgtgatcacagcaacctataatcaagaaacatcagaattcagagaaacttcagcctcagcgagatatttcctttcatgattatttaaaaaacatgcatatattcagtaaagttcatggcagatatctctgctgagcctgaataaaacaaatggaatccgaaactgagaatttactcctctttatcctcgttgaagagtactatgttattcatatactcaaagcacgattttccataaactgagcttttgctaaacatgattttacttttacttttgctaaagtttatggatgtttgaacctctctttgtgatttcctacttttccataagggttaatagttaatacttaatactaataaattgtctatcttacctctccaactcagacaactccacaagtctgtactctttaccttataatactataccaaaagtagtcaatattaaattattaattatgtttaaagataagttacaatttagaaccaataggagcttttcattatccacaaaagtcaaattgcactgaccaaaaatacaaaagtcaaatcgccatgaaaatgaaaccgaaaatgaaatttctaaatgaagaagtagtcaatcagtatgcatagaagcttctgtgggagttgtaaagccacattcttaaaagatgataatgcaataacaacatcagtggtagccaccactttggacagcaagtagaagacaacaaaagcaaagaacataattagtggaatagtaagacaattttagctaacaagtaataattcataccattattatgaggaggtgaagaacagtgcatttgcctgggctgcaaattttcctggagaaagtcatttccatcagtgcatgagtaaaaggagaaagtgttaaagaaaacataaggtccgaagtttaaaaaatcctacattttgaatattgtcattaggggagatcttccttttcaggtctttattcttcaaatggttgttacataaatcactgtcagatatggcctttcttctcttgtcaatgacaatgccagaggacaggtgatcttgtttctcatcacaaacattattttctacttgcttgtgctgaaaataagcactccttacaattaactttcttgttgcctccctgctctttccttcaactgagtcaaggactatctggtctttattcttcacatcgttgttacataaatcactgtcagataaggcattttttctctcatcaatggcaatgccagatgacaggcaatcttgtttctcgtcacaaacattcttttccacttgcttgtgctgaaaataagcactccttacagttacctttcttgttgcctcctccatggtttttcctttaactgtgtcttggacatttgtgtgcccattcaaccccagacatggtttatgaattggctgcctgggctgtcgcagtactgtatgttcagggcttttcttctcttcacccaccatagacaattcatgcaaacaatgaaatgagtaactaacacatgtaaaggcagtaagggattttcccatccaaagcaaaccagcagatttatatcttaccatgacatggagactctgtaaattcagaaatgtttgtggcagaactatatcgaatctaaagaaagaaggaagaatatgtttaaaaaaatatgtaagtctcactaccaacaatgagtagagttttcactgttatagttcaatattcaggcaacttacatggctattaggaggaggggcactgccccaattctcagagtcaataaccgatgcagtagagttctttgtttcattagcagcagtaggtgacacccgaggagctctgaatttccttttcgcttcaagagaagtaaaacctttcatggctaaggaaaagctactctaaagaagaatagaaaaaaaagctgctagctacaagtggtatgttgtaaagaaacattgagcttaaatgccactgaaattcattgcctcaacttgattgttttaaatgttatatatcttgaatctaaatttttagaaaactggtaactaaagcatcaatagcatcaggcagtatcccagtgaagcatagaattctgccctgcattcatccccgttaaacatgctaaacatattaaaatcaattcaagaagaatgctttgtaggatacaaaagtacttagttaagagattcttctgcacaggcaaatcaatctttttctttgcactttcagaatgagttttgaattgactcgttcccacaattgcaaatctggctgtaagattctctccctgccatttaaaagaaatagatttttaaccaaaagtcccctttaaacaagggtttaattgaaggaccatacacccatgtatacttcttaaatgcttttaacatttattaaaaagaaaggggtgacaatctattcatatttgctcaggacatgtttgtgaaggtgatactaactcccaagaaaaccttgtaccagtactatagcataaggcaaacaaaatctactttatatgtagaatttacacaaactcatgcacatccacgcaaaccaaaggcaacggttatagaacactagcaacagtcttttcagttgttgtcaatcctattcctatcattttcaaaattcattttttttttcacaatcatgcaaattgtccttattccaaaaatgaacaaatgaaataagtcaatttattttgaccaacacatgcaagaaaaacagaggtatttcagtttactataaatttattctttcactttaacaaacacacactttggtatggatgaagataaagaagaaattgatgatgtacctcaaatggcattttggtaattggatcaagatccccttttgctattctttgtgctatatcttttggcatgggtgtatcccaggttaaggtataacttcaagtaagatcttagatgattgaacaaaatggagcagagtgatattaatttaaaatggcaagagaacattaaaaatgaaggatatgggcctaaaaagtctaactcatcaccaatatcatcagatatattagacaaatgaacaatattttcattaattggatcataaacccgttgatattggaaagtaagtatagctttcttgaatgactcttcataaaagggaggcacagaaactccactatatctcaagtgcttaagaacctgatacattgcaatttgcattagaaatacaaaaatttcatatagaaagatttacatacaagatttataagatatatattgttataaaaaaacacttttaagcatttatgttatgtgtatagatgtagacctggctgcttaagtgagtttaaacagggaaaatgaacattgattgctaaaaataaacatgcttgttagtttttatggttctgaacaaccatgcttgctaagtgtatcagctgcactcaccttgtcataacttctaaattttttaatgcttgcatgggcccttttgagacccatacctggcaaggactgcagataatcacagccactcaaaatacacatttcaagaagcatttgtctgttgaacccttcaaaactaagctccttattcttttgtagcatggaatactgaaactgaacaccttgaccaaacttgtccattttaaagataatctaaattttcaaggaagaagcaggccagtcaaaaaccagtgagtacgtcaaagtaggaataaatatacactagtatagaaagataacaaaaaacatctatagcttaagccacgtggtaaacttactcttgggcaaccaaacggtataagatcagagtcttcagttataactgcatcaacttgtccacttattgccaagaatgtcatctgggcatctgcctcgtaaggagcaacaatatactgcaagttctcctgcttcaatacctttcaagaaaaaacaaggttaaatatttagttggggatttaatgtaattattgtattgaatatattcaaacgaaatacatatgtgatacacacacacacacacacacacacttcacaacaaccagaccaacgctgatatattgaactcctttatacctgaattagttcaagtgcaatttgaggtgaaatatcaactgctttctggtagcactcataagcagcagctgaatttccatctgactcatgttcaactgcacgtgcaagattatcctttctagccctgcacttgtagcatagacaatatttgattcatttgcaaaagagcaaatacaatcaatgagattttaaggttcttaaatctgcccagaaatcaaagcactcctctttggtgatcttgtaataaagctcataacctctttatcccttaatatcctttagtacttaattcttttggtaaaaagagagaaaaactacgaaactcaggccccataacaagatgttgttttcatgggtgctggagaaggattggtttttcagtatcttagtttgaaagctattaaattattaatcaattctatccctaaatcattcagtattccatccatcctctatatttcacattaaaccaagttcattttaattttacctcaatttcagaaacagaaaagcaatcaaacaatgacaaacagcaaagaaaacaagtatgacatttagaacagaagcagaaacattgagcaagtcaagatcataaacatggcattactgctattttcaacaaattgtgcttgtgaataagaacctcatgtaaacatgaaggcatacatggagacagagctcaagaaagtttttgttcaaaattgtcagcttatatcatttggagaatttccctacatgcagacccactgtacactgaggaagtgaaatcccacaaagggagaaactaatgcaaatgcagacagctggtacaagcacagcatcaaatccttctttgaattttgaaattagataactcacagagaatcaaattaaaagaaaaatgaaaacggttatgacttgagcacattaagcttcttactctactcaatgtaagactcataacattgccacctcctttaagaactgatgtttacggaggcttcacactatcaacagaaaccctgcctgataatagccccttttcctcacctatcagtacttggtacattataccttaatctaacctataagtagcccttaccatagttcaacgctcaacaaaagcactaattgttatgacttgagcaaaagtggagagtccaatccaaaagactagttcgttatgtaagagaacttcatagctagtaccacattactcaacataacatacatgaaagcatcccattaacaattaaggtgacactcaactcaacaaaagataggtttttctttttatgccaaaaaaacttaaaatacccaattaagaaaaaacaaagtacaatgtcgggaagacaaagagagtacctggcacgcttgttctcttgttcactcttcattggcagaagccctccatcaaacactagaataggcttaaccccaaaatggcgcagcaaatttactctgtgcatgcaatactcaatgtgcctaaaacacgccaatgcataaaccaatctcggttaagccattttggggtgccataaattcaactaaaccccctttaaaaataaaaatcgaacttttacgagctgggttactccaaacaaaaatcaaagaaaaacccaataaaataatggtaaagaaaagtgtgaaagggaggttacctggtagtgggcatccctttgcagagttcggtgctgcaagagagggcacctttgtggagccaagagtaggtgtctaccgctacagaacaacccttcagatccttgatgtggattggaaccataatcgacttcaatagcggcaaaaacccctgtattcccattcctctttctctttggagtgaaattacaatgcactaacactacatttcatttcatatatgcactaaaattgggcgccaaagtttatattttggcttgggtaatggcggagtttaatttaatatcttcatttaacgttacttttgtttacatgttttaatttttatataaacattttttagagaatttatataaacttttattgatactaaaaaaataaaaatttaaatatatttgtatccctaatatatatttaaatttggtatttgatttctaataaaaatttattttataataaatctctaatattttaaaatttttatacgagatgtttgttgttggaaagaatatgttattttttatgtagttgttaattttataagtagacaaaatacttgtaatgtgatgtatatttgagttggaattttattataaaataaaatttttattttgtaattataaaatattatttaaaataaaaatttaaattaacattaagagaaagaaagaaggaaattactatttatatatcattttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcattaaaattgtatataattttgtaaaaagcaacttttaatttatttttaatttttattgatataaaattataattttattattttttaattcaatcacactatacaataagataagataaacaataacacgataaaattatattatttttgcactaaatattttattataaaaggatatgataaatatcaccaaacaaatcctaataaaatataaaatttatattataataaataaatatttaaacttatagattatattttaaatttatgatagatatattattaaaaaataattacaaaaaatatttatgatagataatttaattttgatttaagatttttttagttattgataattttttaaaaataaaatttagtttaaaaataaagataaaaataatatattaaaagagataagaggttaataccaatttctctaaaaattatctttactaaaaaaatccttacgtaagaaaaaacatttcctaaaaattcttaaaaatactatttttaaaaaaatctctaagcacacttaattagattaataattataatttaagtaaataaataatttcatttaaggtgttaattctgaataataaaaaaatgaaatttaattatgattatataaaaatatgaaaaattagttttatagataattttataataaattaatttataaattttataatttaatgttacattagatcacattttaagacgaatttgattaacaatatcaaatgaaactgaaaagggcaagaagaagctgagagagaggggatcatccatccatgtagggaagccaatcgattccttgcgcgtttgcttgcttcgatccacaccactgcactctttacttcaatcttctcaaccctacttattcattcattttccgtttaagtaagggtttctcaatcgtactcctccatgctcgtagctcgagaatgctaggttaacgctggcttagcacgtagctctaacctatgaacctccggaacggttaactgtttgttccaaacccaccgttccgcgaagaactcgtacgaattgacgatgtgggcttagtttcgttctctgtttcccaattctgtttcacttctttttctaattgatctgctgtatcgtttccgtgctcagtgccaccatgcctcgtaaagtaaattacggactcgattacgacgacgattactatgatgatgattatgatgactatgcttatgatgatgccgatgcagaagacaatggttagttactttaatttgctttattttttttttctaatatgatgctttgtttcacttgtcctctggtttggtgtcagttacactttacacagcttgtttcacattggtatctgtttagctctgctacattttttccatgcagtttctctgatttggagctgtggttgttatttgttaggtttcttgttattgctactaattttttttactgactgactatttgaatttttacattgtttattgttgatttattttttttctgccgtagcaggaggacctgatacaaagcaagagaccattaagcctggggtttggcaatgctccatttgcacttacgacaacgatgagagtatgactttttgtgatatttgtggtgttgtacgccgtcccttggttaacactggaacttccaacagtaacaaaacaggtaatccagttaatgaagaataattttgtttgttggttgggttttttacatttgttttgtatgaaaagcatatctcttttacactgtctaaattctaaattacactgtctaaattccatttgtggcttagggtgtgggggagggaaaactccgttgatgtggtacatacaattcttttgtcattctgttttgatatgggaagatgggacttggaatgtaaagtttctaaattcttctagctttactaatatcaacacattagtttaaatccgtgagatattttatttctatactccatccctagaaagataagctgagataaaaacttatctgaaattctggtttgtttattacttctaaggctatggcacggttgtagatacaaaaaatagacttgttattctcacagggtaggattagatgtggggaggaagcaaatcaagaatgaagcaaggctttcccgtctctctgtttgttagaaatggcaactgccttaaaatggccatatgaaagagtctaaaagaatgaagctgcgctttcctgtctctctgtttgactatcatgatgctgtatatcttgttcatagagcacccttgagtggatttgagtgcagttcagtttagatggctattgtaggaagaaacaccatactgtgaggtgtgttaggaatatggacagaatactccttataagactttggcaatcctcctcccttgactagcttttggaagtgagttgggactaatccatttctaatatggtacaagagcctattcagtattaatgttgggtcacccaaatgtttagtcttgcaaacctcacattctaaatatcctgtactgggcgtgaggcgtgtctgttaagatgtcctacattgaataggaatatggctaaaatactccctataggacttgggcaatcctattcttctgagctagtttttgagagtgaactagaccctgtccatttttaattaattgtaccatagttttcttgacaatagcaaaataatgaccagcaaatttaaataattgagctaaattgataaacaatactgactctggtattagttattttttggttttaacaacttggagggaatgcaacgctgttcctaaaaactgatcattttgcatcatccagatacaaaaaacgaaaaatattaaactgttacaaacctagaattaggaatggggaagaaaagaaatattttattgaatagtatgaaaagaacaaggaatagccaaatagaaagagcaatctcacctccaagggtttccgtttcacaaagagttaatgctcaatttacaaatgatacccgatagaaatgaaagctttccccttacatcttatttatttaactcactaacccctaattatctaatcaatagggacaggatttctcagtgtttctggttgtttggcaattttccaatttatctttttatgtaaggttaaataataataatttgctaataaaaggcgtagcaggaggatgaggaatcatcaatgaaggaaaaagaataatttaatctttttgcaaatctgataaaaggagaaaatggggagggaggagagtcagagaatatgagaacatgtatctggctgcatagtgtcaggttttcaacaatggccatgatattcctataacctattgaacaatgtctttggtgcagttgaagacataagcaaaagtcctggagcatccaagttggccaggtctctttttcaatcattacaacaacagattcccaaagagattgtattatttccaaagccagatgatggttttctgacagatgacaataacttctacaagcttgaaaatgtccgaggagaatttcatgaaattcataaggcttttagtactcaaaggcatccacatttaaacataggtcttcacaagttttgattcaggatgtgcatgtgactagtttaaacagtttcttctaaatttgatatttgaaggttatgcaatgcaattataattagagataaaggtcttattagttgaagatcagagtttttttaatgagtaatgacatatcatgatttagtttctgcaagttgtaactccttgcacatgtgagcaaattacttatttattcttttttaaataatagttataaaaccatgccttttttttttttttttgtatacagatcctttcaagtttgatgttccatccccagatgatgtggtttatactggcctacgttcttccaaaacgggtttgaaaggtatccttccctcaacaaatctaatttgcctatagagctcaagttggacaaaatgtgtttaatagttgagagagctactaaccatcatttaacctgaaagctcaatcatttttttgtggttcacttcaatattttctaaaaactttcaatccctctcccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttcaatatgttccctattaaagttgtgtccttgaatcaccctcgaaaagatttctaattcctggaggttgttttaagtccaatggcaggaagctttcattgattatgatagtcaaagtaattggaaatatctcaaggccaaactgggatttctaacaaaatctttatcacagtagctttcacccaaaaatgaaaatatatttctaggaaaaactgtttactttttccatattttctgtcttcaaattcttattcgttgtacataaatattaatccatcttatttgtgtaatgctttcagacaaagctacaaacactaaaatttctcagctttcatcaagcatcagagagaagaatgaactttctgtacaatcaaatgctgaaagttctgacaacttatcatccttaacgcaaaagagcagacagggtagttcagctgagagcaaggtttccaaaaatgtagcaattgatctacaaacaagtggtaaaacttcaaacagcttgccagaatctttgtcaaaagacaaaggtaacaatattaataaaataaattctttgaaaaatggtacaattgatattcaatcaagcaaagaaaagtcaggtagtttgtctgcactgtcaaaagtcaaggaaagtgataacattagtttctcttctatcaaagatggaaaacctgaaagtatttccagcagtttcaacaatatggctctcaatgtaagatctggaaattcatctggaaattctgataatactaatgctaagggaactcgctcacatgtttcttataagccagaaaaatggatgctccctcaacaagctgaagatacattgactcagctgaatcttgcaattgtatgcaaatggccaattcttttgtacattccaggaaaatatttctcggaatcaatgacactaaattttttggtttgtctattgtaggttggccatgttgattctggaaaatcaactctatctggtaggttactgcacctattgggacggatttcccagaaagaaatgcacaaatatgaaaaggaggccaagttacaggtaatttcactgtggtcatcttttttgtgcttttaaagcttgatgtttctgaactcatgccaatttctgatccttttttttttgttaatcagggcaagggatcctttgcttatgcttgggctcttgatgaaagttctgaagaaagagaaaggggaataactatgacagtggctgttgcttattttgacaccaagagatatcatgttgttgtgctcgactcccctggccataaagattttgtcccaaacatgatatctggggcaacacaagctgatgctgcaattcttgttatagatgcctcgcttggttcatttgaagctggtatggatggcagcaaagggcaaacaagggagcatgcacaacttatcagaagctttggtgttgaccgggttatagttgctgtaaataagatggatgctgttgcgtactccaaagatcgatttgattttataaggcagcagctgggagtttttctccactcttgtggtttcaaagattcttatctatcttggattcccatgagtgctatggaaaatcaaaatttggtggcatccccttctgatgctcgtttaaaaaactggtatatttttttattactctagatgtgattttgactttccatgatgggcaatgaagagggatatagaaggggtggtttttttaatgtaaatttctgttagaaaccatacttttcactctgtaaatttgatatatcattcatggtgtctggggctcaaaagtaccatttgaaacagcactagtaggtgatttctacctcccaacttctttggtacagacattttctcaacttcttttctctgaaacaaacaaaaaaaatgtatttagagaggacatggtgtgcttacctgtgcaatgtatggtgatggcttttatattaaaaatggactcagcctaattcaaaccctaaaactaactgaaggagggaggactgctcaactcttgttagaggagtattctgatcataaaccccccaattcccaggactgagtatttagaagcataaggtttgcagatactttttggtaagaaagatggatactatttaaattggaaaccgtgcaattgaatagaatccatactgttacaatggtactgccctagttaatataaaaacactgatagtttggcagcattcatgatatattataaatttataataggtgtttatatactggcaatctatgcttgcatttagtgtgataacattttagcaacaagtcactttcattttggttttgattgtatgcaatttgtactgctaaaagaatgatggttgtgttcattgtgaacaggtatggtggaccttatctattagatgcaattgactctctccaacctcctactagagaattctcaaaacctctactaatgccagtatgtgatgtcatcaaatcaactacacttggacaggtgtctgcctctggtaaactggaagcgggagctcttcggaatggatcaaaggtataccaataaggcaatgttatggctgttatgaaaaatcaaatggtagatataaatttggaattctccaaattaagtgttatttaccgatatgatattaactgtatttctgctagacattaataatttttagttaaatattttattttgtgtttttactgtatgtacatagtagagaaaccgaaataaaaatgttgaaaaaggactcaaaatataattaaggaccaaaaacttgtgagtttaatttatatacactgttagtataatttttttatacatactttcaataagatttgactattttattacatcatcctatttgttaatatgatgtggggatatggtagatttttattgaatgtatgtgtaaaaatatttcatgctgaaagtgtatataaattaaactcaaaacttattaagcattattattattttataaaacaaatgtttacttgatgaactcatttgaggaagcaagggatgttatctaaaatatttattcaggaaaattgtctagcatgaaaattgagataataatgtctctcaaagggcacaaattttgattttctagctttctagcttttgtatgcatgtcatgaaactatttgtccataactgtaatttttgtttaataaaaaaattgtaggtcttggttatgccttcagctgttgtgggaacagtacgttcattggagcgtgactctaatgcttgtactgttgcaagagctggagataatgtagctgtaacgttgcaaggtgtcgatggaaatcatgtgatggcaggagatgtattatgccatcctgactttcctgttgcagttgctaagcatttggagttgaaagtgctagtgttagatggtgcaagtcccatattggtgggcacacaggtgtgtactacagatgcgaatgacgttcgttgcactttattttccagtttttttttttttttattggaggaaaaattgtattttattttttccatctctgcagttagagtttcacatacaccatgcgaaggaacctggtagagtttccagaatattatcagtacttgatcccaagacgggtaaggtgaccaaaaagtcacctcgctgtctcactgcaaagcaaagtgcagtaattgaggtgaataaacaatgcaaaactcgttgtttcaatgatcttcacttttctgttcatctatgatgcctgggattaataaaacttagaaggacttttattgtgtctgatttttaggtgattttgaatgagacagtctgtgtggtagagttctctagttgtaaagctcttggaagggtgtccctaagatcaatgggaagaacgattgctgttggagttgtgacaagaataatcgaagaacaaggttaatttatgctattcatcaaataagataaaatgatgataacaaggagcgattctcaactacataccatgcatctttgtttgccatcctagtctagattaagttgtgctcccagacaacaggcagctatacaagtctcgatgaggtttatggtttaatatgtgaattatgaattatgtaagaatggtgaagatttttgtgtatgtttttcaccatatatgtatcataagagagcgtttcttttcaaaagatctagacttatgtaccatagcaactagtctgaccgcgtcggatgcaattgcgtttattctttaatgcccaatcttcagcatagattgatctacatctgcatatctataatcaaattttgggcttggaaggaaatttcgtggtattttccttgggaaaggcatttctttttctactacagtctcttggttaagtaatgtggtgtgggacagtctagttaagtgaatccctgaatgaattggactaaatagttttttttttttctttttctttggaaggcttgcacaagtaaccttaattgagtcattaataggtatgtttggaaggaaagaaaagggttaattttttatttaagagctatataatatttataaaataaataaaagcttaaggcagtaagtttatgtggggcaaagaaaaattaaggccactatgaggaaagtgggctgtccatgcacttggggccgaaatgacacctactttcagcttgccttttcgagcaattgtgatgtttattttccatttttgtttttcatatgtatcattttatcaaattagttttgcttgtaatatggtttgatattaaatatagacatttcttaatgggatttgaactataattagttatgtggttgcactgtttcctaggagtttgagaggattagtcttgtgactttcgcatgtgtgtatacttctttttttaaaaaaaaaaaaaaaaaaaannnnnnnnnnnnnnnnnnnnnnnnnnnnnnggttgcttgacttctatcatgtacaaggaataaataacatgctggtctgcacgtgtaaccttgtttttcgagttactttgccaggatctcaatccatctatagatattagttacctcctttatacctcgaagtctaaatttgctcttgaagaaatgacagcccatattaggaccaaaacaaagccagttaagcatatatctattgtgcaattgcacccttcattccattgattatggtatgaaatgagatatcctcaaatcaggcaaaaaaatttggacattctctggtcagttctgtacaatccaagatatatacagttacgatacagacatatcactaatcaatttgtaacaaatactcaaagttattgccccctttaattaaaattcgttaactaagaggacatgaattgaactgagtatatgtgcagattccattctctacaatgttttgccttttttcattccctctcttgctcgtttttattctaagacctattatgagctttgccttagaaagaatagaaaagaaaaacttccctatatgaataaagataaagaagtaatttcagtcattgatgaaaatattttacaattaatattctaacaagtctgcaattttattatcaactattgatattacttattttatcgaataaaatgagttgctgattttaaaaatgtcatatccattaaaactaataaaataagtaatgacttcaacaaggataactctttgtagcatccctatttcatagcataccaccatatgtgaccttcccgggaagccacttaattatttgctcaaatcatataattgccagcttatttccttctattgctttcatcagtgcatgaaacgtcttagtgcaccaaaagatcatcatggtctctccatcacttatataaactccatataaagagtccatcttctcacactttaaactataaaattttatagcaaatatggtaaaatatgaaacctatctgagagtctcaggtctattgctggcctctctcttgatgtatctcttaggagtcaccgctgagggaaatttctatgaagatattgagatcacttggggtgaacatggtggtgtaaatatactaggaagcaactctctcgtgctttctcttgaccagtcctctggctctggctttcgatccaaggcagaatatctatatggaagaatagatatgcagattaagcttgtctctggtaactcagctggcacagtcactgcatattatgtgagaaatcctctgattctgttctcatgttaaatttaactgttttacatttattgccgttaatacatttcatgtgagaaattctcgtgtgcactaaaccaaccaacattaaataattatacaaatctcgcgccacaaaaatattctatatttaaaaagtgatcatgcatcaattgttaattggcttagacagaagaatccactgttttgtatgtaactttttagtttaataggtatgccctgttagtttagaagtctttacattgttaatcagttaattttttgtatgacttttaatataataattataaaagtcaacaaatttatcatgacacgtgacgatttagtttagaagtctttacattgttaatcagttagtttttttatgacttttaatataataattataaaagtcaacaaatttatcataacacatgacggtttaattataagtcggataacaatataaaaaatctttagattatctgtgtatctattattattcataacttttatgatgcttttgactgagcttatgtgacatggtgcagttatcttctgaagggccaaatcatgatgagatagattttgagttcttgggaaacctcagtggagagccctacatagtccacaccaatatctacacccaaggcatagggaatagagaacaacaattctatctttggtttgaccccacaaaacatttccacacttacactattgtatggaaccctcaacgcatcatgtaaggaacataaagctttcattgtccatcaatcctataatttaattctctaaaattttactttggatatcttttttctctatgaaattatgtttggtaaaaaaatgaaaattttcatggaaccatctatgatccatatgtaatgtataactagaccattgatcctctatgtttcaacattttggctagtttcatggtagataatatccctattagagtcttcaacaactatgaagccaggggagttccatttgctagcagccagcccatgaggctatactccagtttatggtgtgcagatcaatgggcaacaaaaggagggcttgtgaaaaccaattggtcttatgctcctttcaaagcttactataggaactttgatgctaaagcttgtgtgtggtccaaaggatcatcttcctgtccttcaaactcagcttccatggctcataataatacttggcaagctcaagatttggatgcttatggtagaagaagtctgagatgggtgcaaaaatattacatgatttatagctactgcaaagattacaagcgattccctcagggtcgacctcgtgaatgcaggctttctagattctcttgagtgtgggataagtaaatttaaaattaatttgatgatttttttcatttatgtgtatttaaaattccactcaaatacggttgaatttgagtaagctcaatttgattttacttttgcttgcttgaactgataattatatatctctgtttatttacttatttttcctattctttctaaacaatgtaaaattattaaaacgaagtgaactcttcattttaaaggtgttccaaacatacaattttatttacaaataagttcaatcccatatttacaatgaaaaatgctgatcaatactcttatgacacaagttaaagaataaaaaataaaaaaaattattattagagtgcactgttttgtaatttccaatgtaacctcaaccttattttcaataaacttttttatttattgattccttaactagtttttcaagtacacctcgttaacaaaatccttttacagtacgttgaaaaaatgataattgattttttcatcaaatcaaaccaattccattcaaaacgtgagttatattattatttatttagtgaaaacgcttctagagtaatttaacagacaactgatataaactctcgataaaaacaacaaaaaagtgaaaaaatacgtgcaccctcccaccccccctcaagagtaatataaataagaatcctcctaactagtgtagctaaggcatgattaaaaaaataaaaggaaaatatattatgtaaatcatgagaacatgaaaaaaaaatcataaacaacacaatttttcatctcccaataaaaatatttctactttaagtttcttaattattatccttaggacactcgttagcattttttctataaataaacatgagacaaatgaaactgttcaaggcagtagaaaccacacatgctgatcatgatagatataatgacttagcattagagtcaggtccaacaaattcaaagtgaataacactacttgtgcttgagaaagcttttatctgcattgtgtgttcatgcacaaacaaaaagaatttcttttgtagatattagagaggtcagaattggcttttgaggcagtatggaaacaactcatgggtcgtttgcatgatgttatgaggaaacaaatattaattagaagggggattaggtgcttctatttagcaaaccgtccataatgctacctacctttgtagttctggaagcattgaaaccaaaaagtaaagttcaagcggtcatcactataatatatatagcaaatcgatgtacagcaaatgatttgatccagagtacatcaaataatgtacaaaaaattcaataatatattacatataaattaaactactaggaccaatggcttcattccctattccaaccataaggtatattaatccataactccaataccttcaagcgacaaaaaatctttcatgtgttacagaagagtatcgactccttgtaccaggcaccacaaatttccccaaacctacaattcatgagaagcagttgggacaaaattttagagacgcaagtatgaaacaaaatggtgagaacataaaaaaagtaatatcagagaaaagaaaatcaaggctacattgttggccactatgttttttttttacagaaaaataaaaaaatataaaaaaaggataatacagaaaaagaaggataagaaatagtcgaaagcaaagcacattaggaggaaaacaaaacaaaaagtaataaaatacagcagagcttcccaacctatgtactccaaaattttgccataaaagtttgacctttatnaaagcaaagcacattaggaggaaaacaaaacaaaaagtaataaaatacagcagagcttcccaacctatgtactccaaaattttgccataaaagtttgacctttattagtccttcaaacccagttgtagaaactgctagccaaccaaggatcctaaacaaattttcctataagatggtaactgtttcacaatgcaattgcaagagcaagggtccaattgtttctgaaagcagtcactacgtatagtgcctgggtggaaaggcgagagaaaagctctaagaaaaaaacatttcacacctaaacatcctccaaaagtctgaagcggagaaaacctctaagaaaaaaacatttcacacccaaacatcctcaaaaaatctgaagtgaggattacccaacaataacaacaatagtagccttatcccactcgatgaggtttactacatggatcaccatcactaatagacttggttaaaaaccaaattcttagggatattattcaagtgagaaacacccacatgtagaaaattattgctctataaacttttgattgataaacaaaggagtttatcaaatattcaatactttaggcataaaatgcatatctgcacatattggccagaacatataaatgtttgagggaggaggaggagcaaggtagagtagttatcaatagcaaccggaggccccaaaagcaacagagcaggggcactaaattggtatagatggttgaatgggttgaaaaatcctaaattggcctcactaaaatctcagtcagcagtatcaaaaaagggattctcaatctctgctaggatttatgaagacacctatttcatcccagtgtagtccccatcatcacctcatgcttgcagtctacttaaggttttcaatcctatttcacatgacacatctctgttttaaccccacctagcctcacccagatccatcctccatttttacactatcttgctttgtttcacactcgcacaaggtttcatgttcaatgtattacactattaccagtttgtgaagtttttatgttgtatcctctacctttgatgtgtgtttgcacaatcagaaaccattcaatcgtgcaagaagtcttgctcttagcagcatttcccttttccaaataacttccacctaaaaaggaccagaatgataaacaatttttgtaaacaaatactaactttcaatttcccccctaaaaaatactttcttgtatcactttggtacattgaaagtttatcaaaaagtgtatccaaaatcacattcgttagaccttccatctcctagtatgctagatacactaatcccctagttaacttgtgatatgttattctgttatacactttccaatagtattatttacataacgggtaagactttttgcacatgcatgtatttgcacttttgaccaactgaaattattaacatagtttcaaattcaagggtagatatcagcgaaggattagtcaacttgtgtatttacccattagactattgattaacaaacttgtggtattattttagaagagataacaaaatcattatacatgggtacaagcaatcttcatggaaacaaacaggcaaaaaataacaattgcaatccacctccaaactttccccaaccccaactacccaaattcagatatatcttggacttggccatatgcaattgaacaattgaagaaaaaaaatggaaaaaattaaattcgtgaagaaaggatttattttagtaggccctagaagtccttgcatcacccatccaccatgtatatgcttgcaacataaagtagcaattttacctctactccaataaactatctcatacttacaaagacaaatcttccagatccacaagcacatgaactctcgcgacacaaaggcaacataaagaaataatcactacatacattaacccacagacagaggatgggtgctgcacacaacacaaccttaatcaaccacaacattatacaatcaacattttcttcaccaccttccatccattaagtagcaaagataaataatactcatcaatctatgcatatctcttacatcactttaccaatcaaagaaagaccccaggcataaactagatcaaatccttggacaaataactgtatgctctagcaccaagaataactacataaaaataccccagaggagaactactagcatattgaaaatgaaatggagacccacatcagaaatgctggtaataaacccaaagtggtagtgcttactcagagacataacaagttcagaaccaaagaagaggctttaaaaggaaaaaaaaaaacaaaaaagacaagtactttaagcatcaaaactaaaaccctatgagaatagaaaatgagggagaaggaggaaggggataaaagttacctttagagcagaaagcatgtgctgaggatgtgggtatgaaaaatgccatgggactgggaagagtgagtgggtattcgctgaagaaagctgagcgaagaagagaatgcaggaagctgagaccttatattacagaagtgagtgagaggctcttttttctttttccgaattccgaggtaatgtatttggtttgaaaatgaaaagccccaccactggttgtattgtgttgtgttgtatgctgtgcacccattgttttttcttgggtgctgagaccaatcaatggtttaagaacatgaaactttgttcaaacaaaaaaaaaaagaatgaaaataaaatataagaagagggtgaaaaaaagagagtaaagtgccaattttttgcatggaattttcatccactgtagttttagtctttaaatttagggaaattaaaaaaaaatctctcaaattacatttcatttaatctaagtattaaatttaataatttgtttgtcattttattctataaacatgtattaatattattatttaagtgcatgttccaattgtgtttcattaatataatagaattaattgatgaaagatgaaaatgtcgataacgagttttgttgagccgattgtgaaatgaattaacatacaatttgtgggacccagaggttaaaaatatgcgatttaaataacggaaaatcaattattttaaaattatatttaaaatgattagaaaaatggaaacaaaaccatatataatttgatcattttgagccaatacaaaatcttttgaataagggacgacactatgtatgagattataattttggatatgaaagataattctaaacaaaaataatcaattttctttggttattaaacctactcacataagggtataatgatatttttgtgtctctatttaattttctcatacttatctagttcttttttatacaaaagttatgtcaatctcatctttaccaaagaactttcaaatattattttattccaattctcacctatttctcttaaatcaaacaacaacaaaagcataaactcgatctactctaacataagtcacttcaccaccaaaaaaaatgagtacttgtttccggacaaaacattttacttcatttctcttttttaaaattatctcttttctattttcatttattctatttctctcttctaaataaaaaatatacataattttaaattaaagtaataaacatatcataattgcaggatttttttcataccttgttaattctagatacttaaatgacaacaagtcacaatttcatgaactaaactcatcattcactaaaaaaaaaacaatacaaatcgggggccagttggtaataggcacattaatctctggtgtgtccagagaccaaacaagttttaactacagaaaaaatattttgataaaaaaacgactatggaaaaaaaatttgcttttcattttgagatatatttttaaaatgtatatgcccaaaaaaaaaacacagagatgattatatatgagtgtgagtgtgaaatgcacatataaaatgatcgtaaaaaaaaaaaggattaactacaataaaatataaaaaatgtaaaataatttgtatgtaagtatgtacatcaaaattaatccattatgtacaaaaaattaataatccatttattaaattacagtnnnnnnnnnntctttttccgaattccgaggtaatgtatttggtttgaaaatgaaaagccccaccactggttgtattgtgttgtgttgtatgctgtgcacccattgttttttcttgggtgctgagaccaatcaatggtttaagaacatgaaactttgttcaaacaaaaaaaaaaagaatgaaaataaaatataagaagagggtgaaaaaaagagagtaaagtgccaattttttgcatggaattttcatccactgtagttttagtctttaaatttagggaaattaaaaaaaaatctctcaaattacatttcatttaatctaagtattaaatttaataatttgtttgtcattttattctataaacatgtattaatattattatttaagtgcatgttccaattgtgtttcattaatataatagaattaattgatgaaagatgaaaatgtcgataacgagttttgttgagccgattgtgaaatgaattaacatacaatttgtgggacccagaggttaaaaatatgcgatttaaataacggaaaatcaattattttaaaattatatttaaaatgattagaaaaatggaaacaaaaccatatataatttgatcattttgagccaatacaaaatcttttgaataagggacgacactatgtatgagattataattttggatatgaaagataattctaaacaaaaataatcaattttctttggttattaaacctactcacataagggtataatgatatttttgtgtctctatttaattttctcatacttatctagttcttttttatacaaaagttatgtcaatctcatctttaccaaagaactttcaaatattattttattccaattctcacctatttctcttaaatcaaacaacaacaaaagcataaactcgatctactctaacataagtcacttcaccaccaaaaaaaatgagtacttgtttccggacaaaacattttacttcatttctcttttttaaaattatctcttttctattttcatttattctatttctctcttctaaataaaaaatatacataattttaaattaaagtaataaacatatcataattgcaggatttttttcataccttgttaattctagatacttaaatgacaacaagtcacaatttcatgaactaaactcatcattcactaaaaaaaaaacaatacaaatcgggggccagttggtaataggcacattaatctctggtgtgtccagagaccaaacaagttttaactacagaaaaaatattttgataaaaaaacgactatggaaaaaaaatttgcttttcattttgagatatatttttaaaatgtatatgcccaaaaaaaaaacacagagatgattatatatgagtgtgagtgtgaaatgcacatataaaatgatcgtaaaaaaaaaaaggattaactacaataaaatataaaaaatgtaaaataatttgtatgtaagtatgtacatcaaaattaatccattatgtacaaaaaattaataatccatttattaaattacagtacttaattttagattgttgcattcttgcctctaaggacatatttttgtattcctccccgtccagggttatgtggtgagcgatcttaactccaaaaaaagtaatgatagattaagaaaactatctaaaatcatttttaaacaaatgacaacataattggatgcaatatattgtctaaaagaagttgagttacaggattcaagaaccaaaatgaattagagtaataagtaataagccctagaacaactttacctccttaaatgaaatccgtgccacttaactcgaattattcaaaatgcaatataatctcaaatactgaaggtttatggactattttttatatatagaatatcctaatacatatatagattgtactcctatttttatacccttaagaattattaaacgcaaccttgatatttttaagagaaaaaaagcttagcaaaataaagcaaactagttattaatcataatcacccaaaaaaaaaggctccatttaaaagtaaagtgtactctacaactaagtataaaacttgatcaaacagtccccaaaagaacatgatctcactttagggtaatacatggcccagtcccattagttctgtcttgcggatcacgatcctcagttactagaaaatcagacatctctttccattggacctaatgacatatagatacggctaaattgggattgtataaatttaaatcttatcatccttcattcttccaatatgtactaccacaaacatgaaatgatcatcaacaaagacacatgtattccaatcaatcaattacaatacaaaatataaaagtaaacccgtgtctgtggccgcaaagtaaaaaaaaaataataataatggaaaaactgtccgcaaagctagtgtcaagagtcacccttgagcaaggacagaccacatgtatattaccccagagcttaacaccttgtttttcctttttcttcattttggggtaacacttccatcaattccactatccgctacacccctttttcttatcctctttgagcagtgcagtgcaaaaccaaatatgggaaacaaacaaagaatgaatagcacaagatgagtagaacctagtaaacttcaccagccatactgctagaggggattctttgtcgtttctccacatatgcagaaggaaaccatcctgctttgccattgcattcgccttctgaccatcctgatgggctcacctgggtaagcatttggaactttggtaaacatggaggctcaaaaagattgagagattaaaccaaattaatcaagcaaatttcacgatgacatgacagtgatagaagcaacaattgatgactttatacaaacctttcgcacaacaacaaaatcgcccttagaaaagctcagttccttttctgattcagcactgaagggatgcgttgcctgcaagagacacacccaagatcagttgatgaagaaataatagtattagtaatagtgataaatgataatcatcacaataatcaactgaaagattaggtttaggaatttagcatacttcagccaagaagtacattgttttctctgtgccattctcagaaatacctactggaggggcagattctttcttctgtctatctgagaccatctgagaagaagttccaatgagatgaaaattattgaattacgaaaatgaacacaattcatagaaacaacaccacactcgaagaaaaataagcttaaaatttcaggacagttggttctcacctcagcttcaatttcaccaagaatagctgcaactcttaaatgaaaagtcttttctccttcaacctataaaattataagcacagactataaataaaattctactccctccattccaaaactattgatgtttaaggttagggttaaataagagtaaaatattaatttatttagtctataatacccttaattaatacaggatataaatgtggttcactgtttgttgaagtggtcattaaataggctgtaagtacaatattcctcttaaagatcaaatataattatttaaaatatgagtacattcaatagttttggaataaaaagaaaagactaaacaccaatagttttgggatggaaagagaaaaacaattacaatttggcataaaagtacataaaaaaaatcaagtgttatcataccatggcaacaagcctttgaaaagtaagtctctgctgttgtgcttcaacagcggccaatgccgctgcagcttctttacctagaactgccatgtttgccttcagctcctgcatccttgcttctgcagcatgcagtttggcaacctgttcagcagttggagcttcccgaacccgtgcttgtcttctagcaatctcctctccctgattgaattttaaaaccattccaagttatatgattaagaagaaacaagtatgaacaccaaactctgaagtgaatgtaaatatgtaatagataagaaccaaggattcaccaaaaataaaaagataagaaccatgttataaaatggtagtcttcaattcatcaggaaaaaaaaatgaaagagaaatgacaatctgtgacagcatggaaatcaaagcaaaatggaaaaggcaaagaaaagtatctctcagctaccaaagttgtgagcccaagcaaatggctgaaagattcccaaaatgcagtccaccacaacaacctctcataaaagctatttctaacacaactacatccactcaacaatcaacataacaacctcctctcatatttgaatcctatagtgtccactctttccttcttgaataaactcccatatttttggtccatggcctaattgacccagcacctgcccatatcttctttgggctcaacttctcaagctctatcaacattgttatcatgtaacagctatctggagtctttctttatcaataatttcaacatatattgtttctgcctttctggtttatcatgcatcaaacaaaacatgaatcataaacttcactattcattccattccatatatgagaatgagatacagagttcgaatcacaattaagttaaaggttgatccaagagcagagctactaatccattctaaactttgacttacttgtgcctctgcttcttgtctcatccgactatatcgttgagcaagatggcgagcatcctccaaaggaacaccattgatcatttgcctcaaaggatccaatacctggaaattgaaaccattggattcatgtttctttccttatacatttaaagataatgcaaataataaattacattgacctcccttgaggattccaaatgtcatatagacttcctctgtagtatcaaaacatacaaatgttccttagattttcaccttttctgaagggtttcaagagtggcacatgtttgatcaaaattaaaaattgcgctatgtatggcttgaaagtaggaggtcaatgcagtatttaataaccttaagagatatcagtataatttactttaacatataaaaaaaagtataagcaaattggctgtattctatcttccaaactatctcctatgttgaatgatcagtttgatactcataacctagagatccacatcagagtttttttaaacattagtgtcttgttcatctgaactaaaactaaatttcacactgaaaaggtcatgcaaagtaatattgaaatggtgacctggtcccccatgcatatcatacacaaacagtagcagaatatggctatttatgaattagaatatctaaatccagcctcatttatggtcaagaaacactatatactgaaaaatatagttaaaatagcaacatggagattttaaactcatctgtaggtcaatgaaaagattctattactgtttcatattttaagcaccaattctttatcaacttttttaaacaactacttactcagctaatcattcacttgacaattagaacacaaaatttggtcattttaggacttcatcttactttattttccagtagactcttcaatatgattaatgtacaatagaaaaaacatgacagtgattgcttacaaagaatgccctagaaattgtagtttagtacagtaaatatcaattgacaatattttaaaaaaatcatttgtatctggaaaatatagttatatgaaattacaacttaaaacttttcaagactggagttaaaaaactgacttaattgggaaaaagcacagagagtgatatgtaataccagtgcacagctaggaatactcatataaattaagatgtggctaagagataaaactaatataatcttgttttgaacttgtacacctgaacaacatatgaaaagtccacctgtgtagataaaagccgatttaattcttcgtgctccttttccacatgcttgcgggcatcaccatatactgatgcagccttagctaatatgttgtcactgttgttctctgctccatatttacagcaatcctcagaaagtttcgttcctgtctaccatgggtattgtttatgaggatttaatcaaatcataagtcgataaacaaaacttacaggtgcttctcattcctgaacacatgctatcaagacttgtcaaagtaaactgaatttgcaggaaaaaaagaaacaaaagctaattttcacctgtttcaatatgcttataacctatagctgtaaatgtttctgctgctttaacaatttctttctggaagtcctggatcagaggatagttttacgcacatcaatatacataaccaccacgaaaagacaaatcatttaagataatttttttttatgaatgttgtatgacaactactacaactgtggttcagaaaggctgcacagccatgtttaagttaactccacccccaggttaatttatacattccccatctctctctacatcacttaaggtaaagctgattaatagaccttccataactaacatgtattccaagagatataaggttaaatgtaggatatcaatgtttggggtaatgacagcagctacaagaaaatcattcaggataactacccccaacccttcttttccaaaacctctttacaaactgccaaatccaagcttgacataaaaaatggatttaaaagttgttgcaaaaaaaggtttaaaaaaaatgtgagtccataaatctggcaagcacagtaatgtcactcaccatgcatgaacattgaatagacttccctaataagcatatataacattctattttgagttaatatgaaataggaaattccttgctgctcaagcatagcaaagctaacaatcaatctaaacacaaagagaaattgcataccttcccagcacgtgtggccctgtacagcttttccagctggtggtgtctctgcatttcgacctcatcgatgaccacaacatctgaactctcataaccactactgctgaactgctttattactgcctgaatcacaagtacactgacaaagattacaaactagcaattggaaaacattacttttccctgttactataaaagtgtgaatctaaactaataaaacactatggttggttgatccgcaagaatgtgccaaacacaaccagggaaataataattcaacatcttgcttaagaaaatgagcgtctccacttaaaaaaagccataacattagtcgaactaccccattttcaattgcatttcagaacaacgaaagaagaactaaaacgtcaaaagttatcgccaaatactgggaatttggggtacccagatgcgaatttgagaagagaaacacggtacttgaagtgacaacacagaaaaagacaaccttgaagggaagtgagagcaaacctgttgctgtttggcaacttgctccctgagcttgctggcttgtttcctcagagcgtccatggcagattctttcagctctctattcttaattctcagaatataaaagacagacaacaaagtatgaaatcagatccaacgaatgttatctgagaaccccaggccccagctcagctaaacgttgtcaacttgaattatgtcactcttttcccctcttttttcttcggtaaatcccaaaaccactttttacaataatttatagcatataaaatggccatttgaaattaagaagacgttgctctaaattttacattattaatagttagttacgcgttttagaagattattttcattaaaatggtttccgcttctgaaaggtgttgttcattaaaaaataaccaattaaattcagtaaaataaataaacacaatcaaaagaaaacctatgaaaatccaaaagcagatcccagaaaaggtaatttgtgattttaattaatgattaccataaaaacaaatttgaaagtttgaaacttttctcggtgggaagcttgaacatgacaatgatatgacacgcttttcacaagcctaataattctctttgctgtgtcactgcattgcaacaatatatattcagagcacaggagaaacattcgtacatacatagctactagcagttcactttcagtctctgtagatttggtttgtgttcattttccccactgaatagtgaggggtagcatcgcaacccaccatcttatttcactctccacatcatgccttcaggtgctaggaagagaaaagctgccaggaaaaagaaggcaaaggaacacaacatcaacccatcaaccaacaacccccaaggtaccatttttcactcaaatgcatgtgcatctggcaattaatcatagatgggtccttttcagttgtgcattatatcttttttttggtctttttgttctattagggtagatggagttctgttaattattcttgttttgttttactttgatttggaatatgcagcagtgattcattgtggttggggtagtcgagttgggtacactggtatttattaatttggttgttttaattgataatagcttgattgattgtgtaaataataggaaatgatggtttgaagtcacgagatgagaaaggaagtgatcgtggtgagggtaattctcctgcatttcatgaacatggtgaccatcgtaatccattcaatgatggaagtgaagatctggaagagagaggaccatcagctactcaaccgtgtgcttctgatgtcgagaccctggaagaagtccctagtgatacttcaaaggaatcgtgttatgagaatgggaatggtggcgatacttcaaagggtgaatccctcgctgagaagaactcagaggatgggaattgtaattcagttgaagaggcaattgcaagtcatgagttggttaagtccattgattcttccccttttaaaatgactttgattactgaaatggcaccagttgaggagactgttgattcagctgctaactcttctgttaatttagttactgacatggcttctgtgtctgaggtggaaaagagtgatactggaagtgtgttactagagaagtcagtagtccatccggtagaagtgaccaacgtcgcaatgaagataaacgaggataacacatattccttaaccaatgagaatgtgacaatgtcaagtgcgggggagcctaagccaaaggaatgtgatagtaaaatgttaacttcactgtctactagtcctttaactaaatttaccaatggtgcagaacatattaaggattgtaagactgcaaaacgttctgaaaatcaggttttacattttctcacatatacactacaagtttttcatctcacaattatgatttgtaaattttttgtgaaaaactaattttaaatatatttttctttgctgaattaatttgcagcctcatgtagcattggctccaaatttggtgcaaaagaccccctggttgagttgctgtggattgtttgaagttttgtcaagttcaaatagataatttcaggtttttcctttgaagttactttaccttgtaaaatcatgtttgtgtgggttctctttcaacttaaaaggttgtgtttacataaatttgctaccctcatgtatgcttgcttatggttgtttttagctttagttttgcaatttttctaattggtttggtaatttgcgctttgtgacttttaaactattagagggaagtttggtggtgttttctttcactttttattgtttgtttgtctttggtgaatgcaggtgtgtcatgggtctttggaccaatttgtagatactagctttaatggtttcagtacaaatgaggatgctaaattattgtgactatcaatccatgctattatatttggtcatttggtgcatttgggaagagcataatgctcatattttttacgagatatgcttggctgagcagctattttggaatgtgattaagcaattagcatcaatttggttttaaacacatggtcttttaaggggatttctgtaacatacacggggttaggtaactttgctccattagtgatttgtatttttctgttattcattttccaaattctttgttatggaggatctcttattctccaattgtcttgtaattttattttcttcatctgattttcttcttttattattgctgacaccgtcttgttcatgagattcatgagcacaacgggagggtgtgattcttctatacctgtgtgtgtgcatatcattctgaaggtcatactctgttattattctagttcaacttagtctgagcgttatcaaatattcatgccttttggatatggatttaaataattaagatgtacttcttagttcttcatttggtatcaattggttttttaagttatattattcgttctaataatgctcattttggggattattgttgtagtatattgtgtatcagtatacaatcatacattttaaacttgcaaattacgttatgtttgacaacatcttccctctgtttttcttgcagaaatacaagatacaagcatcaagcgtgagtatctcaactgatgggtcaaacttgtgaagatttagaagaattttgtgatattttgatttagattctctcctttaagcttttcaaaaatatagcaggcaaccaggccaaagtgtataatccatacaacttttgtttacattacagtggggtttgtttgtagttattgtgctagcaacaattacagtcttttaaactgatttgttaattctgcgacatggaatttgtcacaatactgtttatttcgccctttctaattaatgtagagcagcagtgagacctagaaacttccttaagaaaattcactttgatctttttcatctaatgcacgattctcatgcataaagcacttagaacagtgtttgcagtgcagcgcactttgggtgcaactttaaaagtttatctttaatcagattaactaccagaaccataacgaagcaggactcttcgtgttctaacttatggtgcaatcatacctcggatgtgtccctgttcaaatgtccttagttagctatcatcttgagaacttcattgtagactgatgaaactttgttcttgccctggtcatggaaatgtccttctttgatatttggtttttcttgtcaaggttacggttcaaagattactctttcatgtttttttgctctagaccatcctgtggataccaactgaagatttcgtaattattgtgtgtgaattgcttttctaggaaatatatcctttaaaaagatctaaaaacctgtttgactttgcatacatggtctttgtgtaaaaatgtttgggttttattgtaccccatgttcgttaaagacttataaatgcttatcaaggttatgcagcctgatgtccctatcatgatcaatgctcacagcttactcctaagaaagttggaggaaaagagaatagaaaaataaagatagtgttctcctttattgctcttgtaaatggcatattcttgattcatacaaatccaaattccaatcattcaaatcaaaccacaatgctaattctcctttaacttgtatgaattaaaagtcttgattggaccgacagaagagaaaagaaaaagcaagagggagagaaaaacacaagcacaccaatacaatccttcttggccaacaaaaaaagaaattccttcaaccttcaagtttatcttctatacgcagcagcactgtgaatagcaactatgtagaaaagctgtgtagctgaaagtataatgataaaagcctccattgttttctgtaaaattggacatttcagaggcctgacacttgaaaatatactacaagaaagttattaagaaagtaaatgaatcttcctgtcttaccaggcgtgcatttctgatacgaagctcaatctctttccaggcaaagcttcattaatttaattatagttagataattaaaataataccacaaaattatttttttggaggggataaatagaaaatagaaatcatagagaaaagattaccccatggccaggagtgtaagagtccaagccattgtagcaactgaagctgcagatggcaagctctcagcagtccatgactggatatgattgattcctgaaattgctgatgcagcaccaaccactccagcaagcaaagcaaatgtgacaaagaatccagtggatgcattgcccattgggaagaacaagggtgaaaagtgtgctggtagttttaattctggacctgcatagtgcatagtttctcaacataagcaagctgaagaaacacaaagaaaatgattggttacatgagactatgagaggacacataggtacatttggacattttaaattttcatacctataataaaaccatgatctattgctctgttcatggcccatccactaatgcccaaaactatggcatacatgcagaagttcagccccaaaagaagagtggctataggcttcatttgctcattagccatctgtgttgctgtttgttttttggataaggaaaaagctgttttgaactagaaaagtactaggggatttcaggaacctaaaaagcagtgaaggaaagtctataaatccaaggaccaggagctgcatatctttggtacaaatgagagttcttatatatatgagaaatggataaaactgaaggttgggttcttttcttgacaaggctgctagttagctaaaaagcttcatgcaggcctgtaaagatgatgcttcacaatcatacttagacattaaaatttaaaatatgtatgattcttacttgtctcttatttttaaggtttgtttaactgtaaataccttcccaacaggcaacttcttaggagttgtcaattgtttgttctctgaggcaagtcatattctttgccactcctgaactcttctcattcacaacactctggcccaatccctattaaaaaaaacccttacactgtttctaacaaatttaattatatcgcgcaagtatttattatttagttttatatactaaaaaactttttatttttattaaaacagttgttactatcccaaaaaagtcagatatagaaaaatatgaaaattctaagattagttaaaaaaaatatattttgttatttgatatacaatgagacaattacataaatgtcttatattttataattttgttagtaataaaataaattatactatcagcgtttaacacacatttttgtttacaataagtgataaagaaaaatactcatctctgatatattaatatcaatatgattttttttccaaatatattgtaccccttcctttattatcttaaactttatacataatgcttaaatctataaatttatttaaatgttaaattgactaaatctgactctgaaatgtatgtgaacaaaatccaagttaaaaaagaaaagaaaaaataaactttacttgagttttatagtaactaccttgaatactaatggtgattcttaattgattgacgtgtaaaagtgtttacactggtcacgtacgacaattaaactcaaaagaaaaatgaaaactctaacaacccttaacttctcttaattctgtaatttttattttatctttaatgtgcaaaaaatcataatgccgatcgacagtattacatgactatgagggtatattccattcttctttataaggtcacaaaaaaaaaatgacgttcatcaatatttcttataagttggttaatactataattcgaaccatgcctgttgaaattaatttactttaagaacaaatatattttacagttttcataaagcaataaaaagggattatttctataaaaaaaggttaaatgctcaatcacaaaatcaaactcaaatatctatataaattaattgatataaaattattctaacttaatttgagatctcaagttcaatcgtgagtacgtaactacatcaaataatccgaggtagagtttatcgctcatagtaatcccacaagacttgaacaaaattatctccgtgaaaaatacttgtaattcatataaaagtatctcatcgcatgagattgctttaatttaaccaaatgtctcattcaaattttgagtnnnnnnnnnntatacaatgagacaattacataaatgtcttatattttataattttgttagtaataaaataaattatactatcagcgtttaacacacatttttgtttacaataagtgataaagaaaaatactcatctctgatatattaatatcaatatgattttttttccaaatatattgtaccccttcctttattatcttaaactttatacataatgcttaaatctataaatttatttaaatgttaaattgactaaatctgactctgaaatgtatgtgaacaaaatccaagttaaaaaagaaaagaaaaaataaactttacttgagttttatagtaactaccttgaatactaatggtgattcttaattgattgacgtgtaaaagtgtttacactggtcacgtacgacaattaaactcaaaagaaaaatgaaaactctaacaacccttaacttctcttaattctgtaatttttattttatctttaatgtgcaaaaaatcataatgccgatcgacagtattacatgactatgagggtatattccattcttctttataaggtcacaaaaaaaaaatgacgttcatcaatatttcttataagttggttaatactataattcgaaccatgcctgttgaaattaatttactttaagaacaaatatattttacagttttcataaagcaataaaaagggattatttctataaaaaaaggttaaatgctcaatcacaaaatcaaactcaaatatctatataaattaattgatataaaattattctaacttaatttgagatctcaagttcaatcgtgagtacgtaactacatcaaataatccgaggtagagtttatcgctcatagtaatcccacaagacttgaacaaaattatctccgtgaaaaatacttgtaattcatataaaagtatctcatcgcatgagattgctttaatttaaccaaatgtctcattcaaattttgagtanaattctacataaataaatttttctgcattatatataaccacttttatactaaaaaaaatactttcaataaatttacttgaggcgcaagacttacattttctacaaagctaagtgctaaccaccaaaaattaattcggtaaagtaacaaaaggaattagctattttaaagcaaaaatatttttttaataaacgttataagaggggggaaataacatattaaaataataaaataaaataaacttctcaaataaactaaaataatcttatatgccacaactttttaaaaaacaaaaagttaatagagcttaacattcttaccttaaaatagttttacatttaaaaaaagtctcataggttagaagtttttcaaattgggccgaatgtatcaatagacatttattaaatggaggagttggccaagctttccataaaactccaaaagacaacaacctaagccaagagaaactactatttgggattttttttattaattattatttgaaagttcgctttaaattattattcaaaatacaacaagcataacatctattataacttctgaacaaaaagtcataatcaatgttacttcttcaacttttttaattgaattcgtaaaatattttacgattttaattaattttttttataaatttactactttaaaatcatagaattaatttttttaattttttataaaattcataaattaatttacaacttctattttttaaaatatttttttaaaattgtaaaaaaaaaattaattaattaattaataaacacatatatttttatttttttagttttattttaatatttttatatattttttatatgatttaatttaatatatttatttttttaatattgttcattttatattttctatatttttgatatggttttatttaatattttcctatttttggtatattattttatttaatatattttttatgtttaattttatatctatattatctaattttttgtataactttttatttaatatattatatatattttatattttttttactaatgataagaattattatttgttttataaattaaaaataatataaaagacttaaatttaaataaaaatatcaaaatattttgttaataatattaacttataatttatcgaataatattaaaaaatttaattaatttttacaattatcattaagtaaattaatagtttcgtacaataatattaattaattttattttataaattattttaatattaataacataaaataatttaataataaaaatagttgttaaaataaaaaaaatataatacattaatataaaataaccaatacaaattaaacaaatacataaaaagtataaacaatattaatagtcaatttgcttatatgaaaaaattactataattaagttctttagttctacataataaacatttcatttaaatttaaatcttttatattattttttaatttacaaaataaataataatccttaatattagtaaaaaaataaaaaatattaaatatagaaaatatattaaataaaataatatacaaaaaatatttaaaatattaaataaaaacatataaaaacatatacaaaatattaaataaaacaaaaaaagtaaaaatacttttatttgttaaataattaatttaaaaaattatttacaaatttttaaaaaattataaaaaaaaataacagctttaaagtcataaaaaaattaatcatatgattttaaattcataaattgaaaaaaaaataaaattagaaatagtaacgtcgattacgactttaaaaagtaataataaatattatgacttattcacttttaagtaataattcaaaacaaatatccaaaagtaattaacaaaaataatcgacccggttgtttcgcctctaagccaacacctaaactgaattgcaaacatccgtagaggcaactcaaaatttgaaaccttgaaagacatgcacttaatttgaaagaaatatatctattacactcgtataatagattttgttattagaaagaaatgaactaatgagtgaatgatataatttattcatcagcactgaatcccattcctctttttcttcgttaagttttttggttcgggataaaatgctatgaaaccattttttttttttttcattcagaagaaacagtcaccccaccaaaatctacagtgtagtacaaaggcatgtttccatgcatgcaaaaattaacactaccaatcattatggctgataaacctcaggaagctgaagaccaacactagaagcagattttccaagagtcctttttacttcatctgacctatccacggcaatattgtatgaaaaaagtaaatcctgaaaaattgtcaacaacgatgcatgatcaaaaagccagatggacaaaacgtagtttttcttgaaaatatatttattcacaggcataaaatgagtaaaaataattatatcaatgataggacacaatctgcagaggatttctcccggctcggccacaccttggtgatgctgatcactagtcaaaaaccacatcctcttctgtgctttttaatttaactatatacataccttaactaaagctgttgagtgttgacaccttgtttttaactaaccgagtttgtgtaaatctcatttgaccaataataactgttcaatcaaacttcttacccacaggcacaaacaaatgactatttgaattttgaaggaaaaatgcatcagagagcaataccttgtgatggtgtacactgttaagaagaaaagtataatcacgagcaagctttattttctgttggatagccacattgtcagacaaatttcggttgttacggaactctgaggttacaaattctataaaatgtttcttgttctcttccttcccaatatgtttcttgaccgccttgagaagaagacgataaatgtgagctgtttggaaggcgtcggatctcatttgtttctatcaatatccactacctactttcctgcataggatgacaagttttaaatataaatatttataggaatcttgttagcagaaaaaattaaaattagaaacctaaatgatgagagggagaaggtatgaaagaaagaaatgctactatagagaataaagaaagattacaacagaaaaaggagtgcaaaatttcatcctaagaaggtgcaaagaaacaaagaaaagataaagaaagttgtatagaacgaggatcttcaattcctgtgtaaactaggatcaatcttgggtttggtagagttcctaattcaatattacactacagcaattttcttcttagaaaatcccagaagacatgcagagaagaagtttatcctatgtttatgtataacaattccattacaacatgcacttaacacaatttgttgcatctcagaaaatattttacaaatgatgcaactagttcaaaacaacttgacttattgtactaaatggaagccatgataattcaaatttgaagtcaattccatcaacaactgaacagtgggaaaatacttataatgatgccatgatcactcagcaagaaatcatcaactcttggcttgaatatgcagctacagctagcatatttttcagattccttgctctgtgaacactgtcacaatgcatatgcaagatgttgcaacaagaggcaactaaattcattaaacaaaaatccacgtgtgtatttgaatggtacatttgaaaatcctaggaaactcaattgcttccattgaatttccttcatttgtaaaatttgttagtctgaatgagtaatcaaattccctccattcataaaattcaatattaggataaagtaattaaatcccctcaataacaatgataattttgatatgttatgtataacttcatatggaatagacaacatagaacttagcctacgagaaactctagcaatatactgtgtcatatgatcatatatgtggtctaataaacaactgagaacgaaagcaaggggggtacgtcaaaagaatttgttgtgaacattttcattaataatattgatcatatatggggtctgataaacaactgagaacgaaagcaaggaggctgaaatcacaatttgtttgtggctccccatgtttcagaacacacatcaaacagtttgtgagcaaaatcaaatatactgcaaaagtaaacgcaacaaaatgtgaagcataatggaatgggcaaacaaagtaccatacaaggaaaaaataaataaaagtcagatccacaaacacaagtgggaagttagcaaaataaacagagagcaaataaaaatgaggaataacacagcataaaatcatattaagaaacaactaatatccatattttgcaactatgaaaatgcagaaagaaagttcattaacatttgtagaagaagtgattgaagtactgcaagcaaaacaacgaaaatcaaatcagcgttgcttacttcctttcttactcgctgtggacgatgctgaaatcaaagcgttgctagttgcaaagaaaggtgtctctgcctctagttatctaaacgaacaaaaacttgtttaaaatgaaatgaagaaaaaaaaatgattatacgaatttataactttcttcgaataattaattttagcttttatatggaaacaaataaacttaaattttttggaattcataatttttctcttttcatttaatttttttcactcctaattaattaatgtatgctagtctttttttatccaattaaagagagataatttatttatcttttaaatatatatcatttattgtaaagtaataaagaatatttgggtcaaaaataattaatggataagataacttgaaaatttttttataaaaaaataaataaactaaaaaagaatcttatatttaaggatagaggaagtatttttaatgatttatatttataaaatttatttataatatctcacatttaaacgatttgaatgaggtgtttctttatgtgtgaaaatatataattctaaataaagattatctttatggctcatgagatatttatagaactggtaaattttttctcttgattaatttgcagaaattattaataagtatgtattgaaattatgaagtgtaaatatatgtttaaaactgtaactgtaagtagaattaaaaatgaaaacaactcaataaaagggcatttatacgcacaaatgaaattatggattcacaaaatttatttataatattcattattttctaaaaaaaagtttgttaaatggaccaattaaaagtgtaacaagtccaataccggttnnnnnnnnnncaataccggttatatgtctaattaaaatgagttataaataattaagtaaatgaaattgatatgtgaaatctcaccttatatttatgtttagcaatcttctttcttaaatttcaaaactcatatttatgtatctttttatcacttgtatattgttgaagtttctcgttcatatctagtgtgagactttacctcacatttatatatcaacatttatgcatgaacttatctgtcacgaagatttttgatataaaagatcctcatatcatgaatctacgattaattcatcttattagtctaaattaattctcacgtcgaatcataaactctaatatcaactattaaaaaatcaaaactcattattattcaaaattttaaagttgaaaaatataaatcgtatcctcacttataattttcaaccttttcattattatttaatataaaattcatcccacaattatactctaacatcaagtttcttcaattctttctatttatatcattttattgtttgtcatgccttgtagatggatgtctaccatttttccggtgtacaatagctgcagaaagaattaaacctaaattctattgggcaaacgcttgattaatttaaaaaaataggaactgagtattggccaccatatacaggttataatgtcctataatttaagaccttctactgtttttggatcacctataatatcactttaaattaattatttttttttttatcaatttaccaattttcttgtcttactaaccatccttctaagtgcgccaaatgtaaaatggataaagtgataaaagtatgcctcgacttttgaagacaatgcggatcacgtcagaacgggcaccttcatgacaccaccacctcaatgcccaattgaaggagcaaataactcttcaaaaaataatcccgcaagtagataaatacaagatataaagagatctctttatatttataaaagatgtttcacgatcttatcaacaaagacgaagcaaatgaagatagacttgtgattaaaatttgtcagtattatattattgatttgtttcataatttggtggctctcaatgtgcataaaaatgccacgttgcgagaccaaagaagatagagcttgacatttgctgaggaaacgtcactgagcaaagcattaagaagtggtgaaaaacttatttataatgaaaacaagtatagaaactaaagaagaaagattatattcattttatataagttagtaaaagacaatttttatttatttaataaaagacaagttagtaacaaaataaaacttaattctataattcaaatattagaattaaaattaactaaaatgatttttcaagttgtctcgtcccatttacaacaaaggactcaaggtatccctatctgtcaatcgcattaagaggtcataattgctcaaaagtttatcgatttcacattaaaacttgaagagtgacgtcaattaaataaaagtaacaacttatagttaattatgagaaaattaaaaatactaagtagccttcagccgttaaaataaatagtgggtagaaatagaatcagaggtaaaaattgcatttgtctgtatcatactatagtagcgatagagagaggagaaagaagaaatgtcaacaatggcaatgcgtgtgtcttcttccacttcaacttccactgcattctctctcttcaatttcatgcatccgtgtaccttctctctctcgctcttcgccgccatcgctctcctacaccttcaatcctcttaggtactctccattcattctcatctcactctatttcactctttctctttctctcactttgcttttccgctttacgaaggtccttcatcggtcacgacggaatcagaagcagaagcgcagggtttcgtctgcattgctacgctcctgctcctctcactcctcccaatttgcaatggatctctaccatttcttcagtgtctgttcacttgcttttctctatttcatccttttactttttcaattccgctatttatttatatattatatattctgaacatttgatttcatggagttatagactacgcacttttaatattgtatattaattattcggttattttattccactgtctgacgagtggaagaaacatatattattgaataattatttatttctgatcttcgattaatttgccaaaaaaacagaaatgtttgttcatgcatgtaacttaatcttataatgaaattctgcgatgatggatgttcggaaatcggaacattgtttgtagggttttgatactggcgagaggccccgcggtgccgaaatcgtatattgttccgttgtttgctttgcaagcatctgcaggtgtcgtttcctggatcaagtatgtcgttcattcattctgatgttttgttttcttgttcagtttatatgctaaaactgaattgtttatttaacaattcttatttgttcaacaatattttgtagagtattattattcttaatttttacaccaattggatgtacagaggtagatatggtgtatggacagcattcttggcacttctgattcgtctattcttctatattcctggtatgttctcttatccatcacgtgaaatttaggaaatattgaaggagaaacaatttgtactgtagatctaaaagtgtaaaatacaccttttatagccctcattgaagttggtgtaaattaaagcatttttctaggaacctcaggctgggctctatatcttcttctctttgtataaactgcgaaacatgagaaagaaaatcctggttgtggagtgtaataataagaaaaagttgtgtattttgttttttcatacttgttggataatgattgaacattgaatgaaggaatcattttcttctgggtctttttcatttctaggtgaacttgagttgccatttctggcattgctcttggtgatggtagctccatacgaggctatgaaattaaggtaaacaagtccatctttttgggactttgggctgttgcctcttttacctttttcaaaaagtaaaataaaatgcttcaacatctttcttcatcagggatacaaaagaaggtgctgtgatttcattgttgattgcggtgtatctggctttccagcatttcacaagaacaagcttacatcaatcatttgaccaaggttcagttgttgccaccttagctatcatttgtatcactgttgtatctttgttgcttcttatctgagttggctttgaaatgatgtacactgattgtaaataagaacaatacttgttggaatgacgatataaaaaatatatggattatgttggatactcaatcttgtacttttcacttgttaattcaaataatgaagttggaatccgtatttggtatttgtcatagaaattgtttttagaacatgatgttctttataccttagttattaaaaccaaatcaaaccatccagttaaccataaaactgttttaataaagaactgtttttgaaatattcaacaaaatgaatattgcatttgaactgtggcaagttaagcattcactatgaacacatttaagtctaaacatgttgaatttggtgtttaaaagctagcatccgatgtaataaagtttttttggtgcttctctatcaaaattgtttaatagaaatagcaactaacaccatcaagccatgtttatgttgtgtgaccacatcccatgtttatatgtcactgttgtgaataaggtagatttttccaaagtagccttctgagcgtcctgggctcaacaataacatgttctagaccaaacatgatggtttttagttctttaatgtattttattctgtttagtaaataaaatggcatgctagctgatattaattacaaggattttctatggaagagaagctaatactgtagaaaaactgtctactacctataaatccttttggcttgatcaactaacagccatacatagatgaaaggtataagtaattttaattgcaagacttgttgactctgactcgttgaaattttgcaaaaactgctggaagactgattgaattccagcgcatcacataaagaatgactgaaccttgtttatcgtctagatgtaatttgatagtggaagggaagccaacaggccacatgtgaacagcagcagcagggaataaaatgcagatgtggctgtattggggcttcctgtaggttctgaaccaaagacagttgatccgccaccgggatttagcatgcctggtggagttggggtcatcactggagttggtggacttggtgggctgacaaatgttggtgctggtggtggttgattagtgctgcattggtgagataatatattaggatgtataggattgcatcttcattaatatagggtgaaaaagagatataggtgctgtaaattctcaccttgttgacttggacgatgcgtatttgcaattcccactacctgcgatggagttagatgttattttctacttttaaggtagagaagcacaagcaaaagacataaaacaaagtggaaattgtttacaggcgcagcctaatccccttaaaaaacaattaaataaatgaagcccacaatccttagagtcatgatgtaagaaaagtaagctaattgaggacattcatccgttgctgagaatggcgttcaacagacagcagctggaccttcatcagttgcttaaagaaaaacattactatacttttttggtacaaaaacattactatagttggtttcatggaaggggattcattcctgtttataaaataaaatatatattttttaaaatgacttcacttgatgccttgtcgcttgctccacaggtgaaagtatgagttcctggcctggtaagttatgggtaaggagagactgtacttcagaaaatcttagatataggtatgtaaagatatatggttatattttttaaagctacaaacaagggaagtggggtgatccaactagaaattattgagttatatagtccctcaactgcctttcaagttatataaagtttgcataagaatcttcattttatatgaaagaagaatagtgacttgagctatccaagctgtactctaaattcccaacaggtctgagatattggatgcatgatggtatgtataggatacttgctctgtgcctgacatgacgtgttacccttaagacatgtaaaacattttaaatatcatggtcacaaccaagaaaattatcacaagaagataatcatgcttttaagttcgatgaaattcttacttggatcattgcttgtaagagatgctgttcctccaaatacacagctggtaggtgctggattcttctggtagtagtcattgaatgcataggaagcatgatcacggacagtgttcggattataacagcttgctcctggttgtattgctgagcagtctgcacctccatacccacaagcatagtcaagagcaacctgtagagcagtgtctgaagctccctggttagcaacacaccattgaccacctgatgatgttggtgttgtggttggtgtggttggtgttgtggttggtgtggtgggtgttgtggttggggttgttggatttgtgtttggggctgtggggttttgccctgatgtgtcaggtgtttgtggagtgttagggtttcccatatatggatttcctgtgccaggagttgtgggattgacgatagggacatcatctaattgagtacccaattccgatgatgagaagatttcctgttttttgtcatttaatattttggttgttcctagacctggaaaaagaaacggaaatttaactccttagtaggacaaatgcgaataacttttgtgatgcacttaagatatatattaccctttctaaatcaatttacgcaaattgcaccaaatcaagttcattacagttgtacatagaagtgtgcatgcatgactacgatatcttagaactggaaactatcatcatttgtagacagaatttatctatcgaaaaatgattgaagtttaaagataaactttgatcatattttcgattgataaattgagtacaaaattttatggctcttgataattaggcttgggttgcatatcttctcaatccaaagttggttttgttataaatgcgtggaaaaaatggtacctgaaccaaagaaaagacataaggagaataatacgaggtgccagcttctagcattcattgctccaggtcggcttgtgcttggattgcaggtgtttccttaagatttattaaacaagggcagctccctgtctgttcctgtgaagaggaatttcattacttaaactttttatattttacataaaataaaatcatgaagaatcgtagctttcttggatcaaagagagaaggaagaatataggcaaacttgagaaaggaggcatgggataattgaaataagcaagcaagagaaggtgcaaactgaggggaaaaaaggtgcatgacaaaggaaaaaggtgaaaggtgaaagggcgatctgatgcttgagagctgcaatgtatatataattaatgtgacggtgatgtctctgcaacgtcctttctcttttgtgccactcttttctactgttttatgggactgaaccaaaaagtaaagcctgagcaagtggtttgccttttgggtttgtaacgaagaatgttgtctcccttctattgtttttatcctccacctcttaacacacaaccacaagtcattttctattccctgaataagtggttcctctggaatgttttcgaagtacgattcctttcctacgaaactcaagttatgctactgctgccttgtctaacaagaacttgggataatcttgtcatgcttaagcaaccttgtctcaaatctaagttgtctattgtaacaaatcaaaaaaagggtctattgcaaagcttaagtaacttaaaacatttctgctataatttttttttttttttggggggggataggaaattcagaatgcgatcggaagctgaaaagattctcaataattgcagtaagggcatgtcaaagtcccaacatataaacattattaataatttacttgcaacaatcatgaagagaatatcaaagagaagtcatagtactaatttttttcatatatatcaatatattttcatatacaatgtatttatcaattttttagaatattacagtatactaacaattcgtctatacatatttttcatataactcattatatgtataaacattttatacttaatatatatttttcatgatcaaactaatttatgtattaatatttgattgataattaatttattaacatgaatatgttatattattgttgattatatttgtttgaattaaaaataaaataatcttatttaatattttctgaaaaaataatataaaattgtaatgtgatctcatctcatacaacaaaatattctttatatatattagataataaaatgaaaccaaacgattttccttaaatatcggacactaagtttatttcctaaactcctcctatttgcttaagctttaaaataaagtaatttttaaacataatttcttcaaaaagcattttttataagtaacttttttattataaagaaaacaaatagtacaaacgcagttaacgtaagtttttaaatatgtcttaaataaaataaagattttcttaaaaaaaagaaagaaattcaaacaaactagcataagtaaggaaaggaggaaaattactacaaaagcagaggaaggagacaccgaagttgattttcctgaagcttttgaaccttgtgggtgttggtgtcttcagttcagctaatttgtaccctatgaacacgtgcttttactatttatttaaaatcaaattacttttttaaatcagatttcgaatgacttaataatcaattttccattgaataataaatcgatacattaatttaggcatgcaaacttaaaatctctctctctctctctctctctctctctctctctctttttcatatagctgtggaacaaagatttgaatttttaatcgtatgtgaattcataaaatacctattttttttcacgattagaacacatctagtggagccatgcgcaaattaagttcaaatcattcaaatatctaattattccgcgtgaaataggtttatggcttaattagttttttaacttttagattgcaaggaataaatatatattttatataaataaaatgtataataaaaaaaatgtttttaaatatataaattactatatttgtttaattcataggaattaaaaataatatcaaagaatatacaattaaaaataatatcaaagaatatacaacaacatgactatattcaaccaatttaattagatttaatcatgtgaattatttttgaaaagagtcatgtgactttttaaatattgatcgtccatgattaattatatgattcataataattctctcactcttatatagaatacatttttctcatatgatacatcatctatatgtgtaatccattaaatatataattattcttaccgaattttttataaaatgataaattagattttcttataagtgttcttcttatcaaaaataattatattgattgtcataatatcacattttgatcttttctaaatcctttataatataataaaataatttttctacattttatttattatactcaaataaatatgtcaaaagaaataattatcacattatatttcaatcttgaattttgaagaaagtaaaaaaaatcaacaaaaataaaaataaaaaataaaaaatggggtatcaatgcttggacatagaattataagaccaaataaagttcgatccttttcggccctattagttataacccatggcttccattgagtcatgtttgggtaacctattttgttacctaatacaagtataaacaactagtttttcaaatgtgtgtattttaacccttttattgccttatcaatgtgtatattctaaaccctatattataatagtttaatggtgatacactaacaatataaagtagttttacactatcatctaattacaaattatcgttgatatgatttttaaaataattttataaaaatcaacaaacttaccataaatgttgatttctaaatggatgatcctataaaactcgttacataacctttttttttcctcatattatagtaccattttattagaacaaaataataattaacaagtagttagtttgagtataatttaatttagatattttaaataaggtttcaaactcgagaattgttaatgaagttagctggggaaagatccaccagcattaaagatgatcaatcaagttcttctaaagatattagtcatcgacaaagcttgcgatacttaacacaaataacatggtttaaaatacaaaaaaaaaggaagataagagtaagactgcctacaatattcaaccttttactttcatatatagaggagtttatgggcagtgaggtatgtaattttttattttttatttttttaaagaaagacaagaatgaatccataaagattgttatattgacacatgttgtaacccttttattatcttaaagtatctttagtatcagatcttgaacaaagatcttgagtaaagatcttgagtttaagatatgatattcattatatctctcaataaaggaaatgaacaactctccaatggagaatgaattattatagaaaaatcctaaaggtttgcataatattcaagaaaggataattttttcccctctttccttaagatctgaaaatgagatctattactaaagaaaaaaatgggacatatcttcaatcctacgtgacactataagatccataaaaaagtagtctaaaatctcaatttagaatctactactaaaatgctcttatcaattctattaagtttattccatgtaccgcacgaccatattggagtgtataaagttacttcaatgtaaaaattaagtaaaatcaaacatgatacctgagaggaggaacacattccacataaaaatgaaattgtcgctacatttcaaccctaaattcaaagaatagtgaaaatagaagcagtaatgattcctgatttcctttttcgtcattgtcaatatgtaatgaattttttaccaataaagtggcatttttccatacacttgaacaatcaactaatacgtctgatacactgtaatattggggaggatgtggtgcgaggtaaaaaaaaaggaacatagtatcaaaaggttcataaaaatgtacaacaaagcttctctatgttagtatgcattaaacccaggtcacttcagttctgcactggctgcttgaatacaaactcttgcatgcgtcctagggtcatttcttctcatgtaatatcaactatacacttcatcttgaatggaacggttacaaatattccaagccaatcttgggtgttaggccaatgtacgttaaattaaatgccattgttgccaagaaggctaggcaggccattcaggcatatatctatattaacttgaaattcttgagatatacatagcagcttccagccagcagattcttcaaaagtttcaatttaaatgataaatccaaagcaatagattgcgttggaataccaaagaaactgctttatccctgttgtggcatactgcattttttaagatgtcggctgatatcatcccatgctgcaaaaatggggctcagatcatgcaccatattaccattttgactacggaggaaaaaaagaaaagaaaaaaaaaaactaattgtacctggaagtttctggaagtcaggctctattccattgccgtttatgtccttgtgatttggtgttacatacttcccaacagtgataaccacaccagatccatcatcaagctcaaatacagattggattagaccctgatagaagtattgcacatcaaagtgtcatgaagaggttgttacaactacactgaatgcatcacgtaattatacatgtgtaagagctaaaccatagcaaatatttttatttttattttttaataacaagtcactgaaagacatcaatatgattttctgctattatctccctttagtaagagaagcataatgagaaaagaaacccattttatagaagcaaagacaacgctgcacagtctttgtggtacactggtgtggtactccttcaaaagatatacacaagaaaataaagctaacgtgattaaagaaaaatgctttcagatggacatggggttctcataacaaagaatgcagattaaagtctacattgtttgaaccatacagcagtgatggaaaatattcataaaccttgccatatgtgcgttttccaacaagaacggctctacaattatcatgcagtgcagaagcaacctgaaataagtacaacagctatagtgacatcataaaaataagtggaaaatcaaacaaataatatattgagaaattgagctcctcactatttcacttgcactagcagttttgtcatttactaaaatctgcaagggttcaaaccaaaaagaatcataatccttgtcatgaagtcctcaaaatgagaattccattgatcaatgatatataatgaacactcataaggagactattttaatgttcgcttgcatgaccttgctcaatatgacgggaaaacactttatcacacagcaagaataaccttataaaatgatcaaacatatagatctcaacttaattcaaacttttagctagtcatgtgcaaggggtaatgaatttttccagaaaacttgagaatattctcagatgttctttaacttatgttatttataatgaatttgtggaattttctaataataaagccttatctcggggagtcagctatattgaccaaatgatgtcattggagaattggacccaatcaaaaaccaaattttcaataaatccatttttgaataatggtttcctaaatttttttcaatatatcccattggatccacttttagcatagggtcaccagttggatttctcctcagtcctcatattacccaactatccatcatttcctcaatgggcatgctccacttttgtctcaaatacacacttgttctttttttttgttttatgtcactcgtccacgttgaccttatcacctctaggctagtcttattgcgacccagtagaatatgcctttgaatttaaaaggcactttgtatacttaaccaaaaacacttggattcaaaagcttatctccacaactcaaatttagaaattcaactcatcaactaggaatatatcatctacaaaaaaaataaaaaattgagcactggctcctgaatgtgcaaattagtaccttaaggtgaaaagtttgtatttactccaatggtggcaataaatcattgacccatcatccataacatatccatcatagttttcaatagtaggaaattctgttactgctccatgggtttgcactcaaatcattacctatcatacataactcaccatagcttcacgcattgcacaaatctaaaatctttatctgctcctttatttaaagggaaaaaatccacaataaattcaatgtatcttaggttttttccctagcattgtttttggaatatataatgcttatcttaccaaagtttatcaaatgggcatctagaatcactatttatcagtcaaacaatcaataacttcatcaaatcagatgtctttgaattattcctgccccaatgataaaccaaaaaagaaattgagaagtagaaatagttccaggaagttaattcaatgataaaaaatcagatgtagaaatttttttacaacaacaggagcttgaatcaatggtgaagtatctgtaacaatagctttctgtaactgaggatctcttccaacagtgtagatcacctgtcatggagacattagaaaaggacaagtctaagaaactaaaatgtattcaaaagaacagttgaataattatcacaaaatagcagactttttaaagaccagtgtgccctacagtataataaaataaagcaacagatatatataacaatttctaactctgaattcacatgatagataacagatattgaatatgaaatcataaaaccaaaaaaggatgccaaagcaattggagatgttactacttcaacatgtaagcaactatcaacttggaccattcggcccagaaaaggctgactgttagaagcactaacgcccttcaagctcaacacttgaggggtcttggactgtcctgcctagaaaaagtcgaccattagaagcatccacaccctttaggctcagcactcgaggctgtgaacagtctggtcacagaggttgaccgaatatagtgaatggattgtccaatgtagaatgattgggtattctaacctttggcccaatcacattcaataaataggggtgaccccccttagtcacctcaagtcacacaaaaagggcttactagggtttctttgaggactccttagtatgctggacataaagattgtttttgacataataaagacctcattcatttgtaatttcaatagtcattgttttggatgtcacatgataattctattagatatttagtgcttttcttaagggagagtgtttttcacacaaaatgtgagggcaaggggcacgtttgcaccatttcaaaccctaaggtattattggcatgtgatcataaattgaaggaggtaagcaaaacttatcctaaccattacaatcagcaatgagcataaaacagacataccgtgtctccttcatttaggaaaagctttgcaatttcaattccggcctgaacgagttaaacataataactacattagacagttttaaaaagcaaagaaaaactacattcaatagaatgcagccatcatttatcttgtcatcttatgtcaaccaaagcatatgtaagcacaccatgacagaagaatacaaatttacttaaatttctgaaaataagagaatataatttcttgataccatgatgcagttgcagtaccttcctgcaaaggcaggtttccacatatgtacaatacaagttcttagaatgtgggtttggacctaactcaatcttacaaaaccagcttgtaaggtgacgattgcccctacttatatacactgttttgaccatatcactaatcgatgtgggatctccaacacaagtgaatagatataaattcaaattgtcctcaaagttgcacaactagtgactcaaaagtaaagagctccaaagctgcaaatcagtttgcaggttcttttgtggtagtgagacttaaatatatcaaattcaaatatatgattaatttttcttagagagctagtcatctgcaaaaaggtaattcttttaactatttgtgaaagcggaaaacagaagcgaaataggcagagtttacaaataggacagtcagcccatgtcaacctacaacaaattataggtctatatccattggcatatgcaccttatttgttacctgctgtgggggcaatcagatttttttttatttgttcatgtatataaaaaaaaaaattttgcccccataaaaaaatttaatctatcaacttggaccattggattttttttaacccaaaacccaaacaaacattagacattcaatacaaaaactacatgatcaagcccaaaccatttagccaattctcattactgttacaataaaaaaaaaaaaaacaaaaaaaacaccacactgcatagagcacaaataaagattatctttatttagataacgattatctaaagatatcttttagtaaaagaaaagatagattaaattgttttcctttacatatcttttttgaaaagatattagtataataatatattagattgaagataataaagaataagagataaagaaatattgattaaacaaatttcaaattatgtacaaatacaaggatagacaattcattttcctagaatcacacaaataaacagtctctcttgacattaatgggttactcaaggattgagaataaggaagaaagtggagaaattttgttgaggcaaaaataacgaagaagtcaatttacttgcttcaagaggtgactacattttcaaaacttccatggtatacttcttttatgagcgtttttcttttactgtgtttttgacataaagaaatcaagattaatgattttttagtgctgattattttaatgaaggatgttacattttacactaaattagtaatgacaatgaaaaaatcatagaacatttttaaagtatgaaaatgcgtagagaacaattgtaatttgtagaagcttaagtactttagattttttttatcatgatattatgtattttgtagtaacttgtggtattttacttttgtgaaaatattagaaattatttcttgctcccactaagaaaaatttctggatccgccactttctatatccataggcaaaataatgagaaaagttactatggtcaatgaagattacaaagaggaccccatcagctcatgtcaaccataactaagtcaatgattttatgttcaagacatatgcagggccatgctaaaaaaacaaatctaatccattccataacagaaatggtttaatgacaacttacttgatacaccatttgtgctacttcaaggttaggtacacagtaatatatttaattcataatttcatatacactaagaaaatcactactgtagtcaatttcaaagaagtgaatcaaaatggtaaaggtagatagggttatatgcaaaagcaacctgtactagcccaccaagattgtctctgagatccaatatgaaatatgaggcacccatgtcttgaagtcgtttcattgctgcaaaatccattatttcttctagtgtcacgtataaaaaagtggaaacaactaataaaagagtccagaagcaattataatacaaatcaatataaggatccaaaaaagcagcagccttactttactaacaatgtatggtattcattcttgcatgggttacatagcctagatgacaatttttttatactaacaacataaggtaaataacaaacccctggcagatcaatgtcaagttattcagaggcgaaaggtgtacttaacatgctaggggtttttaatgcttgaggcaagaagcacgaaaaagctcacatctgactagagaaagggattacaattgaaaaggaaaacaacaaaatattaaagtcattttacattgattttccaatatatccattattcaatcaaaacatttgccgattgtggtcattaattgacttctaagatagacttgataaaagcatagaacagaaccccatagtatattgtatttcatctccatcctttacaagtctgacttagaagtcaattttctctcctcaaaacaatatgtatccgtaatcagttggtctcaaaattaatttagtatcaaggaaggaaagggctgaaatctccatatctgatccagcaaaaaaaacctgaccttagcagctcagagtaagaattagtaaaagaagacttttaaaaaaaatgctcttattgagaaaacattattattttagttttaaaaaacacatatgaagctgagaaaagcttaccaatgactaagtcttttctggccaatgcattgaactctttgaggcgtatatacccaacaggagtaacaccattgtccaattgttccagccgataaaagactggggtacgagcaacaagttgccgctggacttctattgattcaacgggtccacagttgccatgcttgacctgacagtaatgattctaatattaaacttgaacataaaagtttaaactaaataaaactataaacaaaggctagagcagatgccaaactaacttggaattagaatccaaaacctgaatagtcacagatgttccattagggccttgcaacagggatgatacttcaaatgctgattttccctttacctccatgttattgacagccaatatttcatcccccttccagagaaacagaaaaaagtaaaggaaacatattatattattcaaaatagttctttgtgcctaccccatttgcttctaggagagaaactaaaggacagagtatattctgataaatggtaaagacagagaaagggaagttgttttgaatggttaaaagaagcaaaaaaaacaaaattgttcacctatttactgtaatggataccagagattgcttatgtagcaattataatgaaaagcatgactatttgacatatttatttcattgattaaaaacatagaagtgaaggcaagagagatgtatgtgtagattttgaaggtgaagaagatgatgatttgaagagctgcaaattattaagaatgttcatcatctttgtgtacctgtctaacaccagcagaatgagcaggaccatccaatataattcccagtacctccagtctgaggtctccgttttcatcaggaacttccttaaggtttattccaacaccagtcatgtcatacctcgccatcttggagaacttttaacagtgggaaaagtccatatgccattcattaagtaagaaacatgaatagaaatcaccacaatctatataatctcatacataagaaaaacaaataacagtgaagagaacaatgatacaagaacacatcacaagtttcttattcactgcaataaatgcaagggcagcaatattttggaagattcatagtgatgtgtgtgtgtgtgtgtaaatatttctgttaaaccatatagacatattaactgttagatttcatcttaaaatcagttggcattaagtgaaattgtccaacatgtatataggctccaccccaagaattgaattgagacgggctatatgggactttccaacactcctttagtatccaagcgtatcctagtagttgttttgtagcttattgcaccacacataattgggtcattatcgtgttatcagaccacctgataacgcaaatatacagtcatgcaaactagtatataagtggggcgcaacccttaaactatggagtagctttagtctaaaggattgagttaggctcaatcctaagtttagaccccttccatagatgtctgctagctaaaacaggtgatggcgatacacagagagaggctataacaagtaggcataaaagctgcaccccaggaattgaagcagacatgtgggtctttccaacactaatactattgattaacaaacacagtaaaaaggacccatgaaaaaagacctcatcaggcgagagaaagcgagtataaggatcggccaagctggagagcattcgtttgatgatttggtgcgcctttgatcttgtctgaatggaattgctcaaaatagcttccctcttcagctggaaacaagaagcgctatattagcatgagcgatgaagcaaccaaccatgagacactatgagagtaagagtagttgatgttagttacctgccaagtgtcctgggaccatctgtggcgaccagtgtcgagaaaggtgtcgttgacaatctgccatgcttcctcaacgaggccttggttggtgacaacctcgggagctgtttggagcgtctctagtaagggcaccacatcaggacatgtttgggaagcagagacagaggggaaggagaagacaagcccgaaggagagagcagcgccgaggagagtgttgcgaaccaagggaatgggaatgggaatgggaagatgaggagctttggagaggaaagttggaggtgctgagagtttcatacacacatagccactcatcttctgctgctgtcttttttctttgtcttgctctttaacattaacatcgtttcagcaatgtaggcgtcgccacttcactcgttccttatgtcatccgtaggtggatcccactcatcatccccaagacgataggaaaatgtatacttttaactcatcaaattttaaaattttaatatttttaaaaatttcaatactttttcattttctgtcaaaaatgtttattttcgtctctgttttaaagtttaaaataatcaatttaatataataacgattatcactatctttattttatttttaaaattataaaatattgaaaaaatattatcatccatcatcttcttcaaccttctaccatcacccaaaacctccaccccaaatagaaaaaatcataatccaattaattgattattccaaattcaaatcaaaatcctaaaatcatatttcaacttcaaatcaaaatcctaaaaagaatttgaaaaccaaagcttattctctttctctctcacacattatccatctttgttccagactttgtttttctgcgtgctttctccgttgtcactcatacaggtaactcagttgtgttgcttctacctcttcttccacttgaaccaaacaccgtcattcgatattatgttgacggtatttgtatgtatgatgtagccgaggacaatgtcaggtgttcctctcttcaacctcgctcctaatctcactgtctcaaggctctgcttaggttactctcagcctcattcccgaaccatgaaattctattcattcacttacacgacacttgtggttgtgggtggcaggaaccatgactttcggggagcagaacacgctggcggagtcctttcagcttctggaccaagccttccattcgggcatcaacttcttcgactccgccgaaatgtatcccgtgcctcagcaccctcgcacgtgcggcatgagcgaagagtatctcggccgttggatttcacaacgaaaaatccccagggatagcctcgtcattgcatctaaggttctcttcttctgtctccttcgttgctttgtctcttttctttagctcaacttgttcttattgcaagactaggttgctggaccttctgggcagatgacttggattagaggtggtcctaaatgtttggatgccgacaatattactgaagccattgataataggttacttcctctcttaattctttctcaattcacaccctacatgcagactaatcttttatatcgtatatgtagagagatgctggacaaataatactagtagaaactgtttcaggtcttttttgcttgaagctaaaatgaattgagcttctactgtaagctaaaattaacttacgcacttaacttttatagaagctctctcgtttaacttctccaaaagtctttttttaacaacccctccaaaaaaaaaactgtaaagagtttcatttcagctggactatagaataagaaaggaaaaaatgatcagaacaatagtgatggagttttagattgtgatggctcataatatacactcaagagaaacattaaggtgggggtggaactggagaggaggggtgcttgtttggaagagatataagatattattaagtttgcatcttatgattctctttctagtaacaaactctgaaagcttttgttattgaatttatgcagtttgttgcggatgcaaatggattatattgatctttatcaaattcattggcctgatcggtttgtatgtttttgttaatttgaagatttggacatttgtttacattgtttttgaatattacatgttcgtcgactttcttatttttgtcccagtggacgtgcaatatggattttaactcttgaaatgttacaccttgtagttatgttccaatgtttggagaaactgagtatgacccggtccaacaatatgcttcaattagcatagatgaacaacttgaagctctcagtgcagctgtgaaagctgggaaggcaagtggtatttttaaatagtttcaaattgtcaacctgtcactcttgtaattcctgaatcatgattcatgagtatgaaaatgaatgcattttttgcagatcagatttgttggtcttagtaatgaaacaccttacggcttgatgaagtttattcaggttgctgaaaaatatgcttcacacctgaagatagtatctttgcaggtttgatcacttaccatccaactccggcagtatttttgtttattttcatcatggaagcctcaccctataattccctctatgaaagtttatttcttacactaatttttttctgtttagtgacagaattcatatagcctgctgtgtagaacttttgattctgcaatggccgaatgctgccatcatgagaggtatttaatattattgttagatatgaaatcatttatgtgccttcacccagcaacttccttttaggatggttcacaacatggtatgattggtatcaaagcctctttgactaagtggtctagagtttgatctttgttgaccctattcttctagataaaagttaaattttaggacaaggtagggtgggctagtgcattgtcctcactttaagtccaaaggttgcagagggggacatgttagatacaaaatcatttatgtgtcttcacccaacaacttgagtttctaggatggttggttcacaacaattactaaaatataagtttgatattacttgattttggtcttccaaaaagaaggttatctaagatattctgagttgttattcggattgatacgaaatgttgtgggtttggggacataattgagagggcataatggatttaacattaacaagcagatttatattatataaatcagatttaatacaagcagagtcataaaattccatttaattcagatagatggaacattggaagcttaatgcatgaaaatttataatgtttactacatttgttggcctaaatcattctcctgcattttctatgaaagcctcattgtttgataattatttatcttttcagaattagtttgttggcctacagtcccctggcaatgggtatactttcagggaaatatttttccccaggcggaggtccaacagatgctcgtttaaatctttttaaaggttaattgacatctttatagatatgttttgtcttacctagctttttcacctcttgccctccttcccaacatgaaggaaggaaaataaatgttcctggtaagtatgagtttagccaactgatactattgttattattcccagggaagtattcagaaggagaatctaggtacaacttgtccaataaaattataaaggcagctaccgtggttagtggattcttgtcagcattgttgcagattgcaatgctaatactttgattagcttattggaatctgaatatcacatttccttagttttcaagacacatttttttatattttgattagcatatataaagttttcttaatttaagagcagatgatgcgatgtgaatggggaaaattgttttaatctgaactgatagccttagaacttaaaaacatgtgcaatagctagatgctaatatatcataggcgtggacatttaaaactgaacctcatggttaactgttgttaattagaaactctcgttcctatttatttcttctgtttactgattttaatctccatattcatatatttccccttctgcagaaataccttaatattgcaaaaacacatggtcttcatcctgtatctctggctataggtttgataatcttttcctagatcttcatgtgcaaccccgcatccccacccccttttatattaagtgatgtaatttgcatgactccaaacgcatcaaatattaaatcagatggctggtccaccatattggttgatagttgataccgttttacaaggaggagttgctaaattctaatacctaaagtagtttggtagctgcacttgtactgacattgcctttttttagtccccatgcatatgttttaagtaaattcataggtaatcaattacactgcgtatgtagaattcaataatggacagtctgtcaactgtcaacactgatagaagtttggtaaattgggataagtcatgccttcaaagttggagtttttgcttcttagtgatattggatgccgtacattggcttcttctaaataaacaagaatgttctgtttttttccttccttttttgtcttactattttaaaaggatgccaaaaaatggtttaatttagtagtatcttatcattgctggagatagttattaatgcacacgcataatgcaattttatccatcatttgcaattaactcatgctttttcattttttaaaaagcatccattgactatgttattgattgtggtccttgagcttatccattagaggttgtggacttgtggggcattagtttattttttaattttatcctaattttatttcctgttcatttttgttttgagcagcttttgttttgcgacacccccttgttgctagtgctgtttttggggctaccaaatcatggcagcttcgggaggttctaaatgcatgcaagattgagctcacatctgaagtaattgaagaaattaacaagattcattcaaggtttccaaatccatgtccctgaagaatacaaattattaattaataattatgacgaacatgtttgaaatttaggtaaaaaaatactttttaaaaggataaggattttttattttgctttcattttatttttatctattagatttatattaaaatgtgtggggcaataatttcaacaaatcaaacatttaccatctcattatcataaagaggcagaagatagcagtagtcataactcgtaatacattatacaataatcaattcgcgacccgaaaatacagaaggcgacatataaaaagagagcatgttgaatgatatattttcggcaaattgttaagtatacgcaataaatataatattagtagtatatcaattatcaatcatttgtattcttcgtggatcaatactcctgtgggtcccacttttactccatatttcaattgaaacccacatctgattattcaatgaacaaaagaaccaaaactatcttcatttggtttaacaaccatattttcttagttttttaaaatctttttattattccagaatagtgcttagtttatttgcatctatacgctactatgtctcgatgcatatgaaaataggagagagagagaaataagttaaaatatttctaaggttggatgtatttattcccctaaattatttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaattagaaagaagatttgaacttttaaaggagaagttgttatcctattaacatcgatctgggctgcattaacacatcatttaaagttctaagtgaaattacagtaaaaatgatagttaataatattttactacttatttgtacacttggaaacgaatttaaccttttttatatatagaatttaatatgtcaagtttttttcattttacatttaaactttaaaattatcaattctaaaagaactttttttaaaaaaaattgtatataggtacatgcttaattctttttacgaaccctagtgaaggctggaaataaaattgtatgtaggttataatatgccgttaaagatataataggtaaaggaaaagtgaattttttttataaaaaaggtatccctttattttaattttttgaaggaaaagatatccctttatttattattagtattgtatggagtatattttgttattagtgttattatattgttttaattaattattaactatttagtattttcttaccaagggaattattagcatttttagtaaagattctattgttcataaacactataatccgattaaatgaactaagtggagtatattttattcagaataaacactgttattatcactcctctaaaattacgttaaaaaggatacacacacgcataaattaatcattgttaaaagcactaaatcagaaacaaatcccttactaacgaagattttcagtttctcacaaattgttgattaatggttatttccagaaaaaaggaggaaaaaaaagaaaaaggaaaaaactccgaagagagaagaggagggttttgtttcgtttcgtcctctttccgtttcgggtgcaaatcattgacaggagagagagagagaaagagtgcgtgtgagagagagaaccagcgcgcggagagatattttaaacgcggcggaaccctaacgaggcgagcggcggcgggggcggcggaggcagatcggagcgcgagcgaggaggatgagcggcaaaggcggtgggggccagaaggcagggattcctccggcgagtcggaagatggttcagagcctgaaggagatagtgagcaacatgcccgaacacgagatctacgccactctcaaagactgtaacatggaccctaacgaagccgttagtcgcctcctctcccaaggtataacactgcactgcactagggtttttcaatttcaatcacaatcactccttcgaacgttcctaatcttctgtatgttcgtttctcattgtgtagatacttttcacgaggtgaagagcaaacgtgagaagaaaaaagaggtgcgttttgagttacgtgtagttcgttttgcttttatttttgtagatgcttgttaggaggagttactcgagttagttaatactttgtttatgtatttgcttgtgatgctcagtgacgagatttttttttttattcttcagggtaaggacacaatggattccaggtctcgtgtggtaagcaatacatctagccgtggcggtggcgctagggttggcgctgaccgttatgttgggcgtggaggcgctactcaatttagtagtggtggtggtaagcggatgctgcttgctatttttgaataatgtttggattaattaatatgctcttaacctaatactttatcaagtagtatttcttatgtcgctattgttgttgtgttgttgcttttattattattgtttttgttgtcatcatcatcatcaccatcacatatgtttggaggtcagattctggtctcctgcagggaaaacctgtattcaaaaaggaaaacggaacacctgcttatggaggtcttactgctcctgcatctagcgcattggacaataatgtaaacaggcaactaccatcctacaggtatattttccttcaataattttgtgcactactggaggaactaaaggaattcttgtggttatgataaacaccagttcgtggttatgatctgtttggaaattcagactggtatttaattgtacttatttctggtatttattatgcttcctccagttttttctgaaaagcaagttggctcacttggttgttaaagcatccaatccaacttttgcaagctattttcaatgcagattcacttctattcttttctcagacagttggtgcattctgtaccacttattcactggattactctatggttctgctttatctcgtgggatgaactttatagccgtgcaaatgttcatttttctcttccaaagatataagacaccaaactgatcagaaatgtcttctatttgtaaatttttgaatttattataaatattttaaattggtcgtccaataaaatcaaattatctttcaaagtgatatacttgtcatcaaattggtttttggaggaagactctgatggcattagtgatcatttaaggatcaatatgatgttgcatatatgttgagtgggccaaagttagtgtttagttgtttactcatttgtcttatttttttcaaaaaagttttcccgtaagcgcttgaatactgagcacacttttagtatgtaagatagatggagcgtctcatgaatgttcaaaactgctgtagtgattctgtccgtgtctgtgatggtctatcttcatcacaacatggtgggttgcaatctcaatgggcggcgaacccaggtcaagtatcaatggctgacattgtcaggatgggtaggccacagaccaaggcatccatgcctaactcttctgtccacagtggtagccatcagaatgtttttgcaaccccagcagcttcacataccaatttgcattcattgcaaggtcatgcttccaaggtgtcagagacaaataatgaccatggctttgctattaactccaatgttgaacagaatgatgaatggccatcgattgagcatcaaccagctgtttctgtatcctcggttgtagatgatcatccaacatctgagtaccatacaaactcatctaactctggtgaagctaatcagcagctgaagacccatgtaaatgaatttgtagctgaagatgatcctgttgagaatccagaaaatgttggatctgcttctatatctgctaaaagtatatctgaagagaatcccgaaagtacatctgtttttgatggtagcttgtacaaggacttaaattcctaccaacctcatcggcatcctattgaaactaatgaaggtgactaggatgtttatcagtttgcatgtcttgtatgtttatttatatcgagcatatattttttacataaaatttgttaagacttagtgtggataaacttcttgataagcatttgtagaaaaagaatttgggaggtaaattaaatcaaacttctcccttaagttaaaagtaaactatgcaccttagcttttggaaaagtgaagttagatcaaagagcctctaaacaaggaaagaagtttgatttattttacctcttttttgttctcctataagttcttattgagaagtttgtacaaatagggtcataattatcatgtaattagagggatggtactggcacttccatataaaattgctttgaaattccttagttttcatgttgttatctcttttatccacgtatattctgatttgtttgattgggcctgaatcgttgaagtcatagaaatagcataatgaaagaatatttcaatatccttttacaagtcaatcaaagttcatcattgttgttattgttattttgttgttgttattattattattattattatttttgtttttattttctttctcatccttttaacatgtgaatagtttaaaaggagttattttattactaaaatagtcatgtgccctgatctctaatggtttagagagttattataatacaattatttgaagttcattcatgattatatcaaacattcgcctacatgtaagtcctaatttcgtaacgtctttctttcagctgaaggtggtgtttcatcagtggccgcgaacttagagcagctaaatttacactcaaatgatcaggggacagaacaagaggaggaaaattcttctgtagtaattccaaatcatttacaactccattctgctgaatgcttaaatctgagctttggaagttttggatctgcaaacgatgcttccctttctggatctgacccatatgcatctaggcccttgaaaagtaatttggaagatacatctggagcaaaggatgtttcaacaattgggtcctcagatgttaggcatgtgcttagacctcagtatactttgctgcactattctggtcatattttacttatgtgttttttttttcttgcagaaaccgtgactattatggcgatgagcatcttactactacctctgatgggaatgtagctcacataactggtgtggatgctgggacttatgagcattcctccatttcacaatcagaggctttaaaatctgaaccccctgaaactgctcaggaaaatcaatattcatttccttcttcttcacacgagtttacttacgaaaatgcccaacaaccggatgttacataccctcattcacagacaagctcacagatacagaacctgtctcccttctctagtgtaatggtaatgcataaattcttatatcttatgacttgcaatattcagcatatttcaaggctgggtcttattttgggtgttaagttaattagagttggttctaaaatgatttgagatcttatagtgttaaaactaggggatgatcagtgctgctattcatctctttgagaataaatcaaagcttattctctccaaacaatagaacttgtggtagagtactgttttactgtaataaatactttttcgaatggacatttttaagtatattttatgattgaattgggaattgggcatagaaatgcctccatttggatatttcattcatattgttgggtggtgtatgatttctatcacaggtaattgagttgagtgtgaatttcaatgctcagttgctttacttgtatggcaacttattactacagtaacttgtacttttttccagaaaactataatatggtgcaggaccatttattgctttactgaagtaataagccatatatattattgtagtttcttttatcttctaatattaatatcatgttgctattctgctatttgcactaatcttatagtgctattgtttagcaggcttatacaaattctttgcccagtgcactgttggcttcaactgttcaaacagcaagggaggatatcccatactcacccttccctgcaacacaatcaatgcctgcaaaatatagcaatattgcttcttcaattggtggtcccactataaccatgtcagaggtgaacttctgctctagcttattttagtttttctatgtacaagcttttgagacaggttgaatcataaataaatctaggattacagcttacagagtgttcaattattcttgttccaagaggatgtgtactggaatttgcatgtacattatgtttgggggctgcagttatataccaatattttggttaacaataagcactaaggatatgtttgcatgtacatgtattgaataccaactgtccagttgacttccatgtgacatcagttaaagatctgacttacattaagagcatcacaaatcaaaagattatatcttggttcaatcacttgtgtcaaaacggcattttgcatgttttggtttgagctacttgagtgattactgattagtgtcttcacatgagctgatattttgccaataactgttttctacatatgaacttacaaagtttatattaattaattaattacttagcaacataagaggatgtattggatgagataaggcatttggatttttatgcctatgtgtcacatcaattgtatcctgtacccattttgtgtttgattcaatacaagtatttctacactctgcagtgcaatcttgtttctttgcctgataaatggctggggatctatctgtgataaatcttgtgtgattccatttccatgtatatacattttattatactactactagacaaatccattcaatgttactagtcattttggtttcccataaaaatatgggtgaaaaatatgtagatgatatatgtatatataccgtgcgaaggtactggtcttggaatgctatagttatttttaaaaattaggatcctggtgagacaatatgtattaaataaaatgtttatatatttaaaaatataaaattaaatttatcaatatgtgattatcctatcctaacccaagtttcatgctttctcccactgtcaagtcctgtgatacttttatggttggcaagtactttgagggtgttctgtatttgaaaacagacggaagtctaaaaacacaaatatggatgtgtatgagtgcatcagtattgaatatggatttgatacaagtatctgggcattacatgcgtgtgaaagagaacacaggatttatcataattcctctgataccagttaatagaaactggatcagaggaattagaataggaattggaatgaacttttctattagaatttggagtaaactcctgcagcttacaatgtgattctttcgagggatatcacaacctcctagcactctcgcgtgatccctcttccttatcctcacttctatttctacatttcctgagttagttaactgtaactaactccttattctattaactaaacagctttattactatttacacctcctagaatatatctgaccccatctacccctatcataatatcaggtcattggtgcaatttatattgaaattgttttccaatgattacatttgcacaatttaatgttatatctgtatatatgtatcttgattttattgttttttattaagagggagaacatgggtatttggtatcattaattttatttgtcaactcgtaggctctaagagctaataacatctcaacacctcaacctaatccacaagccctgcctggtgccaatgttgccacgggacctgcacttcctcaacagcttgctgtgcatccctattcccagcctactcttcctctgggacattttgctaatatgattagctatccattcttgcctcagagctatacctacatgccatcagcatttcagcaggcttttcctggaaatagcacataccaccaatctctggcagccatgcttcctcaatataaaaatagcatttctgtcagtagcttacctcagtcagctgctgttgcatctggatatggttttggaagttccaccagcattcccggaggaaattatccattgaacccacctgctgcgcctactagtacaactattggatatgatgatgttataaactctcagtacaaggagaacaatcatatgatttcgctacagcaggtataaagatcttcattttaacgcacatttaactgttttcgttttccatatacagtttattctcttgggagttgagccaatttggtttcaacagtgccacctttacaaaatggagttatttgttagtttttctatttatgcttgtgtaaaaccatgatccttttaaaggcatgtaaacaaaagggttaagatgtgtttcattttgttgtcaacaaattactgtcattttttgttgtgagggaatggggtagactgattttgtgttttcttctgtcagaatgagaattctccgatgtgggttcacggacctagctctcgaacaatgtctgcagttcctcccagcacgtattacagcttccagggacagaatcaacaaccaggggggtttcggcaaagccagcagccctcacaacagcattttggatcccttggataccctaacttctaccattctcagactgggatttctatggaacatcagcagcagaatccaagggaagcatcccttgctggttctcaaagccaaccaccaaagcagtcccaacaaatatggcaaaacggctactaatcttattcacctcccggtttttaagggtcttgatgtgagtttgaaagtgactggtcacaggcatttccgcggtctaataattaaaatgtgccattgtttggtcccaagagaccatatatggcccgctgctgccctatgcgaagttgtattctatacaagttataattatgctcgtgatgtttaacttaggtatttaagtgtgctaattttgtgtacaacgcacagtaccctttttatcaacattcttctcatctggttatagtggaaagtttcttggatgctactaccttggattttactcctttcattcttgcccccttcccttttatatatgcatgtctgtcgtttacctgagagttaccttgtattactgtctttgttccttttaaatataatttaatgtttttgctttttattgaaattatctaattttgtattatatattatgtttaatgattattttgtcatttattatttatttttctctttaacttcatgatttataaattgtaatttaagtgaatggaaggatatgattaataaaatagtttaattttttagaatgacattctacaaatggtagtttattgttattattccttccgatcttatttataaaacacggttttggaaaacattattttttctataagattctcgcaataattatgttttactaaaatatttttatttattttaattatagttgattgctactcttaattgtttcttctctcttgaagatgaatagcttctcaatactattaaggataaaatttgaaaaatattataaatgtaggcaaatttaatgttaatacatgatatgatagaaatagaaaaataaaatatatcagtggagtgtttaaaatgtaatctcacttaaattttattgtaacataaaactttcaatcaaaatattacggattacggattgtgtaattttgttttgcaaatctaatttcatataatcataaatgagttggattgatttggattaattgggtttgaatatttaaaaaatattttttattttttaaaaaataatactttttaataataaattatttttgtctaaagttttttaaatatgtaatgattaaatacatttaaaaagactaaattgtgaaaacatttgacttatggattaaagattttaatactaatacaatattcttattttagatagaaataaaatataatattagtatgtgaaaatattaacaaaataaaaataagaataacttaaaaagaaagagaatcattggtgttttaatttaaaattttaataaattatgtgagttcaaaattattaatatgttttgtatttaataattaatttatatataataaataaaattgtataattttaaatatcttagaaatccaagtcattgagttggtttgggtcacgactcacgagcacaatgaagattcctaacacttataatcaaagtttatatcacaattataatgaaatgatacaaaaaaaattgagggtgtttttcttaatagaaattaaaccctaactagtattatttcaaaaaggaaatgattttgtgtttttttaaaataaaaaaaggcatacacatggtattgcaatttgaccgagactcaaggaccaccgctaccctccaccctaaacatagtggtgcagaacaaaaaaagcacctaattatgcatcacaaaaatggaagctaacaattcatagctgttctgttctgttcctatgggatactaccatcacaaaaggaatgaccgtctcatattattatcataattattataatattccattcgctaccttcatttttctcggagtttcaggacgtggctgcagtggtggtggtggtggcagcgacagcaatggcgcaaggcatggcgagtaaccgcaaccggaacgcgagcgcgcaagaagcgcgcaaggtgatggtggtggcggacccgacgcgggaatcggcgggcgcgttgcagtacgcgctcgcgcatgcggtgatcgagcaagacgagctgattcttctgcacgttgagaaccctagctcgtggcgcaacaccatatcgactttcctgaagatgccgtcgttgggaagctccaccactacgtcgctggaccttggaggagggggagccgcggcggatggagaagggttcgattttctggaggagatgaagcatgcatgcagtgtttctcagccgaaaatgaaggtgcgtgtgatgaaggtggagatcgatggaagagacaaggctagcactattctttctctgagcaaaacgcatggggttgatgtcgtagttattggccagaagcgcaatattacttcggcgttattagggttagtatactacttcaaactgctatttaattttctgctggaattattcattcttatcaaaaatgcattgttggaactggattataacgccaagtaactttagattaaggggtttccgctatagcccaacacgggaagcattcagtctttcttctatctcattttcatcccatttttttcttaaaattttcctatttctttttcattctatcaaccttttttcttttctctctatctctctattttccattccaattcaccccaaaatgggattatatttgagatctactttctgtattttcttaaattcttgtctcaatgaagagaaagacagattcaagtattgtttccatagtgtttgattaaagaaaaaggatttttaattttttttttatatatttcatttacaagtttaaacaaaggaaatagaagaaaaaagaatcaaaattcttcctctgtctcttttctatctctgctttgatatgagatttgaaaggaaagaaaaatgtataaagtctgtaaccttttgtgactggattatttttaatttgaatacttaatagtagaatttaattagaatgtactaagaacagcctacttttgtaataatttaaaattatttataattaatccattatattaatacaatattagttaattttctatatgatagaatccattaatttcacgtttggttcatgatcaatgcattaaaaaacttttaaaaggaatttacatatgtgcagtatgtagttgtagaatgctggtgtagaagttaattttatgttgctaacttataattcttcttttgtgtttgaaatttgaatgcatggcaacagatataagcgacctgctggtggatctatgaaaggggtgaaagcgatagacactgcagagtatttgattcaaaacagctcgtgcacctgtgttagtgtacagaggaaaggccaaaatggaggctttgttctcaactccaaaacccacagaaatttctggctcttagcctaaaggcttcacacaccccatggccatggatggtagacatttttcattacggcttgaacatatcaatttcgctgaggatagatttaggagaaacttttaaatagacatcatatcatatattattattacattattcattaggcactcaaatcattataactcccagaaacttatatgggtcacatactaataatttgagtgcttatgatcaataatgtctatctaaaagttattctagatgtagtgaaattggtaagatttccccgtaactttgttgtttggcaaatggtgagaatcccatggatgttatcccagattacctaaaaacaccgatctactcatcttaaagacgaaaattttctgcttatctcaatgtttccaaggagaaaattctgctaacaaatgtcataaaaatgttagttaaagaattaatcaatagatagattaaaaatcacagtgtgttgcttgataacattaaatgttaaatttttacaaacttttcactttggatttgttagcaagtgttcttaacttactagccagcaatctattatttataaaaggacatacacttaataatggaacaacactctcattctaagattcctccatgtatggaaacaccctcggagtataaaaaggcagaagcttatctgaaactcgccagatcacagttctgaaatagacgtggataaattttgttaaaatatttgcatattcattcatcagattctaaaagcaaatctgatataacgaggccccaacgcaaagcttctcttgtttaatattaataagcaaatccgtaaagtcaagccttctgtgactgtataaaagaacttcatagaagcagacaaagcaaaacaatccttatttcatttgatctcatttgaatataacagaactattgttgctttgtaagctatgagaaacaatttaatggaacgaaaaatttacttatccctttgaatctttgatttcaacctttcggttttaatttcatgttttagtacacgatccgtgatgagtactcgtgtatatcatatgagaaaaattcacatcaagagaaaattaaaagcttaaaaaaatacacttgccttcataagttcagtgcacacaatttaaagaataaacaagcccgttgaattcttcaatcttcattacgcattatattgacgctgttgatgaacaaatcatgtaactcattttctttcaacgggatcaccttcctccacatccaaatttccaccatatgaagttatgaagttctcaacataattgaagacgctataagaaaattcagctccaagattatcttcaggaagcaaaagttccaccaacactatgtatcactctatctgttgacataagaatttcatttttcaaaacacctacaggacgctccaaatgttgaaaacattccaattgtgtgcaacttacaccaacagtaaacaccttcgtacttatcatagaaaacccacaaatctaagtgtcgtgccatagtttcagattctgagctaataatcactgcaatagaatccttgtacacagcaagtttttacgcgtgttgaaagaaataatcatttcgttactaaccttgtcactcacctccatagccacccaaaaacaaagtttcctccaacgtcacactgttctctgtccaaaacaagcatccattcacagttacacactgattactactatatggatacacactgaatatttttcaactcgaacagcacaagtttggtgaaataaccaccaaaacatgcattgtttgtcttcccaaaagagtgaagccttacttaatcaccatcacttgtgttgaaatagaagcctatgagacaatgtggtggcatcttatgaggaagcaaagcgttttgtggttccatgattcgcttggtttgtcttgtagctgggttccaaagaaaaatggtagagctttggtccaaagaataatgaacgacacaaagtaaaccgttacataaacccaccaacttgaaacccatgtcagaatctgtgacttttggaacatgaagttgtttgagcttttttcttttgacatctagcagaaataagtgatggccgcagattttgtccttccagtgaaagcgatcgaggattagaagtgtgtctcttcgaatgaagcgaagaaaatggtttgagatgaaggacttgacactggtcagcaaggacttcattgatggacttttgagaatgactttgaatgtttcttcttgttctaatgaactaggaagaatttttcatctcatttagaagagttgggtgctaaacatgagaagaaacctttttttttttttttttgaattctgaattttggattatacagtactactgtatcagctctaaagaaatactactagtactaggcttaattttacattaaaaaatttaaatgagcattgaaatcaaaagggtagaatgtgcagaagcaatttggaatttcgaggctgtcttgcaatgtgagtcatattgctagtaattggtgagttgatttcatttgatgaatgatgatggcttggtggaagtggaacaggttttaagattagatcaattggcggaaacagtgaacctaattgatctctgaatgagggatatgataagttacaagttaacgatgattatccacctcaataccatacattcaattttgtttcttaaaaatgaaataatttccatatgttctccttttctcatgcagctaggtgagtaggtgcctttttcatcttgtgagatactgattgacttgagtagaatttgaaggaaaaaaaaaactcactctgctctgatcacttgagataaattagattagattagtttcaatattttttttttttctcaactaactcaatctaatcataatcaagttttaaatttagactatttagtcattaggttgtacacttgcacataattaactattttataaaaaaacaagattaaaaggagagcaaagtttcatactatatctatatttaataatatgtttaatgtttatgcaccaacggtataaaacaattttacattgtcattcaatcataaatcactatatgaattattttaagataattattttaaaaatcaatatacttatcataatggtgaattataattggatgattgtaaaaaaaattatattgttagtgtatagcccattttttcttcaattatttgtctaatttttaattttttgaaatcatatttataaaagaaaaaaaaaaagataaagataaaagtttggatgtgtgatcaagtttgattgggtctaacatgcaaatcttacctatttgattatattaagcttaacacaattgatctatataagattatgaaaaacaggtggtttgaatttttttatcaatttttttatcaattaataggatctaactgctagatcctattaatatatggatctaaaaaaatttcatcatcacaactagagggagatatcatccattcctcctctttgtgaagaattacctcaatgtcaattaaattgaaataattctagagaaaattgaacaaaatcataggacaaaggactagggagctaagtaaaaatcgtttgagaatcatgtggtaaggtaacaataaaataggggcctaaaactattaattgatcaacctactttatttctcaaacataaatagtagtagttatttagttatattattctacaaaaagattcacacatttcaaaaaggaatcaattatattagcaaaacaataatatcatattccgtaaaaaaggaataatatatcaaaagtacaaatcagatgcaaatgcatgtataaatacagaccttgtctccatggaaaatatcccaaatacagtatggagtaacaatgtaacatgatcaggaagttatacttcgctaatccagatcagttgtgaactcatatttcacatgtcacgaatgagcttcaattttcaaatattgcaaaagtaccaaaatttccattaatgtaccccagaaaaataactgcaaaagtacattgtactaaaatcatgataaagtgtagtagcgaaagtagctgataaagtgccctacacatacggctctttcattctatacatacgacaatttcatgtgtatatgttgtattgataaaatcctaaaatactacgactaaagctataaaagactacagaaaataacataaaactgaaatatttcattcattgattaataatatgtaaagagaatacatttatatagacctaagtaatgtcaattaataaataataattatgcaagtgttttttttttcctttactcaaaatttaggagaaagaaatgacgtcccaattcaaaacagaaaaaacctattttaacacaagtaaaataaaaattgtaatttataaaatacatatttaactccatcttacatgacccttcaatcattttattttgggcataaaatccattctatcacattgtcactgggttgtgatcaccgaacgcagcagttcgtctcctaaaatcaatctgactttgtttacccattgttctcgtgaaatattttgttcctgactccaaacagattaaattttaatcagttactgcaaatttttaccttacaaattaagcagtggataaaaaaacacaaaacacaataagaacctgaaagcaagacaattatttaatattgatcattactttgaaaatccggtagtcttttgagtaacatagacatttgtgctggtttcaaatggtttgaaacccttgccactatatcgggaaatgacacatatggtgattgaggtttccgtgccccatgtatctctggatctgcacaccaaaaccaagaaatgattaagccttgatccaagcacttgttacaaatttgaaagagaataactgcaactatgctttaatatactctttctaacatattatttattattaatttgaaattattgaacactataaaatcacaggcaagattatttaacaggaagtgaaagtcataattttcaatcaatttcagtaaactactaaaaaataaaaaactacttacctcattgttcggagggtccacgctatacgcagaccataactaaccgagagagatattgtactcggtcttacccttgaatattcaaagagactattttcaaattcgaatatccataaccaacaaatcactaagacacaactttactactgagtaaacaataacaaaatttatttaaaaaaatgaactagggaatattttatatactcttaatataattatacttgaaacttataatataatttggatgaatgtgtgtattcatataagcagtccatacaatatgtcttctaggtgctgatatatcatccaccccagtgtcatattgcttagaactaggttggctccttccctaatatcaccttgcatagtagcacatgcctaaaaccatgttcatctgccacggtacacatagcactgtgaattaaatgaacaatttcttagctctatttccacatagacataaaattagttttttttatagacaaatgttagtgtattagaatgtcagttttattagtagagtggataaaattcataacatttttttttatcttttcttctttcttaaccatcaaactcaccttatatcccctctcaactctattttcacatagacataaaattggtataacaaaaatagaattggttcatagaaaacattattgcacacttgcacctacctatcaatggaaaaattggcagcaaataaaggaatagcaataccatgacactcgtctttatcaccatctcgtaatggtttcgtattcttcactccttcaacttacattaaccccttcgtaatcgagttctctattggctgctgcatgtttatttatttatttattccgatacaataagatgattgatatgtaagtaggctatatttgttttgtgcacttgtaacctcaatatgcgattagcaatgcatgaaagaaagggttgaatatttatgtaatttgtcatgggcatgaacctggaccaagctaaagatgtttccgtgatgaaattatatttataatttcatacccctcagtttaatggatcctctctcatgtgaaaatcttcaccattaactgaataattaaaatgacataactaaaatttatttgatacgaaattaaaaaataataatactaagcaatatttttttgctgaatataatactaagtaattacaattacataaaactaaaatttgggaatttaatattgtaacataaaattttaataaattaacttagattttttagggaaaaaatactgcagaagaaaagtttgttaaaaaaaactattacaaaaacagacgtgttcaaaatgagaattttgaatttgtaatataagaatttttttaatttgtaatataagaatgaatatgttgataaatgaaaattgtgtgattccttgtcactatcaagcgtgagtgattctctacattggctttcttaaggctcaagccaaagcagtgatgataaacggtaacagcttccacattgcatttcacaatgcaaattgtgagcacctttttcttttctattatcagtcgtgaatgattttattttattttattgtttttcaccttcctagttcctacttatcaattactgaattgagttgtgaatccgttgtcaaaacaaagttgaagactcccattagatttttttcttttaattttgatgacgagttagcaatagcatccattatctggacgtctctctctctccagaaaaaaaaatttccttaattttttccttatgataaataaacaaaacctaattctcatcattgacaataaaaagtttcttatgatacttgaaatgattttatcatccttaataatgatgataattatatatttatcacatttaaaactatataaaaaaacatgcagtagatgtacaatttgctaatcatattaaaattacaagtttagataaatataattttactgaattttatcaacacagttgaacttgttaatcgatgaatcttaacataaaatgtcatcccgaattccattgatcctattcgatacaagttcagctatattcatctaacttactatttttgccgcccgtactatgatattatctatcatagccaggtactattgttacattaacaacaacgataaattatagttagcatgtattagatgttcttatatatatatataagaatgtgtaagaagatgttctgagctctcataatatggaagaagattaaatggcatcataatcccattcgcacacgtatttagttcttattactaccaacgaaacatcaaaatttcacaacccaaacactgcctcagaaagacatgtacaagcatgcaaccagccaatgcatgaccaaaaatgtttgcctaaaatttgttggaatataaaatgctaagatttaaataaacgctactttcagaaaaataattagaacatttttccttcaagaacaagggcattgaagataaaatgcagataccctctttaaatgcacaccagcacaacctgcaaaactctcccttttctaagcactgggaagtagatgcctcctagattcagttatactttaatcctcatttcgactttcatccttgacaagcttgatcatgtcatcaattcgaaggatagtaatagcagcttcagtagcaaactgggaaaaaaatacaacttatcagacagctgtataagaagaagctgtatcttgaagtcaagaactgttgatatttaactcaatacatacctgaataatttttactttgctcattgcaggctcaatgactccggcctccaagttgtttctaattttcccttccgaaaggtccaaacccatactggggggaaaaagagcaaaataataacaataattagcgagatagaaaagaatgccaaagtttatcaagcatcatttcatatgtattctccattgttacttttctctaatattcattaacgtattcacatgttggaataatacctgaatctacatattatgggcagatgcacaaacttattttacctgccaaattcaacatatcctgccctatatttctccttgcacacaacacccaaataaccaaaaatatggcacatgatattgcaaaatcacgtgagtagcttcatgtcaaatggttacgaagttctgagtgagtgtgtgcataataatcatatacgatgaattaccattccaacacaggttggaagaaatactaatgtttaaaatataatggcacaacaaagataaattcaacaaacagacccgaagctaggaagaagataaatacaaaggaaacaatatagttactattactagtaagcaaataccttgataaatgtttcttatcggctttagtttgtgctgaatggtggtaggcccgtaatttcgcgaccagctcagtggcatccttagcagcattaacagaaagcacctgcaccagttaagtgacaccaacatatacattgtcagtgcttaaatgtttggaaataagaaccaatcaattaaaagtgtctcaaaagagtgaaaagaccaaatatttaaatttaaatataaagtcaaaaagtaaattgtttaccacactaaccccacatgaaagtacactagactaaaattacagaatttaattattggacgggagatgaagacaaaactcaaactttacaccatgtgttcaactaggcccaaccaccctagttatttgtaaaataagcagaagacccaaaccttaagccattaatttagcttgtaacttaccttaggaatgattaacagagactcagcaaattctgctatagccaactgctcccgagatcctaacgttgtagcaaggtactccaaataaactgataatgctgcttcaacagcacctccaccagctaccacctgaattttatatattaaaaaaacaagcacaaggaaggcaaaataaaaagacatcatttgaaaaacttaatctaaagcaacattttgatttcaaccaaagtaggattaaagctacgtatgcaggataccatatttgattcaagagttctcttgacaatggacaatgcatcatgcagagctctatccatctcatcaagcatatggtcatttgcacctcttagaatcaaagtgacctacagaagaacaacacagaatcaggtgataccgcaagctatccacaatgtgcaccagataataaataataaactatcagtgtccccccgtacgagcatgcgtgtgtgagaagatgatgagtaaaaaatatcatatttcttaaaaaaatatttataaatataattttaatagatatccaaaactccttgtgcttttctgtctacaaataatctacaagttaataaaaaacttactgcacttgtagttttggtccctttgatcataactacagcatcatcagaaattcgctcctcaacaacctcatcagcagatccaagaaaagatggttcaaatgtttcctccccttccatatcagcaaatgttgagacctgtgtcaaagtaaaaatcaagtccaataataaacaaggaaatagtattcaaaacttctatccaaaaaagaggatactatacaagagactgatgttgcttgacaaaaaatataaactgagatattgttaacacagaagtttggcattaatttcaaggaaagtcaataactattaggggaaggataaaaatgcaaattgaaatgaatagaatcgaggataatgattacttctctggttttggcattttattaactacaaattcatccctcgtggttgctaattaagacacgaagctcttcttttttgtgccagaaggtatttaattacaaaagagaaaccaaaatacgattaataaaatgccctagcaaccactatttaagtaatgatcaggcatatataaaagagaaccatcttaaaacatcaagaaacttaaaatgcaatgaaattagaaaaaccattttactgccagaatgattaaaagatacagcccaaaatgaaaataaatcccttcaccaatagagacccccgggtaagacaaagattaatttagttcaatttaaatttgacattaacatcaacatcaacatcaacagcacctttaacccaaattaattggggtcggtggtagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaattatggaggataagaataaaagaaaatataaaagattagaaactagagttaacatttaaaaaatgttatttcaagtagctttttaaaaagtgtgaaaagctactaaaaaaatttattttccgaataggcaaaaaaattcaattaataaaaaaattaaaaactaactataatattttaccaatcataaccttagtcttttttctcttttttaattctataatttttagtcttcataaatgtttttaattccatgttaatatattttgacaattttaaattatttttataaaataataatagtagatgatttgttaattatgctttactaatttcttttactaaatataacttaataattacttttaaatatatattaaatattgaatgtagtacattttaatttaaagtaaatttatattgttaatgtgatattttttnnnnnnnnnntcttgggtacctcttgcccaagcagatgcactgtgtcttgctcaccatctttaatcctcgaaaactcacacttcatatactccgtcttgctcctacttaccttgaatcctttagactccaaagtgcttctccacaattccaattttctattaacgtcatctttggtctcatcaataagtactacatcatctgcaaagagcatgcaccacggcacttcttcttgaatatgacattaacaatgttcatatttcagaatgcaaaagggtttcttgggatggcaagcttttaaaaatctaagattttaagcaggaaatattcagagtcatcaattgttagaatgcattgaatcagtcgcattcccaccaacccataaaaatagcaacaattttttgttcaactagtaaaaaggagttaaaaaaagaaggaatggagccctatctaatcaacactttattatgacaaatattcagctttactgtcaacttgctaacattgcaatttaaatttataaaaagaaaaaaggaaaaaaaaggctaccaatgttgcaccagtagccttggcaacatggcgcatgtcctctttccgcacacgtcttacagcaattgccccagcctcaacaaagtactgaaacaagaataaatggtcagaacaaaatgcataaattcatgactttatatgtcattcatcagtaaaagaacatgtatcttgaacagagaaccacaaaatccatcaatgcaaaaggaagaaaaccagaagtcatgtttaaagatccataggcacatatgtcaaaaatttggtgtattttcatcattctgaagttagtaaggtcaggcatttattccctaaaaatggaccttggtaactgaattcacacaagccacaagggttataacttcaaccttttgtaccatttggtcctcagttttaactatagtccaatacaagtaatgataccgcaatcaaaaaaaatgtatagtgaatgaaaagaaaattttaagtaaaaatcctatcttctgtcatgtcatgagttcctgggtgtaatgcctcatccgctaaaagtattaaaaactcccccatcaaacccctaatactcagcttgaatttcccctaaatcgataaattccatcaaacaccaaactccaatctaagatgtgaacttcacacacccaaacagccaccaaacaacccttgtaattgatcaggatgagtaatttatacaagggttaaaacatgacatgctcaactgtcaacagatatatattatcatataatacaaaaagataaagtcaaacactttctttgacagcctaaatgtaagattataactaaatcctcttgctcgaagaaatatatcgaagaaacataccttaagagccatgtcatcaattcctttagttgtcagaataacattagctccagccttcagcagttttccaatgcgttctttagtcatatcggcctctctgcaattagaaaaaaaaggccattagtcaaaatgtattatagatattactttatcttgcaagacgtatggatggagaattgtcccaaacaaagcaaaagcaaattcccacaatgaaacttaacataagctggcttacacaattagaacaatagtctttataagaactacacaaatcaataactaaccataatattttgagtatttagcttaacagggctttggattgatttcatgcctatcatccaagttttctatttatgcctattttatacagctcttagaatgtgggtttgggcctaactcaaccccaaaagctagctaatggggaaaggttgccccccacttatatattctgtctttgtcttatttctagccaatgagggacttgggtttttcccaataacagcttattttcaataagataatagatttattctcattatatttaaggaaaatgaatccacaaaagttgggtatcatagtaatatagaacccatataatcatactgacagtacctttgacgaattttctctagttccctaggatcagtaactaaaacttgaacacccaactgcatttttgtcttctgaagattgaaatcaagacaggcaattcttgcaggggcgaccctaagaggcattccttgagcagcacggccagtatttagagcataaccattcatcaaaaagctgtctctagcactttttccatgagctttcaagatattgattccctgaagcatgaggcacaaaagaagcaagaaattaaatcaattcaaatcctatgaacattaaagcaagtaagaagcaagattaaaatatatactacagatgttcttattgcgcaaattggcatctttcatccaggaaaagaactgaaatcacaggaattctactaccaaccttgattgggtatttaacttcacctcgagcattggtcatctttacagcttgcactgcgtctacaacctgtgtaaattgcacacataagtcaattattagtgactacctatacctacagtctacactctacagaccaaaaaaaaactgtcccaaaatagcagttatagcatctttttcgcaactaatccataacttcagaaaataacccttcataatgaaaaacagaggtttcaaaaatcacttagaccatatcccaaaaattcaatttattgattataaaaagtctcctagtaccgacaacaaagttttatttcagtttcgtgtgacagcacacatacttccaaaccaaatatggtcaacaataaacaattttacacatttaaaacacagtagaaacagatgaaatcaagaaatatttgaactcctttcctctaaagcagaaagaaagtgtcaaatctagtaaggttaggagattttttattttacaaaaatcaggattcaaatgagatgaggattgaaaagaatatagctttatcaatatcaagttttcaattactaatccaactaaatattgatacaagaaacagaaaatgcatataaacttcagtcgattggatatgcgctagaatttgcagaagcagcagaacatggtgtgcatcaatcatgtgatataaactctcaacattctatataaagccaatgcaattacaaacataccaaactggcaaagaagtcactatcaccagctatcaactttgaggacatactggtcttggcacagttaattagtgaatcctttcccagcttttcaacctaaaagtcaagagaaaaatccaactgagtaacacatgatatacaacaatttattaatatttagacataacataacaatggtcatatggtccaaagtaggtttttcaaaatataaaacagggaaccaataaccaagagatgcaagctttcgtcctcagtcctcacatcccaaacttcttttgcattagttaatgattgtatcattgatgcaaggaagacatgaacaataagcatacatattgataagtagtgtgatattattgggcaatgggcatatttaaggaaatctaatcataagaactcataatgagtggaatacagcatacaatgactctacacatccatgactgcaaaaaatgtgaaagaacaatcattatggaactaacatcattggcattcaaatattctaacaatgatatctatcgacaatcaaaggaggagagaagagaccagagaagaaaaggttcgggccactgataacttaagcttaaaaaatatgcatacaaaataaaaaagtttattaaggagatcttaccttgacagctagtttttcttctacatatttacaagcctctcgcatagcaagctataaagaataatcaacataaagagaagttagttaaaccatgcaaattcgcaattcaaatagcagaacagaaaaattcataatggtagctacaaagattaaatatagcaatagacaattaattaagtttaagaaattattaaaagacacttactctatatccactgataatcgaggtaggatgaatcttgttcctgacaaggtcatttgccctctgcagaaaagaacactcgcactcgttagttagttagttacatctgagacaaacacaaaaacaaagtgccaaccaaatagagagcgatgcggttactttgagaagctcagcagcgacaatgacgaccgaagtagtgccgtctccgacttctcggtcctgaagctcggcgagttccaccaaaacctaaaaagcaacacatgtgagtaataaaaagcaatggaacgagaaaacagagaaagcgaagagcgagtggagtgtggttcaccttagcagcaggatgctccacttcaagcatcttgagaatcgtggcgccgtcgttggtgatagtgacgtcgccaatgtcgtcgacgagcatctgaaacgaatcgcatcagacattgcttacttcgtctaagatctaactatgtatagagagagaaagagaaagagagagagtgagagtaccttgtcgaggccaacggggcctaaagagcttttgacgatgttggcaacggcttggcatgccacaactgcattcacagagattgaacgatgttagaaatggttgttacgtttttcattgtgaaaaaaaaggagagagagacggtaccgttttgggtgcgaacgtcttggccggactgtctatcgccggcgatgtcaggggtttgcgcaacaaccgccattgcgaagtgtgtagtagtctagggcttcagtcgcagagggttttggttttttcaacttcgcccttcctttacttttctttttatgctaagctatgctttcttttccctcctccctctttatttctttctttttcactttcaactccaagtgcattttttatttaattatgaaaaattaacaataataattatattttaaaatgagtttatgtagattttatcagaaaatttataataatttacagatctcaaacaactaaattagaccctcttaatgtttatcttatttatttattcttttttaacatgtaataataatttttacattcgattaaaaaataaaattgcataatatattattaatatatcttgagagtaagaaatttaatgtataatgattttttttaaataaggataatgatttgataggttatgatttaaaaatatatatatttaatttttctatttatatataattttttttaaaccaacattctgttatatacttttggacatgattttcactcaatttctcttattttacaatattaaattcttaaatttacataacaaatcaagtgacaaaaattaagtttgttttttatatattatgtaatttgtataacacggattttttatacattttttgttttgtttctattttataagatattttatactaataatttatgttcgataaaattagttaaaaaattaactgaaaattataaagttagttcaaaaattaattggtagttgaaaaattaatttattaatttataagtgttagtaaaattagttgttgaagtagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatctatgttatataattaaagtagtatgattttaaagtaggtaaatatttttaattctatatattttaaaaattattatacatttatctggagttataaggtggattggatcattaaagaaggaggaaagcgagtaaagataactgagtttgatttcctgcttgcaaaattaacagttctacttctaacaactaatattttttttttcgaaaaaattattatttatttttatattaaaatgtgcatgaacctaaatgaaaaatatgctcttgatccttttgttttatttcttacttcgtactattattttggtagaatgactcacaacattcttatgattatgtttaaatattgaaactaaatgttatggaaacgacaaatattcttctatagnnnnnnnnnntaaaaattatggaggataagaataaaagaaaatataaaagattagaaactagagttaacatttaaaaaatgttatttcaagtagctttttaaaaagtgtgaaaagctactaaaaaaatttattttccgaataggcaaaaaaattcaattaataaaaaaattaaaaactaactataatattttaccaatcataaccttagtcttttttctcttttttaattctataatttttagtcttcataaatgtttttaattccatgttaatatattttgacaattttaaattatttttataaaataataatagtagatgatttgttaattatgctttactaatttcttttactaaatataacttaataattacttttaaatatatattaaatattgaatgtagtacattttaatttaaagtaaatttatattgttaatgtgatatttttttaacttgtttttacttccaaacaatattgatattaataatcagagcttaatggtatgcataatgcattgtaactttttacatcgtgaatcaaccaaaaatattgttaaaataacttttaaaataattgtatcacataaaagtcaacaaattcagaatactattatgatttatagataaacaatagtacagtataaaatattgtgtcctatcattaagtaacttatttcctcaaataatggtctggtttagctttgggtgagccaaggctcgtggatctacttttgagctaaaagatggtgattcttaacgttgatccaaaataagactagaattgaagtattttcaaaagcatttcaacactcattatgtgtttggtagtgttaaaaaaataaaaaaaactaatgaaataaaattaaggaaaaatatttaaattaaaataatatattagaggtgtgagactcgcactaaattttgaaataagatatttttgtaaaataaatttgtgcaattctgtttcttctcagttatatatataaaactgattttatctatgttatataattaaagtagtatgattttaaagtaggtaaatatttttaattctatatattttaaaaattattatacatttatctggagttataaggtggattggatcattaaagaaggaggaaagcgagtaaagataactgagtttgatttcctgcttgcaaaattaacagttctacttctaacaactaatattttttttttcgaaaaaattattatttatttttatattaaaatgtgcatgaacctaaatgaaaaatatgctcttgatccttttgttttatttcttacttcgtactattattttggtagaatgactcacaacattcttatgattatgtttaaatattgaaactaaatgttatggaaacgacaaatattcttctatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacccacctaacctgccaactgcgaagcacaagatctttaaggatatataagtaatgcaagttatctcatacaatgattgacatatatcgctattcccctttctctagtaaagagacattatcaagatgttctaatatgtcaataccacattatcaaaatgttctaatacgtctttctttaatttttttcctattaagattaactgcaaaaacattactggttctctttaacctcaagcacattccaaataacttagttccaaatacacacattagtacaaacttttagtcccaaaccttcaaacacaacaaaccataaaataatacaatccaagctattttttatcgagtttcttgcaataaactaaagaaagacaaataaacatttatttttcacattcaacaggaattcttacacgcacgaaagaaaatatctaagaaaaatactcattagaggcagcaaagatggattgcaatcgctgatacacctcgttgtttgtccactccaacacatcccaccactcttgctgccctttaatggactttaagttgactgcattttcactgtctagtggtaaagttttcaaattaggacagttatgtatccttaacagctccaaagaggaccaagccaatgtatgagttgagcatatagttttgaagttaggcaagttaaccagcagaagtatttctagttttggaagcacatccctttctctttcaatgttttctccgataagtacttcaatttttgaacaatcttcaagttttagattttgaagttctgaaaaatgttgaattgctccattgctgaaaatgtcactgagtgatggacaattattcaatgacaaaatttgtaatttggaaaaggttccactgtgcaagggacctctaaaaacacgtcttaaattgagcaaattttccaaatataattgctccaaatttggtaagatgactcttgtttctatttggattccattcatggtgttgctacttgtatcggctgacacaattgttaaaactttgttacatcttgtaatcaaaagaccacgaatgcgttccaaacacactatgccagcaaaatttgtcaatttttttatatctttatggcaaactaattcaaatgcatcagtttttggtagtacctcaataattgccaagtcatccttctgtccaccattgcagtacctcaaataattagtaattttatactcaaaagattcaagtatttgaggtcgccttgtgttttggcatcccacaaagaatttaaatgaatttagctgcttacaactccatgatttacttcttgaaagaaattctccaagaatgattgaggagggaaaacaacatatgagatgtgctacattttccagagaagccacatgttgtaaaacaaattcagcatcatcgcaccattgttcataggatatgacttgaatggttaattcttccaacctatgcagctttgaaatcacatgaacattttgagcttcattatcttcacttgcaatgaatgggattcgcaggcatcttagattagtcaaacatccaatttgtagaggtatgaatgttactttagtatctcgtatgtcaaggacctctagaaattgaagtgatccaatttcagatgataatgattccaagagctcgcaattgttcaagaataaactccgcagacaagtcaattttgataaagacgatggcagttgtgtaatcatgctattatacaagtctaacagaagtagactgctcatgttctcaaaaaaagttcgtggtattgtagttagttttggattttttctcagcaacaatgtcaaaatcatgctgcaatcttggcttgttggaaaatcaagcagttgtctcatagagacccacctagccttctgccaagctcttgaatttgagagattttcagattctccaccatcttggaggtaaaagctacattcaggatctttagaggatatgtgtaatgcaagttgtctcatacaatgattcatgttgacatatatcattgattcccctttctctagtaaagagacattagcaagatgttctaatatgtcaataccacaattgcgtgcactttgatatgaccttttgtcatttatatcaccgagtaaaccttgtgctgcccaacactccactaaataatcagtgtaaaccttgctatttgcaggatacagtgaagtgtataaaaaacatttctgcttttttttatctttgagttcatcataacagaatttcaggcatgagtacaactcttctaaaccttgattttcaagttctggccaaggcttaagatcttcaagtcccaccgaccaacttgaagcagactctttcaatttaaaagaatttgctatattgtaaatgagaagtggaagacgagagcaccttttgcatacaagtttggctataggttgaatgtcaagggaatcaatattaggattaaaggtatgaacagtatctctgaacatcttccatgcttcctcaggagataactccatgactttgatgaccctctgcaccttattcaacttataaactcgagggagtcgagtggcaattaccaccttactgccattgttgacatcactaggaattcccaactgctccaaattgatggcatcctcaacctcatccaaaatcaataaatacttcttcttttctagctctttgtgtattcttcttgcaacatcatcgctatgctccttgtcggtttctatgtccagcatcaaccgatcaacaattttctcttgaagcttatgatcatcagctgtggctttcacaaaaatgacaatttcaaacagtttagcaacctcttcattgttgttgaggttctgcattattgttgttttccccaccccttttgttccacacactccaacgactttaatcttattattttttagcaaacccagcatgttttccaaggcaccttgaagggttggatatccacttatctgtgggacatttaactcctttaagacaggctctggtggtttatcaacaagaaaatctcttaaacattcatccttcttaagttcacgaacacagttgcacttcttctccatctcttcactcagatgtgaacgtcgttgaatacgccaccagggtagcattttctcttcgtatttagctttcagcttctgcacttcttctgcagcatctgataccctgtttgtccacagtttgtaagcattagtggtatctctgtggttgtttctttgaacctccctctctttatccttctttattgcaagtagcatctccatctctttgagcagaatgttgtagttgtcatcaaggtttctggaagacgcaattttagatgcaattgtagtatgtaattctccaaccccatgcgctcctacctctccaacaagaggggctacaacctcaagcccagacattatgaaacttcaaagcctacaatacgttaacaaagaaaataaaatgaaaggttatattcatataatacaccaaatcaacgtatagaaattctagacatcagcggtatagaattttgaagcatacacaaacataggcgctttattcaatatgaatatgtatgtaacacccaaagccaaaacttcagtatgtaaaaactaatgattcaaccttttagtaacacacttgatcattatttatcttttctgtttgacagtaaaaacattttaaatatagacaattacaataaattcttaaattctaaagcaatgattacgaaacacaaaacacaaaaagaattgtatatgtgtgggtgtatagtatatataaaccttgagactagaagtagcaccatttaaaagtagtaacttattgaaactcggacggatccaggaatgcatagggatcggggggggagggggggggggggnttctaataaataattatgtaataaataaaaaagtttcacagaagtatttattattaattttatgcgtaaaactagaaataaaatatacttctagaaaaaaaatcaaacaaacatgaactcaatactcgatttttttattcattttttattaagaatattttctttttcttgtttctcaatccgtccctattgaaactgatatacaaaatgattggaatgtatgtgagggggaatcaggagcaagagttaagtaagaaagattcatgtgtacctctgctgctaactgttaagaattgagatccatctgaagggtgagtgaggaatcagaagaaacagctaagaaagattcatgcatatctacctctgccagcagctcttgtgcacagattctgcaaaatgatgggtaagtcaacgcatgagcagctccaaattgagtctctggtgtccttgttcaatactagtggaggacaggcaccaaccagaataaatactactgattaagatacatttgattattctaggtctgtttaatctataacatctacatttttaaaaaatatacttttgactacaaaattaaaaagaatatttataaatatattcttcatatcattttacatttattattagttaattcaataaatacttttatctaacgtttctaattaaatgatctactttaacaactttgatttcaaataatttgtcatctttaagccattttttttttaccaaatataatatatctgtttgataagtcatttcaaataattaagaacttatttaatttataagtttgttctaccttaattactttcaagttttagtttaaaaaatcacttttaagtattgcgttaacttagaattttttttgtcagatatagtttcaaagctattgaatatgaaatatttagtaaaattatctaataaactaattattccatatatatgttatcagcgtgtgtataattaaaaatgtaatagatttagatagatacggattatttagtattattaggtataccatattttataaaaaaattaaaagagaaaaaattaaatatacaaatataatttgttgaaaatacgagttttattaattaggaaggagtaaaataaaatcatttttggaaattagcaagacaaaataaaaagacaacaatcataaaacttttgtgttataagttatatatttggaaattattgtattttagagaaagatgaaaacaaaaatagaagacaataaattaattattccttaattagttgaaagtgatatacagaatcaaactacataagacttaaagagtggtcagaattgagatccatttcaaggatgaatgaggaatcagaagcaatagttgagaaagatttatgactatgactgtgtgcctctgcgagtgcgagcaaccgtagccgacagatcttcttcatcctcattttgcaaaatgatcgatcaagtgtttgattatcgcttgctctgtttgtttcacaatggattcaagtcaacgcgtttatcacttcggtgtgtggtgtcggctcgataccatccttataatactaatataggaaaaaaagtaaagataaatgctattgcctattgatgattttttaaaggcaaatagtattgattatattaaattaaaaaatatgtatacaattacttttacattttaattcaatataatttttatcatattattaatacgaatatctattaattttatttataactaatcttcataaaaaaaatctaactaatcacatctttacaagattcaaaatgaagattttgtttaccagtcaaactaaagagacttcatcaaatacatttgattatatacgtgaaatatatgattaaaataaatatatttaaaaaagatgaatttattttattatttaatgtgttcaaataaaattgatcttttgtttatactgtgtttaaataaaaattataattttgtttttcaataaattgatctgtataaaaatacatctttttatattttaatttatcagtcagttaataacgaattttacgaagggtctattgccattatcaactgaaaaagttaactttttttttttttaatgaaaggggctaaaaccccaaggaaaaaacactaaaagccactaggaaagatcatggaaatagcataggctaaaatattaacatgtgaccctccgtagtattgacataatttcattaatttgctagcaaatccacaacttgattggcctcgtgtaaggtatgagaaccggaccaactgaaaagctaacaaataaatgaaaattaagcgagagttgaatatagtgtttgacaagtaattacaagtaactagttatattcctcatgaaaattcctttcatctaaaacatagagtaacagaatcacagagagtcagagacagtattgattcttacgatattcttttagtaattttttttttataaaaaaagaccaagacatgtaatgatattgcaaaacgattattatctaaagaatatttgtttctattttgctaaatcaaacattaagtgaaaacgaagatgtttacagccaaggctaaggcatataaataactctgtttaacaattagcaatagcatgtactcgaatataaacataatccaaaagaaatttactactaagattgtaatatatgaaccagaaaggttgtaattgcatccttctctttcctaacccatgcgatatttaattaattctgatctaatatctgttaccacatcctctgcctcatggagtagggcttcaagctctacgacctttcttttattttttgatgaggtctctgcttcggttttctattgataagacagcagtcattgccattttttgaaacaagaacacgacagaggaaaattttaaagatggaacattcacatgaaatatgaaaaacaaaacaaaataaacgcacacaaagtgaatgcataatttaatatgtatgcatctaactagcaagtaaataacttattctgttagaactgggagaaagtgagaagattcaagaaagaaatcaagaacagaaatatctaattagtaatatcctcaccggacaacataacacaaatactagaagagacgagtacgtttagtgataatggaatggcatgtacgttcctattaccttgtgtcgcaaatttatatctactcgaaacaaacgaaaaggaaacgaaaaacaatctatgttgtttcttttttctttttatgccttatctgatttgatttgtttcgcatgcatgtgttatatactttgattatttacgttatatttatattgaattgaatcgaattgtaatttttattttatatttgtttcaaataattttttatctaaaaattgaatcaaacttcactgcaaacactcctatccggctctttgcatgatgcagaccccaacgacaacattgcttatagagttatagtttcgttactaacttggtattatcctttggtaactagttttttttatctttgcatcaacggagcttttaatgttgagtgaggattataaaagttattatatttaatttatatcttttgaaaatgattttttataaatgaatatattcgatagagttttaacaaaaatctttagaattattcatatttctataaacatttaactatttaattcactgtctttaatagagcaaattttgtttcttttttttagttaaaaattataatttcttaattaaattatttttatcacatataaaaatatgacttttgttatcttttagcagcaataagacaatacaattttaactaattatataaaaaatattattttatatcatataagaaataatagtattagtttttaattttaaatcatgttttacaatttattttaagtaatctgtattttacaacaaaatttagtctaaaaataaattcaaatttgctaggcccggtccgattttgaaaaagaaaaaaaaggaatgacaaataaaacaaatgtaaaataaaggaataagaaaatgggattaaaaaatccaaacccatgcaacgtgaaagaaaaaagaaaaaagtgtcttctttacctttcaacatacaattttaaccctagtaaacttgactatttttatggaccgtttgcaaggagagaaattttttaatttttcaaaaaccataggataagaaacttgattttccatatttgatatacattttagaaaaataacctcgaaaaatgatatttcttgaaaatgttttttaatcaattttttatgaaattttttaatgatagagctgaaaatcttacttttttcaagtttaatttttgtctgttataaaaaaataccatattattttttattaaattataatgtaataataattaaaattattaataaaaatatgtataactttttaatttctaaaaatcttatataaaaattattaatgttgaatcaaataaattttatttattaccaaacagattcctaagaatcataatatccggaacctcaaataaccccgtaactaagaatgatgaatgtttcatcattccaactccagcatttcatttcatccacgttttgtttacggaacagcttgtgaatatcttcattttcattgatgtccatctcttgtcggacacctcctaaaccaactatttttctcctccatcgtagcacaatcttgtccaagattcgaactgcccaagtgcccatatagattgtaatggcccctcacatgagcctgcccaaataaattagaaataactaaggttgaatatcaaagcatgcaggtgcatgcgtagtgttctgatgtttgtgaatagctagaaaagatgctgataatttaagtttggatcaagctctttcttaaggtatttatatagaagaaatatcttcagaagtcgatcattatgtacaaagtgatatttaatcagtgaggtgaagtgtgtgaacagtgtcaataaaaataaaagagaacgagaatatgtatattttttcctctgcaagtatcccttgtttataatgtacttaattcatggttagttgtggatttcacttaaggtcaacagtccactatttttcattgtaccttatcactaaacacttttaaaattcgtaacagataacttgtctataatcaactgtttttttgtttataaaaaaatcaaatctctctatatatattcactttcagggtatctttaagtgctagctatatataaattaagaataatatcttttttttttatcagccaaaatgataatatattaagaataatatccatgtagcagtagctcttggaatttattttgttctagtcaaactatgaagttaacatctgttacctgttccttggctactttttgattttggcgcaatgcaaagaaatctttgcgacctccatatatcttccgaatcaataaagcgactggcacgaggctagtgtcttgcgcgacgaatagcggataactattactcgtatttgcccgctctgttatcattgcaaatttacataattgggtaatttttaaaatagatagtttttgaaaatattgtataatattaataattcgtgctttaaaataaaattttctaaaaattgtattttaatacacaactttaaaattataatttattttaaaaaatactaatgtcatgattcaaatacgacttcaatattttatatttttctaaaaacaaaatagtaaaattgtattttaaattactacttttaatattttatttttaaaaaatattaaaattgatatctaaaataaaactttactattttttaaaaaaaattataccattctaaaatcatgttttaaaatatgacttttttttataggaaattgtgttttaaaataagacttaatcatatgtataatattttcaaaatctattaatttttgtaattgtttttaaaaattaccccatgtaaatttgttgctatcatccctactcattaattagacttcgtatcaaatggaaataaacttttccaatctcctaatttgaaaataaataatgggcaaatatgaaatatgagtttcccaaaaataaaatatatgcaatataattatcttgttacctcctaacaaatgtggcgatattttttgcaaactaatattcccataaataaataaattgtgaaataagtattccctaatgttttgataatcttataagtttttattccttgtactttttgaagacttgaacttggttttttaaattttattttgtttatgattttaattatttttatttattttagatattaagtgatgatatgatatttattttattattattttaatttaaatataaatatattttttatatttgaattttttatagttcctacacattatatttgttttgttttttttatctttctgaaattttagataatatttttttatggttcaaaatattatttaaaatactttaaaaactaaaaataaaacaaatataaattataatgattaaaaaaaacaattgtacaagaataaaaagataaaaaaggataaattataagtaaaagaatggattcaaatttttagttattacgttttctgacggccaaaaacgaacagaaattgaacgaccgaaaattttaaaattatttcttttttccactttggccagagtcattttctctgctcctatcccctccgacagcggcctcttcacgcacaccgagttgagttaatgaagagaaagcggaagcggtggggatggctttgaagagagatgttcaatgccagggtcatcctcttcggtgacgtcgacgtcggcgaccaaacctccagatctggtttcactacattcaattccaatcacgtcattgtcctctgcggtggcaactgaaagtccccaaaaactgatcgagatgctgggaaaaacgaggaaagtttcggtgcgtggcaaatatgtgacagctaactacgcctttgcttcttacacgcatcaccaccaccaggggctaccctcccttgaacaagtttcagaagaagttcaccgagctctctgaggtgaacaaggaagacaacttttttttttgtgacgaaaaaaaaaaagttacagatgtcaagttttctggaacatgcaaatttcacacaggtttggattgccggccaaaaagtcacaatataaatttacgaggacgaataacagataaaattttataaagattaaaaatgaactttgagcattttgtatagacaaaaaacatattttaagtcaattaataatttctggttcttataatttcatattaatttatcatgaatacttttgatcccgccacccctctcttcaaacatccaaaaatctatttttttcactacattttgatggtaaaatcatttaacccaattttcccccacttgttttgccttgtaataggaggtattttttgtcttgttatgtaggcaacctttgatgatgacgatgattcaacaagagattacatgcattgtaacaatctttaattaacattcattggatactagcttgatgttttgtatgttccaagtttagtggattaccagtaacattttttggatgaaatgtatttataacttgaaggattgatcactagtctttttgttcaaacttgcctcatccccgctcttaaatgatcaaattctgttctttggtgcatgtatgtcttccttggtacgttatctcaattattgctgggttttcgtctaacctttgaacttgtttttttgctaggcacccttgtacagatccatatgcgcatttgtaatatcctctgcaatgcaaacgactagttttgtcaatttttcggcaaaactagaaaataacttctttttatgttcttaatataaagattaggctggcaaacttagtatggtacgaacatcaaataaaaatattaatagaaacccctcttgttttaagccttgataaggaagttggagaagaaacctacattctctttttagttgctgtgaatgttatagtatagtctatgtccaaaaacaaagaatgagatgttatctggagtttgtggttgttctcggttttaaattttcgtaaaggtagttgtcaaatgaacaagtttttgtcgagaatgtcaataacaagtttccaacagaaagcactaatttgggcccatttgaaaccagctgacatggtcctttagttaatttttcaaattgcaggtcattttgaaaacactgggggcatagaaccattaaaacaaggaaagagaactcattgtacatgcatattttattttccccattacgcttcattagctaattggctactgattttccagttaccaggcctaaggcctctggtattaactaaacgagaggggtgaaacttgtacgtcaataacctagagggagaggggtgaacctttctgtcacattctaatcaaatggcaattatataaacttatactacgaaaaaaattgctaattaaacttgtttaatttatcacaataaaaagttaaatgagaatagaggttttaactaaccttgaaaacttagctccaagaatactcttttgcccatattttatccaattatatccatcatctaaacaccatttcacattaacgcttagaatatctttaatattagatcttggagatagatcttaagtcgaagatctaacattttccaaattcagcaataaaaaactaaaaaaaatataaatctccaaaatcgagatcatggagatcaagatctccatgttgaaaatccagttcttcaggaaaaaatgtgtatatctgtacagattccaaacaaaaaattattcatcaacaacattaacaataaaacgcgggaggtaacagatccattagaatgaagtaaaaacacaacaaatataaatgaagaagaagaaaaacaaacaactcattggaaaaaaaaaaaacatatcaggtaaagggggcttgcatgtgtggaggaaaagggaggtgggggttgcacacgcagaggagaaggagaaggagaaggtggagccgcggcaaagaaggaagaagaggaagaagaaaaagtgaaatgaagagaggagagagggaggaggaaaaaagaagaaaagatagttttggaagttgaagaagtgaaaagaggagagagggaggagagaaaaaagtgaatagtgaaggaaaaaatggaaaaaaaaacaaaatatatttaaatatttaaaagtgaaattcatgtgcaattcattagaagttatttaagatttcaaaaaaatacctcttgagatatttttgactcaatactatccacatttgaaacatggattaaagatgattgtgtagaacttgaaattccctgaaaggaaaacattcaagtaataaaatacaaaaaatgaagctaagagggtatgatcataatagcaaaagcaattcatacagatatacaaaattactataattataactctagctcatatgacccatggttggagtttgatgagtagggagataaatatgaacagacttgtttatttaaatctccaaaattaagtatgatcataaagtgcaggaaaaaaaattgccacaatttttaaagcaccaagaagaattgttgtgaagttaattttgttttgacataaaaagatgctcattaagaaagagatatacaaaaataggaagatatcctacacatgaaaacttatcatagttattaatctcacatagaagtacatagctttaaacactatagcaggaagcacgatggtcattttttaaaatattataatgcaagctaaatagtttatactacatatatattaaaaataagaaagaaaaaaaatccaaaattaaagaaattcatgataaatattatttttaaaataatatattttaaaataatatataatgcaagcacgatggtcatttttttaaatattattttgggtggttcaggctctggattgggctccggattcgattcccggctagggttcaacatcaacaatatattttaaatattatttttatttttagtaatgcaaacttgcaagacaagtttttttattcaaacttgcctcatccccaatctcaatgatcaaattctgttctttggtgcatgtatgtcttcctcggtaggttatctcaaatgttgttgggttttcgtctaacctttgaacttgttttgttgctaggcacccttgtacatatctatgtgtgcatctgtaatatcctctgcaatgcaaaccactagctgtcaatttttcggcaaaactagaaaacaactttttatgttcttaatataaacattagactggcaaagttagtatggtacgaacatcaaataaaaatattaatagaaacccctcttgttttatgccttgataaggaagttggagaagaaacctacattctccttttagttgctataatgctatgaattttatagtatagtctatgtccaaaaataaagaatgagatgttatctggagtttgtggttgttctcggttttaaatttttgtaaaggtaattgtcaaatgaacaagtttttgttgagaatgtcaataataacaagtttccaacagaaagcactaatttgggcccatttaaaaccagctgacatggtccttcagataaattttcaaattgcaggtcattttaaaaaaactgggggcatagaaccattaaaacaaggaaagagaactcattatacatgcatattttattttccccattacgctccattagctaattggttactgattttccagttaccaggcctaaggcctctggtattaactaaacgagaggggtgaaccttgtatgtcaataacctagaggggtgaacctttctgtcccattcaaatcaaatgccatttatatgaacttatactacgaaaaaatttgctaattaaacttgattaatttataacaagaaaaagttaaatgaaaaagagcttttaactaaccttggaaacttagctccaaggatttccttttgcccatattttctccagctatatccatcatctaaacaaccttccgcattgacacttatcttttctgtccgaacttcagtttgaactgttcttagttcacgaaccttttaattgccatgccaaaatataaaaaccataatagtcttttattcaacatgttaggttcatgaaatttatttttgtttaactaaagactatagagacaccgcctacggacacatcttcacattggaactcagcaacagtatttgatctcgattcatgaataaaaccatcatcatcatttttcagttggggaagtagcttacattgtgttgaagctaaagattgatttgcaatatagagaatatctaccttctgaatcttttgtggtataattgatgcatagtcaaattagagaacaaacaatttcaagttgcaggcatataactccctacttatatgaccatgcatcatagcttcattggaatgagacatttccaaagtgatgttttccttttcttttctttttttcgtgacagcaatgaataacttaagttgctgataaagagagagactgagattagaatgacttccacgtcttaatcttgtattggtagattaaagaaagagttactttccttgggaaacgatgtaacaaaactcaatcgaacgattaaatatttaattattattattattatttaaaaaagaagaaagaaagggctatgtgtcggtcatgcaggggaagaaatggaaaacctgctaataatacatttactttttgtttttgccttttctttttgtttgtaaaaataaagaaagaaagaaaacatagtcatctgttgcgtaatataatttattttcaaaagctgaaactcctctctttattctttttttaattgtcaaaactcaaaaataaaaaagccatgaatgaaatactatgttcgtactgcatatagtttgttgaggtttctgctcctccttcattccattccttcacttttcatgcactattttcattgtgcaaaggtaaatataactcataactcagattactgaattaaagtttatgtttttttcattatttgtattaaactgagtgcactttagagaaggaatctaggcatagttttcagcatagatggtgaaggcacgaagtggctatgagttgacataaccaaaattatttgcctttggtttgatatgattattattcattttgaggtgtgggtggtgaaggcttcttgtaattgacacatgaaaggaacacaaagaggtaaaaaaaaaaaaccagggaattgaaaggaaatttcagtggccggtgtgacttgcctcagatctaggaaacctctcttatttcctttgctattttttcattttcaatgaccccattttcccttgtctccgtttttagagagggacaaggcatttaccttgtcaattatttggtgctgcttagtttcttgaataatctattgtctggtttttccggggatcgatcataaggaggaagaaatacaaggttttgggacctcttctcttggcttataaaaagtccaaaacaggtgaattcagaaaggatcttgtgggctgttttgtttgtttgttctagtctttgagaataataaaaataaccttagaattgaattttgttacactgtatttgactgtttccttaggaggttggttctaaactccttcaatttcttgccgtaggagccttcttggtgttttgatgttgattggaattatatcatagaaaggaggaggcttgagggaaaagggtggaaaaaaagtggttaaaagggacagcaacttattggatactggaggataagaagactattgctacaaggcaaagtaaaccaattgatacaatcctaagaccaagacaagtgaatgaagacttggaattacacatggaggcacttcctttggtgattaaagagccaatgacaagggctagggctcaaacactccaagatcacatacattctagcttgtatctcttggagaaccatgaagaaggctacaaaatgttgaacttatctgttgtaatcgattaccagtagcctgtaatctattaaatgcacttgtataaatgttagatttgtaaatagttctgtgataatcgattacaagtcctatgtaatcgattatatgatcatcggtagtgtagtttttgaacttagctctattataatcgattattccgtcttgtaatcgattacgtagaagtgtgagttcctgtgataatcgattattctgatgtgtaatcgattacctggttttgagagctcctgtgataatcgattacctggtgagataatcgattattttgttcatgctcaatttccaggactgatatgagcaatgtaatcgattgccaagagatagtaatcgattatttgattcaaaataatcgattaccattcgaaataatcgattattaccgtttcagctgcagaagcgccatttttagtttttaaacagctgtttggatagcttcccttggaagcaacatttgtatttcatttaggacacatttacatttcatttggctttaaattcgtggtctatataaaccacaacacaacagattgacttttggttgaatgaaattagattgcactttgtatgtgagaggttgagagttattctcccttgttcttagtgaaaaacttcttgtttcttatcaatagcttctgagctattgtggtgattcttgcaagacttattggaattcctattccatggtgtcaatccaaatcctcttctaatcttcttccattgatccatttctcaaatcacaaaacctaaaaacctgtaaaaaacagagcacttcatactctgttttattttccattgaagaattgattccattgcaaggaagattggggcaaacaggacttgaatcagtttaggagtccatcaccaatggaggaaatatcttctactgttgcagtaccttttacacttggtgttggaaatttgattcaaaaggagtctgcagtgacgactcacatggagataactgggctaaagctcatggcaaatacagcagcggctgctttgatgttaaatcctgcagtggagtgtttaaaggataatcaagttggagctgctcttgtctcagaaatggttattgaatgtgagagtaattgggtcttgagtgaacgccataaccaggcaagaaaggaagatgaattaatgctagcagtggattttcagtgtatgcacagttcaagctctcaatctgtggctaatgggaaaagtgatccttgtagggaggaagctgcgttgttgaagagtagtttttctgaaatagattcaccaatcatcatcaaggttgatgacgatgttgatggtaagtccagaataagcgatctgtgtccatcaatgaagccagtggaggacacagtttcttttgttatggatattactaatgaggatcaaagtggatctgatgagtctgatcctagaccatctgctgtgcttcttgatcagttgccaggggagaataaaacatggagaacaagcaacccgaatgctttgaaattgaatagtggccctctctggggttgttcatcaatttgtggaatgagacaggagatggaagatgctatttctgttaggcctcaaccttttcaagtttcttcacagatgctgattaatgaccatgtgaatgataatgaaaaacagtcactagcccacttttttgctgtctacgatggacatgggggccttcaggtatggcttaaaaatactctatcaaattacacaaattgtattgttgaaattagtgtttcactgatgaggtgttttgtttttgtaggttgccaattactgccaggaacgtcttcattcaacgttgattgaggagatagagactgcacaatcaagttcggctgaaacaaatcggagagatgattggcaggaccaatggaagaaagcattcatcaattgttttcaaaaaatggatgatgaggttggaggaattggtgcaagtaacagtggaaacaacagtcgtgggtctgagtctaatattgaaactgttgctcctgagactgctggctccactgcagtggttgccattttaagccaaacccacatcataattgcaaattgtggagattcaaggactgtcttataccgcggtaaagaagccatgccattgtcttctgaccacaaagtaaggcatttcattctaattttatagtatttttggtgaatttatattagaagctgaagatgtctgatagaggaaacttgacttcctgttttgcatccaaatagagaggatgagcgggctcggatagaagctgcgggaggaagagtcatacattggaaaggatattgacttcttggtgtcttggcgatgtcaaggtctataggtatgtgtttgttgcatgatctctagaatatgattggttttcttgcaatattatgtggttatatgaaactataatcaaatggtttagccgttattttttcagttctacatctctactacaatacaatattattaatcactagtttgtgctgaagttgaatgtgaggacatacattattcttctatgcaagtgttcttttacaagtaaacaacaatgtatgcaatttttacattgccatccaatcacaaaatgacatgtataataagtttatgaacttaacaatagccattttaaagttttgtcttacctatcatgattgtagaaattttgaaagtgctagtacatagagcataaactcttcttttattggtacactagtttggtgacccgtgcgaacgcacgggtccgcttcgctacgctccgctatatttttataaattaattataatttttatctttataataacaaaaaaaatatttatttataatattattgataaagtaatttaacttaattaactttaattttcttataactaataattaaactattattttacaataaatatagttactaagtattattacgatgattaacgtaataattgaattaaataaaaacgtttaaaaattttaaatattcatttaatttaaatgataaaacaaaaaatattttgttttaaatgtcaatttaattttactgttatttacacattttttatatgttgaaatattaaaaacaaataatagatttaataaaaataaataaggttgattgtttgatatgtaaatgtgttaaatacttttaataaaataacagtagaatgagaggaagtacattaaggcattattaaaaaatgcaaaaataatattcataaaggaacaaaaatttgatagagaccactgaatcaaaatagtttaatacatcaacatggacaatatttgacacttgaggagcaatctcttcagtccaataattatacttagacaaaaaagttaaagaagccaaggcatcaaccgctttgttacccattcttttggcgcacaacaaacttagtgagtcattttgctgcataatttagctattgaaagtcacatataatcacatcaaaataagtaagattatgtacatatctctttttccaagcctgtgaaacctttgacagtctgtcttataaataaataacataatgaaatccaaaaaagtagttatctcaatactccatctcagtgctagggttcaacttcccgaatattgtaagaatgtggaaggaaattagttgttgcagccaaaatttggcctacattatgcaaaggttgttccattgtcacattattggttaataaaaatatgattcacagataccaacttaccggtgaatgaatgaagttatgacatcataaatgagaaaaataatgaaggatttatataagattggtatttactatataggcagccccaatgatcataaaaacatgattggaatagtattctaaataataaataaagtatgaatctttataatattaaatcaagtttatttgacatgattggaatttatccgatcactgcccttgatagaggttcaaaacaaaaaataaatacacaaaaaataacatgaaatgcaaaagctaccgcctttatcacgcagaagttacatttgacacattccaaaacactgtggatttcaaaatttgagttagatccacttagcctaaatcagaatgtccataacaaaaggtcaatcaccgtaaaataatagtatttgtgatattattgatttggtttattaaaataattatctttgatggtattataacaaagaattaaactattatttaataataaaaatattaaatagatgttattatgttgctccgctacgctccgcatttttttaaaatgattttaattttatatatatgataaataaaataatagtatttgtgatattattgatttggtttattaaaataattaactttgatggtgttataacaaagaatcaaactattatttaataataaaaatattaaatagatgttattatgttgctccgctacgctccacattttttaaaaatgattttaattttatatatattataaataaaataatagtatttgtgatattattgatttagttcattaaaataattaactttgatggtgttataataaataatcaaactattatttaataataaatatattaaatagatatgttgctccggtacacttcgcatttttttaaaatgattttaatttgatatatatgataagtaaaataatagtatttgtgatattattaattggttcattaaaatgattaactttgatggtattataacaaagaatcaaattatctttactataataaatatattaaatagatattattatgttgctccgctatactctgcatctttttaaatgatttcaatttttatacacatgataagtaaaataataatatttattcgatttattgatttaggtgaaatgttagagagagaaaaaaaataccaacaatgttccttctctagatgaaataaatagcaagtataactcctaaagtggcaaatgaaaaattcccgtaagggttttttttttttacaaattaattttaatttttatctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaattaaatttggttatcctataacaaaaaatgaaactattattttttaataaatattttaactaaatgttattatgttaattaatgtaaaaaaattaaattcaataaaaagagtttaaatgaagcaattaggcacacattgactactttagcatgctgttaatttttcaagacatacattgaactgtaacgacaccgaaaagggagtcatctccacatcttttagttttgataattggtttagtattctttgaacccttgttaggctttttcttcaaaactttattctttgataaattattttcaaacaaatatattaactaaatagtattatatttttatagtaagaattgaaattaaaaaattaaaaattttaaaatcttgattaaatttaaataataaaactaacaataattttattttttttaaatgtcatcactttattttactgtcattcatccattatttaatatgttaaaaattttaaataaaataatgtatttaataaaaataaatattgttaactattgatatgtaactaaattaagtatttttaaaaaacattttccatttaacagttcacccatgatgacctagataacaattattttccgtaaatgatgattgtagtttctatcataaataaatgaaattaaaactaatttacattatgatataatgagtaattaatttaaattctttttgtaacaaaaattattttcactaactaatttacattatgtagtaagtttcttttattccacctccttcaataacgtttggagcaaaatgtgacttaagtaagcttccttcaatgtgatttcactctacaactttttttctacataaatttcttattcaaataatctttgttgtctaatttttcttcttgcccatcaggtgatagatacctgaaaccatggataattccagaacctgaagtcaatattgtgcgtcgagagaaaaatgatgagtgtcttattttagcaagtgatggtttatgggatgtaatgacaaatgaagaagcatgcgaggttgcaaagaagcgaatccttctttggcacaagaagtatggtgacaacgacacaacaggacgcagtgaaggagctgatcctgcagctcagtccgctgcagagtatctaactaagcttgccatccacaggggaagccaagataacatctctgtaattgtgatagacttaaaggctcaaagaaaaattaagagaaagccataaagtgatgtgttttatatctggcatatcttcatttgaagctattgatttattgtattttagagtcattggcactttttagcccgtcagtttttcaccagggctaagctaagttatatatgctaatatttgcactgtacaaggataccttcagcttggatgagttatcactgtctctgaaaactttccaagcataacaaaggttttttttttttttttttttttttttttttttttttttataaaaaaaatgttaagagccaatatgttgtgttagctaatcaattgataagctcattgtctcttacatacgcaccttggagccactcttaaattttattttattttggttacgtaatgagaaaaaacagaaaacgaaacaacgcagcaactgaagactacagatgcggatatggcattccctagggcatcacgtaacaaaatggttcccaagtcttaaatttgattagtaattgcaagcaatgaaaacccatcatcaatcaggaaatttgacaagctttaaccaaataaaaagtctcaaatataacttgaggaactgttcagttagcgtgactcaaaatgttcatttgggacagcttgacaaaacttttatttcatgaaaatttgtacatcagatcatattatcagcaactcaggcaaatccttgtgatacgttttgttgcaatcataaatttcaaacattttgttgcaaaagcagcccctgatacttaacttcagcattaaagttcttgcatatgtcaactattgcaatttcttgacccttgcatctgagtttatcaacaaattgaactcaaccactcaacaactaaatacagaatccttgaagtgactctaggagctggttcttcaactcatctgcaaacgcaacagaaatggaaaactacagttacaaataactccgattgtttagaaagaaggtactcagattatccagaaatattaatatctaaaactggatggttgcatgagagcacatcctatcatcgtaatttagaaaacaatacccttagtatcatttacagaaccaaaaacaatttcttaatatagaagaaaaaatacttctacttatgataaaatcaatacattatatagggatctacattcaagaacacctgatagattcgcaagtaaagaacaaacgaataaccttttacttaaattaataatagagtccaagattggaacatacaaacttttataaggttgcaagaggagaacctgcattcgagaagtaagctgaaagatccacctccaagtcatcatacatgttgacaaaaggatgtgcctggagtttcaatcaaatatatagcatcagaaagacaattttacatggtatgtgtacataagcaagatttacacataccattaattcctgagctgacagtcgatcctttgggtctttctgtagactaaacaagattgaaaaaaggaagatcagtagacacataaaaagcacacagtgaaatagagtttttggcaaaacaggcagcagaatagtgacggaaggtgctaatatttatacatgtttaaatggtttcttcgatgaaattatgaaagataccttaaaaataagaataaaaaatgaaaataatggtttgtggatgtaggtagggcaagtgcattacatttctattattgttttgtcaacataaacaatcagcaaatcaaagctcctcaagcatccactcactaatttcaggatgacctttaagaaactgctaccgttatgttagtgttctctgtgtgtgtgtgtgtgtgtgtgtgtgtggttgtgttttcattttcttatggtggattaagactcttgactgcacagaactagtatcacatataacaattaccatgctgagataaatgagcaaaattctgtagaaaattgttcagatggaggactaggaggaggtttatcgacaatagtttccataagctcaaaaatgctttcccatgtttcactttgatcaggcggtgcatatggaaaccgacccaaagcacactcgagtaatattagtcccaaactccatatatcacttttgtagttgtatcctcgctggcttccaatgattctctctggctataaaattggcagagtgaatgttactgtatattctaggcaacactggtaaattttggtggtaaaatgataaatatacttgcacatattactcacagacatatagttgtaggttccaatgaaagtatttgcttgaccagatgtactttccataattgtactcacaccaaagtcagtaatctttacttcaccaatatgatttattaacaaattagaaggttttaagtctctgtggataatatgcttttcgtggtggagataaactaaacccttcagcacctacatcattaaaaaagaaaaaagaaagagatcagatcttgtttgcgattcagtgaaaagaattatgggtactagactgaagggaaattccttactccatacctgcttacagatggcagcaagataatcctccggaattgttttaactttcttcagcagatcagctaaggaacctccatccatgtactctaagaggattgatatgacaccgttttcatagaatgattggtagcagacaacaacataaggacattgtgcttgttgagtaattttcagctcttgtgcaatctgcttgcgcatagactcctcaatattcatctgaattacctgaattgtgaagaatgcatacatagtgacaaatgaaaaaagaggaatagatttaaatgataacattaaggttgggaatatatcagaacaaaaggaaagtaattagtttattagttcaaatacaaatactaaactgttaaccaagcaagagggaaatttaaaattgttaaaagcaggagggaaaccaatatgggacatgttacccaatcatttctgctctattttcaaaaactagtaggaaaattaatagaaaatgaattgacaaaagactgaacatttcaataatgaagggggagggggggttgaagaccttagatgttaacacaagtttaaatttgtcttgttcaatgattgattaatatatacaagttcctatggaagagaaccattttcaatcagtatgttaaacacaattcaaatgttcgaagttgggtgaacaaaatgatgttctgttagggtataaggagatgggaagtttagaatattaatcagttagttagaggggataattagatataaataggggaggtcagatagcaggattcggggaataagttgtcatttgtaaatagagcattagttcttttggaaggggaaatccttggagtggagacccttggaggagagatttctttcctattcctggttcttttcatcctattcaataaaatctttctttcctttcccattcctaattcttggttcatatcatgttctgacataacaaagaaagaaagcaccagcagcataatagtaatgagctaaattactatttgaatgaaaatgaaccactcctaatgaaattaaatcattaaatgttgattgaaagaaataacattttatgaaacttactaataatgactttgggtgacactgaaattccaagagaaaacaagtttcaaacatccttgctcaatgaaatggatgtaatggagaggggaatgacattatcaaaaattatgtaatatgggtagacaatgccaatacaaaaggataaactaactaaaaatgagagaaaagaccatgcaaactcaaagcatggtatgcaacatgcagcaagtgtaccttcaacacaaaaaactgacgagtccatttgtgttgcaccaattgaactacccctccatttccctctccaacaactttgattacatctatatctgccaaagttaactggttgtctgtcggcttgatttgaggtggctgaaaaaataacatgaatgttagaatcatatacaacatattgtcagaattcagccagcaatgtattgtgtattgtgactagataaaaaaaatatgcatgaatttcaacattcaactcccccttgtcctgctctttttataccataagccactggttggaatgcacaactatagatatggggagtttaacaggaataaatttaaacttagtcacttataaatttgggtcctcatttaacatggctatgtatctactatcaactcattttgtcttctaaaatgtattgaccatataagagtatgcataggaagttttccaatataattagtcagattattttttattttttttcatgattgacagtgtaatacatcagaaattgatgaaagtgttgaaagcctccctgagtcccaccaaaaaaaaaaaaagacgtaggaaggaagaagaggatccaacattaactcagaatgcaaacaattttatgcaacaaacttcgtttaagagtagaaatgaaagactcaatttgtttagtggctcatgaagtggatgacgtatgcttagcacaatttcatttcataaacttgcaacttgttgtccatttgattaaagacaatgtaaataagataagaaatgcataacctcgttaacaatatcaggttcatttaaaatccaatagcaaaggctaggaaaagtgaaagtagggtcaataccgccgaaaacacacacacaagaaaaataatggccaaggagaaacagcaaataatccatctcataatttttttattcaatttaaatcatataatactccacttgggtatggtaacctgagaataaggaatctacagaaaaatcatgaatcccttgttatcttatctatcaggcatttcatcagatccaaaagatcaaatgcaaaaaaacaaacaatggagcaatcggactggacacataatgaaataaacaaattgttaacaaacaaacaattacaaaggcaaagaatgcataaaaaagtgagagaaatatgttaccgcttcgacatcattctgagagacaattcgaactccatccctgttgacaagcagatccccatccttaaaagtcccacacatcacaaagagagagagagagagagactcacaggaacttggcaaaattagattgatcggacacaggaactgagagtttgagaccaagccccaagattcctttcttcatgattaaattgcactaaaaatggagagaatccgtctgttagcactttcagacccctctaagattcacttctaactagggctgtggcaaccaaaaggccatggccagttaagtagttacctttagccttaaaaaatgtatacttttcgaaaaatatttattattaatttgaattattaggtgataaattttataatgacatatattactatttttattattaagactgtaattttaagattgtattaattgaacaattgaaaactttagatgaagatatggattgaaaatacttttaagttctactaagaattataattttgaaaatcttgatttattttcaaaataaagatattgcaagaaggatagacaaaaaaattcatatttcactaaaaacattatttatttaaaaaattgtatttttctttcaaatacatgcattgtttctaatattattaataatacttgtaaatattattattattattattaaaagtagttttttaaactaaaaatactcaaatcttttttaacatactaaaaatcttatttgatatactaaaatcttatttgatattgaaataatttgaatgattttgtcattttatatattgacaataaaatgctagaaatactttacactttctataaaactttgatcaataatttcgtaattgataaaaaaataaaataaagtatgacaaatattaaagaaaaatacagaagagtaagcaaattataatattgaaaatcttgatttatttttaaaataaagatattgcaagaagtatagaaaaagaaattcatatttcactaaaaatattgtatttttctttcaaatacatgcattatttctaatattattaataaactagtaattcttattattattgaaagtagtttttaaaactaaaattactcaaatcttttttatgttacatactaaaatcttatttgatattaactatgttacgaaataatttgaatgactttgtcattttatatattgacaataaaatgctagaaatactttatactttcttataaaactttgatcaatgatttcgtaattgataataaataaataaaaatttgacaaatattaaattaaatgttaaagaaaattatagaagagagcacaaaacagagagatgaaggatctttattagagagatgaacaatccaaggacagaacagtgaacagagcacggcagcaaaggtcgcggttggccagaaacagtgacaggttcgccagaaaatggccataaaggtcaggaatgaccggaaactatggagaatagaggctgcagaggttggggatggcaaaaaactcacagaagcccccaaaatgcagggaaatgccaaaaatgttgccagaaaagggtgtgcaggtgggaaaaggataacaatgtcataacagtgtgtgcaagtgattgagaaagcagagtttcggttgtgattcaaagaagggggcaaaatcattgcccactaaaacaccccaaataaagttgtttaatggttaaattaaaataggtttttttgtgacccactccaataaagcctgctccaggagcaatttcagctattttgctagatatggcagctgtgatggtcgctacttcaaactgatacacttttcaattttcatagcatgctctagcagctctggaatgcaattctgcgctagcaccactatttgttgctattggcaactagtcatataaaaactgaaaataattctttacgtgaaatatgttgaatacattcagcacattgatgatactgaatgaataaagcagtaactacttccctatctgaataattaaatgacaataatttcctttggtgtcaccatgtttagcatctaaatgttttaagttttcttaattaaatgagtttttcagcacttaaaattataatcttttcaagcaaaacacattcgacgtataattttacaggtttatcaaacatgcctttaatgtaagtaaaccaactcgtgcatataagaaaaccaaaagcaatgaatcacgaacggtgacaaggcatctcaaacctgctttattaccttttctgatgcatcttgaaatatttttggctcagtaacgactttccgcttttgggcttcaatatttgaactacccctacccacagatgaaacaggggctgaaggtgacaaaacaggtatttccaaagatgactttgctatcgactgtgtagaacttgaaattccctgaaaggaaaacattcaagtaataaaatacaaaaaatgaagctaagagggtatgatcatattagcaaaagcaattcatacagagatataaagttacagctgtcaagttttctggaacaagcaaatgtctcataggttttgattagaatgacagattaaatatgaactttgagcatttagtatagacaaaaaacataatttaagtcaactaataatttctcgttcttataattttatgttaatttatcatgaatacttttgatcccccacccccctcttcaaacatccaaaaatcaatttagtttcactacataaaatcatttaacccattttttccccacttttttgccttgtaatgggaggtattttgtattgttatgtaggcaacctttgatgatgaagatgattcaaccagagatacatgcattgtaacaatctttgattagcattcattggatactagcttgatgttttgtatgttccaagtttggtggattaccagtaacattttttggatgaaatgtatttatgatcatattaaataatgttatttactgatattttttttactgaaatgtagataacatcagcaatatattttaaatttgtctatttttatttttagtaatgcaaatttgcaagacaagtttttttataacttgcaagatttgaccactagtctttttgttcaaacttgcctcatccccactcttaatgatcaaattctgttctttggtgcatgtatgtcttccttggtaggttatctcaaatgttgctgggttttcgtctaacctttgaacttgttttcttgctgggcacccttgtacagatccatatgcgcatttgtaatatcctctgcaatgcaaacgactagttgtcaatttttcggcaaaactagaaaataacttctttttatgttcttaatataaacattagactggcaaagttagtatggtacgaacagcaaataaaaatattaatagaaacccctcttgttttaagccttgataaggaagttggagaagaaacctacattctctttttagttgctgtgaatgttatagtatagtctatgtccaaaaataaagaatcagatgttatctggagtttgtggttgttctcggttttaaatttttgcaaaggtagttgtcaaatgaacaagtttttgttgagaatgtcaaaaacaagtttccaacagaaagcactaatttgggcccatttgaaaccagctgacatggtcctttagataatttttcaaattgcaggtcattttaaaaacactgggggcatagaaccattaaaacaatgaaagagaacttattagctaattggctactgattttccagttaccaggtccaaggcctctggtattaactaaacgagaggggtgaaacttgtacgtcaataacctagaggggtgaacctttctgtcacattcaaatcaaatgttaattatataaatttatactaggaaaaaaattgctaattaaacttgtttaattttataacaagaaaaagttaaacgagaaaagaccgtttaactaaccttggaaacttagctccaagaggactcttttgcccatattttctccagctatatccatcatttaaatacccttccgcattgacacttatcttttctgtccaaacttcaggttctgtccaaacttcagtttgaactgttctttgttcacgaacctgttaattgccatgccaaaatataaaaaccacaatagtcttttattcaacatgttaggttcgtgaagtttatttttgtttaactaaagactatagagacgcctcctacggacacatcttcatagaggaactcagcaacagtatttgatctcgattcatgaataaaaccatcatcatcatttttcagttggggaagtagcttacattgtgttgaagctaaagattgatttgcaatatagagaatatctaccttctgaatcttttgtggtataattgatgcatagtcaaagtagagaacaaacaatttcaagttgcaggcgtataactccctacttatatgaccatgcatcataggttcataggattgacacatttccaaagtgatgttttcctttcctttttttctttttcgtgacagcaatgaacaaaataagttgctgataaagagtaagcaaattccactaaaaatggagagaatccgtctgttagcaccttcagacccctataagattcacttctaactagggctgtggcaaccacaaggccatggccatttaagtagttaccttaagcctaaaaaatttatactttttgaaaaatatttattattaatttgaattattaggtgataaattttataacgatatatattactatttttattattaagactgtaatttaatattgtattttaattgaacaattgaaaactttagatgaagatatgaattgaaaatacttttaagttctactaagaattataatactgaaaatattttctttatttttaaaataaagatattgcaagaagtcaacatcaatatcaacatcaacagcacctttaacccaaattaattggggtcggtggtagatgaacccaatgataaatcgaaaataaagcaaaagagagaaacagagttaaatataaaagaatggtgagaggagaagagaaaagaggaagaaaagaattaaaacaggaaacaactggaacatagaactactaaagggtttaaccctccatcagacttatagcttttctccactccgtcctaagacataccgtccgccaatctaaatcccactccattaggtcttgtttaactacctttccccaggtaagttttggtcgacctctacctctctttgtatctagctcttggtaacatactcttgttctaacaggagcatctaatggtcgtctcataacacgcccaaaccatctcaatctatgctctctcatcttttcacatactggtaccactgatacctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcatcttttctcgctactctaaatttttgcaaattctcctcattaggacatttatgcaagaagtatagaaaaaaaattcatatttcattaaaaatatcgtttagttaaaaatattgtatttttctttcaaatacatgcattgtttctaatattattaataaacctagtaattattattattattcttgaaagttgcttttcaaactaaaattactcaaatcttttttatgttacatactaaaatcttatttgatattaactatgttatgaaataatttgaatgattttgtcattttatatattgacagtaaaatgctagaaatactttagactttcttataaaactttgatcaataatttcgtaattgataataaaataaaatatgacaaatattaaattaaatgttaaagaaaaatatagaagagagcacaaaacagagagatgaaggatctgtattagagagatgaacaatgcaaggacagaacagtgaacagcacggcagcaaaggtcgcggttggccagaaacagtgacaggttcgccagaaaatggccataaaggtcaggaatgactggaaactatggagaatagaagctgcagaggttggggatggcaaaaaactcacataaggcccgaaaatgcagggaattgccaaaaatgttgccagaaaagggtgtcttggtggaaaaaggataacaatatgtcataacagtgtgtgtaagtaattgagaaagtagagtttcagttgtgattcaaagaagggggcaaaatcattgcccactaaaacaccctaaataaagttgtttaatggttaaattaaaataggtttttttgtgacccactccaataaagcctgctccaggagcaatttctgctattttgctagatatgacagctgtgatggtcgctactgatacacttttcaattttcatagcatgctctagccgctctgcaatgcaattctgcgctagcaccactatttgttgctattggcaactagtcatataaaaactgaaaataattctttacgtgaaatatgttaaatacattcagcacattgctgatactgaatgaataaagcagcaactacttccctatctgaataattaaatgacataatttcctttggtgtcaccatgtttagcatctaaatgttttaagttttcttaattaaatgagtttttcagcacttaaaattataatcttttcaagcaaaacacattcgacgtataattttacaggtttatcaaacatgcctttaatgtaagtaaaccaactcgtgcatataagaaaaccaaaagcaatcaatcacgaacggtgacaaggcatctcaaacctgctttattatcttttttgacgcatcttgtaatatttttggctcagtaacgactttccgcttttgggcttcactgtttgaactacccctacccacagatgaaactggggctaaaggtgacaaaacaggtatttccaaagatgactttgctatcgaatgtgtagaacttgaaattccctgaaaggaaaacattcaagtaatacagtacgaaaaatgaagctaagagggtatgatcatattagcaaaagcaattcatacagagatacaaaatagtaaaaataagaatcaactcattagtcattggaaaataccaacatgccaataacaccatgcaatttgaaaagaggataactaaaaattacctgatacgtcgtattgtgatgttcatttagtcgagtctcttgaagtgcagctagttggttcatcatgtcagcctcctcgttaattggtgaaaaaattcggtcaaaataattgggtcgaccagcatctccccactctgctacattccatttcaatgcttcccaccagatgctttctcctttgatgatcttcaaagatttgcttgacaactctgatttggaaagactttggagacttgggcaataataaaatatcatttcttctataaaaggtccaacatgtatgccattgaaaatgttgaccaattcaggaagatagagaagcgatatcattctcaacttggggaggaaaaacactggtttttgttctggtgtggcatgacttatcagggtggttacttttggacagtcttcaataataatctcctccaaaaaggaaagttttttaagagaatctaaggtgaagatggtggttaacatggggcaagtgtgtaatgctatagactttaagcagagaaagaagggactactcccttcgcagacgcttcttaaattcttcatatagaatacactcaaaaacttcaacattagagaagctggcctatcaggtgaattgcttccactgacaattgtttccatttcattacactctgccaatatgcatacttccaacccccataaattcctcaaatcgaaatcagagagactcttgatggtcatatgtcggtctaggtacaaggctttgaagcgtccaagatgcattttcactccatttggaacattcacaccattaacaaactttatgctatagtcacagtgtttaaattttgtctccagttcaggtggtacacgcgatatcaaacgtcgcatatgttgaccaacaaccaatctgaaattgagagatttttgggttggtatgaattccaagaggtcagcctttgggacatatatactcaacctctgcaaattccataatccaaaaaaaatttccctcaagacgctaataacattctcattccatcgctcatcttcagggtcaacgttgatgcttaaataattcaattgagtaagatttgataccaatcctggaggaataattgttgacctggaagttccatcaaagcagaggcttaagctttgcaggttgatcaattctcggatctctattggcagatgggtgatcaaagtcccatcaagatcaagctctttgaggttctttagctgtccaatctgatgtggtagttccatgaagagatcacagcctctaagataaaatttctgaagttgtattaatttagagacagaagggggtaaatcccttatactagtgtaggataagtccaagtgttgaagcaggggcatgtggttgaaaaatgagtcagggatatccatcaaatcaacattgccctgcaacaacaacactttgagtttagggcaatctggagattgtggtaattcacatattttattgtccatcaattctatctgaacaagactatgccatcgtccaatgtagggtggctctgtcaatcctaatgcaccatgccttaggatggaaggctttgaggtgtgcaatgattttattatatcataggtttctactggcaaatagacatctccactttcatatttcaacaagacaaaacggtcttgaagctcattgatgtaatgttgtaattgccttctgtattcaccaagttcttgtgtgtatcctgatattatcttagcccaatcagacaccaagatatcatctctcaccccatttttaatgttgtgaacaggcaaactgagttcaaggcaaagcttttgtgcatcatcaatgtcttcccaaataatatttacgaatgcattgaccatgactctactaatgccaattcgatcactatcttgataatcataggaaggattcagactgcttaatttgtcaagtgcaagttcccactgtttaaaatcttgcacatacgtaagatactttgccacaaggacaatggcaagaagatgaccatggcattccttaactatttcctctgcaattttctgaatggccattgatgaacttaccatgctactgctgatacaactgccgacatagctgcagaaaactttccaaggcaatagatgatcctgggtccaaatattcaaatccattgtgcatgcaattctaaagtcaacatccttctctgcttgtgttgacggctcagttgttatcaacaccacaattccagttggaaaacgcaacttttggaggtccagcttgttgttgctatctgcatccactacaattaccaactgcccattgcttcccatgtcatcaacttccatcatcatattgatatcgatttgttcttgaactcgaacctctgcatcagtctcatatgttgaggcattgatccatagggctctaagaaaatctttgtcaattccaaacatggtgtgcttatcttcaacggctgaaactattgtgtccactacagatcctttttcagccaagtttctggttaacagtctgatatagcgtgcacagtaatccccagaaaacaaagtttgaagtagttggttaactgcgagatcaacagattgttggagaatggcttctggtattgcatcaacatcattatggctgaagatggatctctcaccactttctactttacttattatttccattggcataaatcccttcataggtcccagtgccttatcagttagtacacaccatggtttgtccatcacagtgtcatcaccagtggacaataactgagctttccattcaggaaatgcactaatccaagatcttaaaatattttcatcttctaatttcccaggataagtcaacacgaggctgataaaatctcttatcctcatcaagcctgacagctcattgtataaaacttcatctttatctgaagatgttccctctgcttcattttgaagagttgaaatattaggacccaatatagttattatatattgaacaaattcttcaatctctgtatattgtggcctgaaattttaaagaaaatgaagaattcgaaatcatcacccaagagaagcaaaacaggagaagataatagaagagtagttttcaacttttaaataccatttgcatcaaacatctatattaaatttggacccaatttgcaagttacatctttcatgagatgagagcgggttacttacttatttgggatataccaaccagggagattggccactcgagtcagagcttttctccatgtccgcacttcctccatcctctctttatctaccaagaatctttgttcgtgtttccaaaaggcttcctcgtaccatccagtctgttctcgcacatctgatggatcaacatcataaaaaataggcagaagacgtcttggcgaagtttcaatgcaattgaagatgtgtgctagttcacgcaaacaccgagttgaggaagcatagttctttgaaaggaccacaatgaaaaggcgggagccttcaattgcatgtaacagctcgggttcacccttttcgggaagtgtatgacctttgaaggcgacgatgccttttcttctgagagcttgaaaaagaaaacctgtggagttgttgttgttgttgcgtgtgtcttcaccgtggaagctgagaaacacgtcatatgcagaagagctgctctggacgctggagatagaagccattggaattgcgaaagtggaagtaaacttgtttgtgaagaaggacagaaggtgtaaattaaggacaagtatttctcgattgctggagttgggataaaatgggatccaatggaagaaaagctgtggcctgtggcgggaactactactagaaaaaaaaattaaagaaacatcaagtcaatactctatttttcttattcattttatactagtaatattttctttttcttttttctcaagtatatataaaggatcttgagggagggccaaggcccctgcttcccccataccccccaaaatccgtccatgttgaaactgatatacaaaatgattggaatgtatctgaggaggaatcgggagcaagagttaagtaagaaagattcatgtgtacctctgctgctaactgttaagaattgagatccatctcgggggaatcagaagcaacagttaagaaagattcatgcatgtctagttctgccagcacctcttgtgcacagattttactaaatgatgggtaagtgaacgcatgagcagcaccaaattgagtctctggtctccttgttcaatactaatggaggacaggcaccaaccaaaataaatactactgattaagatacatttgattattctatctctgtttaatctataacatctacattttaaaaatatatacttttgactacaaaataaaaagaatatttcatatcattttatatttattagttacttcaatgattatttttattgaacacttctaattaaatgattgagtttaacaactttaacttcaaataatttttcaactttaagccattttatttatttatgagtcttactaaatataatatacccaagaatgtgtttgataagtgattttaaataatcgataacttatttaatttataagtttgttctaccttaatgacttcatttagttaaaaaaatcacttttaagcattgcaccaacttagaattatttttgtcagatatagtttgaaagctattgaatatgaaatatttagtaaaaattatctaataaactaattatcccatatatgtgttagtctgcgtgtgtataattaaaaatgtaatagatttagatagatatggattatttactattattaggtataacatatttataaaaaaaataaaagtgaaataattaaatatacaaatataatttgttgaaaatacgatcgaattttattaattaggaaggagtaaaataatatcatttttggaaattagctgacaaaataaaaaaaaaaaaaaacaacaatcataaaacttttgtgttataagttatattattgtattttagagaaagatgaaaagaaaaatagaagacaataaattagttattccttaattagttgaaagtgatatacagaatcaaactacttaagacttaagaggttagatttgagatccatctgaagggtgagtgaggaatcataaacaacagttaacaaagatttatgatgatgactgtgtacctctgcgagtgcgagcagccgtagccgacagatattcttcacccagattttgtaaaatgatcgatcaagtgtttgattattgcttgctttatttgtttcacaatggactcaagtcaacgcgtttatcacttgagtgtgtggtgtcgactcgataccaatttaggacaaaaagtaaagataatgttattgattatgattttaaattaaaaatatatctacaattacttttacttttaatcaaatacgtttttttatcatgttattgactattaaaaaatctaattaatcacatttaatataatcctccaaaaattcaaaatcgataacttatttaccactttgatcaaagagacttaatccaatacatttgattatatacatgaaatatatgattaaaataaatatatttaaaaatctgaatttattttattatttaatgtgtttaaataaaattgatcttttgtttataatgtatttaaataaaagctataactttatttttcaataaattgatctgtacataaatacatctttttatattttaatttatcggtcagttaataacgaatttcaccaagggtcgatctatttccattataactgaaaaagctaactttttttatatgtgtttgcttaatatttttaaaaaatattaacagtttgcttaatatttatctcttaaaatttattaattgttctttaagtttttatttatttattttcatttgactccttctatccttcaaaaattttgtttttgtaatgagagaaagacagaagaaaagaaaacctaaaatttgaatatgaagaaaagtcaaaagaaattttttgaatttttgttttttaaaaattaactttttgcctcttttcttttctttctagctcttcgttcttatttgatcacctccttataataataaatattatttgttttatgatcacattgattacaaacttgagtacctgnnnnnnnnnntttgttttttaaaaattaacttttcccctcttttctttatatttttctccaatccaattagagaaaaagatcgttaattatctctgttttcttatctattttgtccttcaaaccaaatattaatcttatacattataggtattttcttttctttctagctcttcgttcttatttgatcaactccttataataataaatattatttgttttatgatcacattgattacaaacttgagtacctgagattatatattgtatacattattttggcatcttctttctggtaccatggccatagtggatttatccttattagccttctttcctatcttcaattatccttctaaactagttcgcacttcatcatgctttctttcattaattctcaagcttaatctcactctcgtgttacatgatttgatgagttaggaaatatgcacgcccgcatgcaaattgtttgacaagaagaagaggcaggacaaacagtaaatctcaaagactcacactagtctcataattctctctcaagaaagaaagaaagaaaatggttgtaaaatcaagaaacaaagatggtacaattttgagatttgagagacaattgtgaacttaagtgagtctctgtgaccacttgagataactgtttgggctgtttcttcttcttaccaaacaatttgaaatttgaagaatgaatattagagaaagaaaaaagaaggccagggagaaatacaggaagggaagttttaatttgtcaatgttcaagatgagagaaggaaaaaggttagaaaaattcctccaaatttacacatgtttatttcaataaattcttttatttcatagtttagaatagaagttaagagatctcttcttaagaggaaaacttttttaatttaattttgattttgaaggaaaatacgcacgagtttttcgtgcaataacgcatgaaccggtggtctttgtcaaaattcattcagagttatttggtatgagaaaatctttacaaaaatgagtacaaagcgatagaaattcataaccacacataatggtccctataaaaattgattttaatgtatctgcaatttaacattttgagtcaatcatattgtttggttaaactttcatgaatttgggttcgtacaatatagcatttttcattcatttatatgtgtttaatttaaaaaaaaaaaaacattggtccacatcattattaatgcgttttgtgccttatgtctttcgtaatgaataatattactgaattttgatatacttattagcgtaatttttttatactaccaattaacatattaaaaatcagtttagatattattattataaaaagtactggtttttaattatatgaaaactcattattagatttacttttgaattttagctttctcaaccttcagtatacttttatttctttcacgtttcttctctttcaaataacagaaattgattactattatatatttactaaaatatgtttgatcttataaatatttgaattttatatttatattctaataaattttttctttgttttgaatttttaataaataatatttttttgttctgtcactattttttaatatttgataaattaataaattttatgttttttattttattttctatacattattaatgtataaatatattttttcgacgttggagccaacgaattctgacataaaatgatgaaaaacatatcaccaccttccttatatctcattttttcttgtggatttcaaactcatctctttcaattcattcaccggtatttttattctcttctctttttctccgtaatctatctttacacgctcaattattagtttctctctattctgttcattttcttctccttccctcacgtgaaagaagattcgtttaatgcaagcattattttctttgaaatttatttttttcctaacacccagattatccaacattttctggcagtttgacgagcattttcgttatcctccaattcattgtaaccgaagatatcttaaatttaaggttggttgctgagaaaatattgtggtttcaatactttatttttaatgaacattttggggggtttcatcacttggaaaatgaaattgggaggagggggttaccccatattcttattatttatttatttattatgaacgaataatgtacgtaaatgcttgcatttatctaattaatacaagtgtaaaaaagttcaatagttaacacacgtacaacattgcaattttgatgtctgctgataataccaaaatttgaccttttttcttaatggaaactggatcatattaatttattcaaaacaatgtcagcaatacatcaccgaactgatagagaccagctaaagaatttgcctcctagctaaactatgaccgacagaatttgtgtgtctcataacaaagcaaacgctgaaatttggttaactatgaagcaagttatgacattgatcaattattttttaactcttattttttatgcttgatctatctatctatcttccccttaaagattaatcagactaatctgcaacggagttattgttgatcatgttaattattcaaatatatttttgtttttttggggggggttgggggagagattaaggaactaattaaggattattgtaccagaaaagttttgttattatagcatttcttgagggatttattttgttagtctataagaagatatttctttctttccaggtagtttagcttggctgctattactgaagttgcagttttgaacgattgctggcttcaagggtgccaatgaataatcaacggttggagtttgggaggcctgtctcaagtatgctatgattcttaatttcatactctcatgtatttaactgatttccccttattaaaatcaatcatttactttcttttctactaatttactccccctcttaaataaggataagaataaataatgattaagggtaagcctaaaaaatttataatcaatacttcattggttttccatttgttaatgtcctaaagcacattcaacccaatccatcgatagtgtgattgaactgaacgtccgtttgaagcttcttaatgaaacatcaaaatacttttaatagataaaactccggaggatttgaatccatatttttttattgaagttggaatgattgatcctgatatggtacttgaatgactgttgggtcacgtgatggcttatgcatttatacagtttttctctggtgtatttagtagttactaacttcatgatccctgatgagtggtttttcaccctaccagagggaatacttaaagcaagaatatttttccatctttattaggttgcatttttgttgtcaatgttgttgcctagtatttttaatattgttttattattttggtgcatgtaaggtttctgggatttcaaataatgactggatggttgtgactggaaactgtctctataccaagctttattggaatatttagtcttcttgtcaattgtttggactcagagagcttgattttaagcatagcagcttaagattatttagaaattctattacttagaaataaagggatgtttcaaattctaacagctcatcaatatacttataaagtttattaattttatcaatatattacaaaaacattttcaacatattgtatctcttgaaaaccaaggcttagacctgctggcttttgtaaaagctacaatgcaaagtaagccttttaggttaggccaagcagaaaacgaatagcctatttcttataatagactggactcatactttatgtttgaaaaacaggcttaatctgtttaaggtagatctgatgttgcttatttccatgtccaattgtcaatgtaaagttattttcacttatttttcttgagaagttgaatgattggcaggtttcttacaggtaaaagaagagtgaaggatttattgcttcaaaaagataatcgcttttgtgctgattgtaatgctccagatcctaaatgggcgtaagtgtattcaccattgtacatttttttgccgtgtgtgtgtgtggtttatggtcatggtcactgattgtaatactcaaaactggagtctgagtgttgaatattttctgggaagaatttataaagcatccttgtgattaaattgtagtaaactagctacatgaattttcctaaattgataatgtgaaatgcatattacctcttagttgtgaatccatttttctaactgcttctacaggtcagccaatattggagtttttgtatgcttaaaatgctgtggtgtgcacagaagtcttggctctcagatatcaaaggtaactattcctaatccactttacttaagagtttagaaagaagattttcactttactaataaggaatttaaactgagttccttcttcaattgtctacaacaaattgagaaactaatatacctatagatgtggctaattattttttgaaatgggttcaacttgatttgatgagaaaagaatcaaccactcttatatgtctatactcatgaaagagtccggtgaactttgctttgtcaggggtgcattattttgtttcagttttactgccttatgttgtgggggtttgcagggcagccttattcttagattccatcccacaacatgctgtgatatgatatcttgtgaaatttagacaaaagaaacactaaaattagtgatctgagactagaagtgaaaactttccaaataaatgtttcttttcaatgtactatttatttatcctgtaatatagctgtaatcactaatctttcaggaattttcattgttaaatgaataatactggtaggaatggaaaataatatcttatggatatattattacaaggtatctcttttcatgtctaattatgaaatgtgaactttcaatttagtgatgccctctgccactggatagtgttatttgagtttctcttggtctttattgtcaaatatgcacatttttctttacttggtttaaaataaaaattcagaatttgtcaacttttatattagatacagggtgctagtgattttttacatcaaagcagatagaaccaacaccttaataaccatataagtgaattagacaccacaccttaacccaaaaccttaatgctcaggtttatgagtcttttcctcacttatatggtgtttaacttgtctattgctatccgatgtggggactttaactcacacttgtactccaacatgctgaatttatttatttatgcttggtcttgtcatgcattaaaaccttgggacattattttcttactttcaggttttgtctgtgacattggatgaatggtcaagtgatgaaatagatgcaatgattgaagttggaggaaattcttctgctaatttaatttatgaggcttattttccagaaggatatacaaaacctggaccagatgccagtcatgagcagcgtgcgaaattcatccggttagatatgttttcatctaactttacactgtacatctaccattcttagcatcattttgcttgttttataaatctattatatattatatttatggtcattacaaaatgggtaaaagctgtagtcaactttatatgatatagataggaacttgtgtgccctcattgcaatttttttcttctcatgtttttcttttttcttttttaccattttgctttgctgagtcatttattttcaagtttctgttttattctggtactctttttcattgcagtccattgtcctaggttgataatggactaaccggcatggcgttgggattactcatggtagcatcatctatgatagcaatctgaccaatgctcaagttaagagtggcattttaattgtggcaatttttactgcaggttaaagtatgagcgtcaagaatttttgaaacctagtttgcgcattgtgtcaggaaaaagcaatcccccatcaagtatatccaaagggattatggatagttttcaaattactagtgattcacagcatatggtaattttattttatactttagttcctttggatggagatgtatttgtttgttggccacatgttgatttagcatatcaaaggtaaccgagttaaattgatgttgtacccagatgaaagccttctaatcgagataattatatatatatacggcacttgttgcatgcatccaactttactacttggtagtaaatgaaacgaaattattttcgtgagtggtttacttggatgtttaactgatatttatggttaaaacaggaaggaatggtagaatttattggaatgttaaaggtgaaagtgatcaaaggcacagatttagctgtcagagatatgatgacaagtgatccatatgttatcttgaaacttggccaacaggttggttgttctcagttctcattagcataaattatttcatgggaaactttcatttttaattgaagagtagtagatgctgataattttctttctgaattgactttggtgctatatgccttcagactgttaagacaactgtaataaagagtaatttgaatccagtctggaatgaggaacttatgctgtctgttcctcagcaatttggaatattgaatttggtaaggttcaatttcatcttgtcttgttagaaaatggaaacaaattctgtgatgcttatttggtggttggatatttggatcttcatatgtgatacttctatttgtctctctgtgtgtttgatacagaagatacaaaactcattctggtgtaaaaacatggaactttatgctaatggtttggtacattgcattgcagaatgtatttgattatgacttgttttcggctgatgacataatgggggaagcagatattgatcttcagccgctgataacatccgcaatagcgtacggagatgcaagaatgtttgatgatatgcagataggaaaatggctgaaatcccatgacaatgtgcttatagatgatagcacagttaatattgttgatggtaagattaaacaagacatgtcaatcaagctccagaacgttgaatctggagaattagacttagaactcgaatggatacctcttgattattagaattgaatgaagcattcttggattgaatggggaacagtaattccaaatcaataactgcacggcacgtcagaaaaaagaatgctagaattgctttcattagaatagttttcgtgtaaatgcggtgtgaattcctacctttctcataggtattggtttgaatttctcgacattatttctctcgcttggtggaaatattaatataaattctcctccaagaaatcctctagcactaggttctgaaatttaaactattaacataaactttgaagattcatattaatgatataatatgttatactaatatttgatgtattgataatatataacaatattttatattgtcaaaatttgttaatataatagataattttgttaacataaattcttaatgtctctataacagtcttacactagtttaattttcagtagaaaaaggttatactaacataacctaattcagtactaacacatttttattgaataatttaaaagaatagtaaaaaaaaattatatgaagatttataaattttctcaatgaagctgtttttttttacgaagctggtggttgaaagtggtcacaatttaagttttgtcataattgacatcaaaatataaatgccacatatacattcattatttgaacattaaaatattaatgccacatataatcatttttaactcttgtatttttatttttcatagacccacgttttgaatgtatatcccaaaatcaaatatatgtttttacagaaaaatcaaatagattatttaatgataatgagaatgattataatcatacatctactttctcttctacttcattttcgaccttttttccttatttatggtaattatctacttaattatcaaaataaattgtacgtgtattgtcaaaagtaccagcaacaagagaattagtgtaatcctagctagtacaaatgtagagcacgtttgtaattttgattcatattttttgttaccatcttttactcatactcgcgttaaaattaaagcttagttattttgtcaaaatggctaaatgaaaaactaatttgagtaaaaaaaatgattgaggaatgaagggaaaaaccacaaaggacactaaaaatcgcaaggacaacagtacaaaataaaaaatgcgcaaacgatcatcaatagagtgagcattatttgctaaggtgtctgtcacctgattaacttatcgcagcgtatgactccaagagaaatcaccatttaaggtttaaactccgttaatatgtattcctaaaaaaatacattaatatggagtatgaggcagaagaactaatgaaaaagattgtctctaaaaataaaaaaaaaataaaaaaaaattaaaactttgacttccaaattccaatgaatcttttttttagaggaattccaatgaatttattacgtgaactcttactatatatttttatccgaccatcacatgataccatattattaacaaaagaccttttttttatgccaacaaaagcccgtaaacaatacaatgtggacacattaatcccacatttttcctaaaaaacgaatatggtttctaatttttcaatcaatgcgacaattcgtagtagatatataacaatagtgcactttatacatgaagaaactcaaaattaaggctttgttttaaatttaagatttttcttaaatgaagttgatgttaaaataataattcatgtttaaacaccaccttttaaaagtaaaatgacaggcattaatttacgtcttgttcaaatggtaaagtaaaatacattttatactataaacataattattttggtcgatcattccagtcatcaaaagaagcacaagatgaacagaaaaaagtaaaataattaaataaacaaataatatcatataataaagtcataaatctagaaccgctaccctttacatgcatcatggaatcatatatagaacactagctagctagtgggaaacaaggaaaaatcataatcaaaatcaaaatgatagcaagaacacacaacactcgctcaagggttgcgtaccaccaattgcaacttgttgttgtcttcatcatttccaccttcattctcattctcaccgcaaaacgctgcgtttaacttctgctttctgtttctgtttctgtttcggttcttgaacaaatagatcaaacccgaagccactagcagaaccgcgccggccacgccgcacgccaagctcgccaccgtaagcaccttccccaggcctttgccggagtgtcctctgacaggttgccaccactccggcggcgaggcgtctccggagtccatggcccggggaagtgccacgtcggaggaggaggaggacatcgacggcgaggagtcggcgctgttgaagaaggatcgcatctccggcgaggaatgcggccccgccggcgagaatgtctggaaggtgaggccgtggtccgacggccggagctccctggcggaggaagctccggcgagaaagagtggcacgaagacagcgagggcgaaggtgactacttccatgaagagtgaatttggagtgacggttggaagaggaagcatatatagagagaaagatggaagtgtggtggagaatacggtgtcgttttgaaatgggagatgatgagagtgggagaggcttaaacttaaagaaagagaagaagagtgggttttgttttgtctgagtgtggaaaactgtctgttttacattgtgtcggaggaaaagcttacttcctcttccaccctcgccgctctctcctttgtctttttactaactcactttttcttttctttaagcttggttaataatgggataagtattctcctcaagtttattaattacaaattttttatgtttttattttcttctcattttatgtatattaaaaaaaacaataagatctgataattaaatggacacaaacatagataaaggaagtatatagtatgaacacatgaccatcaactttgttaagttcgttaatttaatcataaaatggatacaaacattactacagtctacagtcagtacattagtgaaaattctatttgttaagccaacaatttcttatcataaagagaagattttgaacacgacaagtgcgagactgcaaagtcatgtgtattataaagagttgtagaaagtgacgcaagacaatcaatctaaggtcaactctcatagtctcattaatgtacgtagatataccaagaaatctggcgagtttgtcgttgaagaaattgtaatttattcccatttcccatattagtaattgacatgcaatatagtttgcgttgttaaattagattagtggtgcgagtgcgactatatatggagaattttaagcattaagatgataacgtaatgggttttaattttatagggatgcgactaatatatgagttcagaacgtacgtgtgtgtctcatggaagctgtttgcgtgttcaagtttaaggtacctgagatctgtaattcgaatctgaaaatttaatgtttagcatgagagagacggtttgaaaaagagaaaaccaatttttaacggttaccagttatcaaaaatcatctaatatatatatatatatatatatatatatatatatatatatatatatatnnnnnnnnnnnnnnnnnnnnntctaaacatttttttaaaagtttttaaatgtcaaaaataaattccattaaataatttttttaaaaaaatacacatagtaacgatcatgtcatcatttaacaacaaaatctaacagttgcaaccaacacataatggaatgaaagttctagaactaaaaatttaattaactattttctttatcctaatcattaagtgagttcttaaagtttgtcgtgaaataaagtcaactttgacgcaaaaaaaagtgtgctgtgttaggattaaatccttaatttttaaattttgaaatcaattatacatattttttttattttaaatatttttatgttgactcattaccaatttttaaatatgttagtaagtcgtttcccttgtgaatgaagttttcaatactaaatcaaatatttaatttacatagaaataatttatgaattaattggaatgtactatcaatataaaagttttttaaactaatattcaactataaattgttgtgtatgatatataattacttaaatagttatataaaaatagtttctaatcagttgatacttttcatccacaatgcatccaaactaaactcatacttttcttggtgtagctttttcttttttatatatcgatcgaggttcttcttgttcagctgatttgtttttctatactcttgtatatgggttcttggtacccctcgtacctagcaatcaatatatttttattttctgatataaaaaaatcagctttaaatatattgttttgggtaatgggtacaatttcaatactaattatacgtgcatggaaaatgttagcaaggaataatttccgccataaccagaatgtaactatgtaagtaggaacctaccgagaagaggaaaaactaaaaaaagtaaagcaggagtgtgacaagaaattccaaaggaaaattccgaagatgctgccgggtttcactcctgttatagaattgcttttgtgaagaaaagtcgtagatcgaaggaaggaatagtataaaagataaaagaacaaacaaataaaaaagaaaaagtaacagggcaaagacatattcgaatgtgaattaaaaagatacaatccatgtatgtaccggggggaaaaagagaaagaaaaaaaaaaaagataaactccaagttcaacaacgcttgttttagtgtaattacaagtattttttgcagattatatgcttcatctataaaagctgtctagggctttattccacatggcccttgacctacgctttcattattcatcatggagtgatcggtgttcatgtactccaaaaagaagtaccgaataaagaattgatccatgatgtgtccctctccattccacataagacttcctttgatgaaaagggaaagaaatacatctaatatatacacacgtatatacagagaaagggataagatgagtgaattttaaccatataattcatatagatagttaagatgaaaatgattaaaacaactttgatcgcgctcatgtataattatgtgttcaaaagtcatcatgtattttttttaaaagaatggttatataacttaatcttaaatattcagtatagttgtatacaaatagatttactctcttaacttttatatagaaataatttttctactaaatatatctcacatatagagatcgagatggagagaatccttttaatcaaagtatctagtataaaattcgtatgaaagatataaacattcgatataaattacaaattattaaagaatttgattatcattaccattagtttagagatttaacctttttaaatagtgtcaagaaattattaaataataatcttttttgtttctcataactattctcacttaaagaaaatttattcaagacatactctgaaattaaatatgatcacctcttctaaacctagttcttcatgaaattaattcctttcactaaatccaacctccattgatcattaaacaataatcataaaaactatacaaacaagacatcaaaataaaattaattaattttgtattagattagagttctttttaatcattttattagtgcaaaatatccattaacttgataacgattgttctatgcaaagaaaccttataggcttatattatcatctattttagtcaataagtatctttgaaaatttcacgattttcttgtatcgtgacattattatttttaacagacaaataagataattcaacaaacattcaccaattttttttattaatctaaacatcatagttatatgtttgatcaaaattagtagtgcatataatacttcgctgtacgttaattatattcaataatgacattgattcaaaatttatttcccctacttcgtcttctttttttgtttcttttttctcttgaaaaccgtgtcaagaaagaaacttgaaatttacagcacaaaaataaagcaagaacaagacataagactcaaatatgcaataattattgttggttgggaaacgatcattcaacatatggagcattgcttaattggttttgttatgatgcagaagtttattataaattttctcatacaagcctcgtgctgctgattatataacacatggaagggcataactaaagcttccatgcattttcgcgccaagatgatgtttccttgtttctatgtgcatggaggtatacttggggtgctgaatcaacctcttctaaagtggtagatatatgttgttgatatgagagaacacaaccccatgcagagggaatgttggtggtgtcttgatattgatgttgttgcttttccatttgcagttttgcattgcacctactagtactttgaaactaacttattctcacaaccccaacattcctttcattgaaagattggtagggttgaaaggtagttgggccagaaaattttagttgttcgggatgtgtacaaaagataaattatatgtagctcaattttgaacatttatttatataaataagagcgagataaagagaaaaaaaaaaaagagagagagagatagctgatgagatgagtgatgtaatgagaaaaaataaagtgaaaattgaattatgaggaatgttgtaagaataatatattttttgtacaatggtcacttttttgtacctatatattttgttggcacaaccaccgggtgggttcatgggagatggattgtattccacttttgcatcattctgttcttctagtacatcagcagaacagagaacaaagtgggccctatatgtgtaaggccagcccaacggggaagcccacaatgtacattctttagtctttcaaaaaataatgttacttattaatttactatgttttaaagtaaacaattaattgataaattatttataaaaaaaaaaaaaacacaagaacagcttaacattgtattgataaaaaaattcaagggtcttgacagaaaccaggaaaactgttataagagagtattctctgtgaacaaattaattatgctattaaacactgatttcgaacaaagtttaccattaaagacaaaaataaaatagtcttggtaagcttcctggcgtaactctgatttctcagaaacttgggatccattcctttggttgtggtggtaattctgggtttcttgatgccattttgtgggctttggtacgacaggtcgtaggcagttgcttcctgcacccctcagaggacactaatacccttcttgtaacccagcaccccattgagcggccacaattcacccagttactttatttgtggcattggagcctaacgatgtaatttgctctcttggtttaaatacttttttccgaaatttaacgtttttttttataattttcgcccttttaatttttgtgttataatcttgataaaatgtatttattttattttttatttttacactattctgaacagtaaaaaaattaaacagtaaaacaaaattatctaaaagacttccaaatttaaagataaaaaaataaacacgtcttgccataactaaaacgataaaaaaaattacaaaaacattaaattaccgataaaaaaaagtatttaagcccttccattggtagtataaaatttgactcaattccaaattgaagatcggatgaaggggtattactaattattacacgtaggtggaatcataaaaaataatgatttttaacaatactagtagagaatattggttggcgaatatcgaaccataagagaaagagagaaaaggaaaaggaaaggaaggatctgttggaaattgggagcaaaaaggaaagaaagatgcaggatctgatgtgcggatagggagggtccaggtagtactacacaacacattctgctaacataacacaacataacaccgacttttctctcaaacgaacgacataattcaactgctgcactgtaaaggttcatttccaatctctaaccctaattttcctccctccaattcacctcgaggaaccacgaaacaaattcactttttctattttcgattggtttaatggaattcccttgtttaagatgctattcaaatgttccgttatctctttctctgcttgtattgaaattgggtttaactatgccctgatttttcttaatcagattgaaacttattttgaagaatgaacgtgggttttggttttgtgcttgggatgtgaattttttactctgttttatctgtatagaatgcacccgaaatacttctaaattcagttaacaatctctgttctggttccaggtttggacaatgttacgtgcttcacgaaacatgacctctgcgcaggacattactggtattttacatgaacaatatccttgatccattttattgttttactgtaacttttccatttataattagtggcttacccgcatgttttaattttagttaacaaaaaacaacacatggagcaatatcattggtgtttttgtgtctaatggaattgttacaacaacaatagccttgtcccagtctaatggaatttttaatggagaaacttctattcaacacaaattagtaaagttgaagatggaaaagatgaataactactgttgtgagtgcagtaaaatcttcttttatcttgtattttgtgtgctggaattattccttagtgaaaatcataagaaatggtaaaaaaacacctttcttaaaggaaaaaaatgtttgcataaaaactcatgtttcttactgtctagtaacttttaatgtttggctacaattcataggcaactacactggatgtttccttttctgtattggttgccttgtgaaaattattattttgtcataaaattattttcaccactcagtgtcatagatctatagctccctgtcttttgggtttgccaatgtatcttttaatcatttaagtcattgaacccatactcttgctcagaagctgcataaaatgatttatgccttatcttcatcctcttcttttgcaattacgttgtgtgtaaaccccttcgcagtccaccctccagcaaggcagaaagaggaaaaacatgaaatagacatttaggcttcacttttaatcacgtgtttgctggttttctgagaagcatcttatttgtatgtcttgcctagggactgcaatcaatatatcctagctattttatttttcgttattacgcacagcttcaccttacactatctttaaacttaaagtatcttattttagcttcaaaatttgaacttcaaaacttatttcaactttaataagtcctgtactcctctaatcctgtaactatttttgtttttaactaactcctgcactggccacccgtctgacctacaaaatatgtcaatatattgttattgctttgctgttcattagagtagaacctatccctcagcaactctagtgtactctagattctaaccttcactgtgaaaatggtgaactgtaataactaataactatgaatgtgttcatatattatattggaaaaaattcaagtctcacattggctagagatagtgtcaagacagagtatatcagtgggaggcaaccttcaccccatgagttagcttttgggattgagttaggcccaaacccacattttaagatggtatcagagtctatcctagattcatcaaaaaaggtcacctaccatattatccacgcaccaaactaaaaagtgttgggcgtgaggggatgtattggaaaaaactcaagtttcacatcggctagagatagtgtcaagacagagtatataagtgggaggcaacccacatcccatgagttagcttttgaagttgaattagactcaaactcacattctaagatattatatgctatagccatactacgatactaatacctggcacaagtgaagccaaaatgtctatttcatgtttttcctctttctgcctcgctggagggtggactgcgaaggggtttagactttagatagtattagtctttaggtattattcatattcatctacttattgtgattactcgcctttcttatttctgctttatctatatcagttcccccttaaagttgtctctttgaacataagactcctttgcattctgacttggtaagaaatgaagagtcttttgtatctattgcttgagaatatttatgttgctttccctctcctttgtatttctttttccacctttgtttatgattctctgtcttcttgactgatctattgaattagccctcatccaggctaattttttaaaaattcataaagggattagttttagaatgcaggagtttgaagtaatatcttgttatgtagctgaggaaattattttctagcaaaaaaagtgtgcattaagttgaagataggtaaatttaagatgaaaggaatgaaattatatgggctcacatgtttggtagttgagagatttgggcagaaaaattcacttcaaaataatgttttttgacaatcactgtttcttctgtatttacaaactcaacataaatctggagtttgtgttcctattgtgatatatgcttctacgttctgattgctgctcatgcattataaaacactaggttcgtttttaagatattgtgttaattttttattgagcttctttgctattatcctatgaagcatttcacttgttccttcactccatcccaaacacaaatttactgtctaaacctatgtagcaaaatgtctatccagataatgaagatgatggacagcggcagtcagaatcaccaatgcagtccccatctgcaaatggaatatttgatccaggtattagtacccagaatgtcaatgtacagtatgcagcacctggccagcttggaactgggcatgcaatggtatgaacttcaagctcctttgggttctcttctgattttgtcttggaagaacaaaatatgtttcttcaatgatttgacatcatcagtccaatttgaatcagcgtcctaatatttaattaattccagaaatactaaggaatattttgttttgcaaaggccatagccattgtatatcatccaatgtgtcttgcctgttgtaggtataagatagacacacattgccgttgttttgtcattgaagcaaattgactctgaatattagcaaatcatgatgaaaattttccccaggtttattcttcctctaattcatgaataaattggctttttttacatttttcttcccgtgaaggtggcattcctattttgacacagcaagctaatttgaaagtagccattaaatttcttgatcttgtaatagttaaaactgaatttcttaatcagtacctactttagcatgcgaaaacttaaggcttctggtcaggcaaataatgatgcaatctgaagtttttcttataaaagtgttctttagaggttgtgttgtggtgaattaaggttgatttttaagaaaacagagtttttttgtcatggatattgaaggcaaatgaataattgcccgagtgagtactggtgtcagttgttatttagatgtgatattaaagtttgttcagaatcactgtttgcactagaattgttcttggtatttgattttaaaatgtaaatttcttacgcattgtactaatttatgttactttcttatctaattgaaggcaccacctgtgtatccagatcctgacccttactatagaagcatctttgctccctatgatacacaacgttatcccccacaagcctatagtgggcagccaatggtttgctctaattctttaatgttgattctattaatattatagtggcttcttgtgtctttttccgatcctccaattattaaaccttatcctgtgctaggtccatcttcagttaatgggaattcagcaagctggtgttcctctgccaactgatgcagttgaggagcctgtgtttgtcaatgcaaaacaatatcacggtatattaagacgtagacaatcccgtgcgaaagctgaatcagaaaataaagttataaggaataggaaggtatatcattctctgcatctttatagttctttcttatgataccaaaagtagtgttgttattgttgtaagctgcttgcttctcttctctggaagtacttacttgttcttataataaatcttgcagccatacttgcatgaatctcgacacaagcatgcactgacaagaccaagaggatgtggtggtcggtttctgaattcaaagaaagacgagaatcagcatggtgatgtggcatcagctgacaaatcacaatccaatatcaatctcaattttaataaaaacgatcaaacttcatcagatagggcatcctaaactacagaaatgatgataccttagacagtggggatctattttatgtcacaagatcaataatacctgctttggatatcccacttttgcttcattctggctttgtacaacactgtaggtggtgtggtaggtagcgttaggatgtcgcacgatgcaggtaaaatgtaaattgttgttattttatcaaatattgtcctttggtaggggagatttttatggtgatcattcctttgtatttggttctgtagagaggttagagattggtgttttgtttggttgaatcgtatttatttaccttgctagtgacagttgaagaagtttcaaccatgattggtgatggatattgatagttgtttttgttcagtgattaatagatagataaataaggttcacatgacttgctgatattggaatgaatcccgtctttggttagaatttgtcctaccacccttgcttgaaaaaataaatgttacatatattttatatgattcttttatatctatatatatctttttaaaaagttataactaaaaaagcattttaatttttttacctgcattaacacgttaaactcaattatatcactattttataaccatattgtttatgaaaagaaaactaaatttactaatgataaatactcaattatatattttataaaaaaacattcaaataagttaatttaatattattatataataaaaatacatttatcatatttattattacataaaattagacatgataatatttataattctaaagagcagtcaaataatgtaatgacaaaatccggaatatttctttaaaactttcataattataaaatactttaacataaaaagataaataaaataaagaatttagtatttgttatcaataactattattttgtataaaaaactaataactattattttgtataaaaaatattaataactattatttaattcattaaataattataaaattatattccannnnnnnnnntttactaatgataaatactcaattatatattttataaaaaaaaacattcaaataagttaatttaatattattatataataaaaatacatttattatatttattattacataaaattagacatgataatacttataattctaaagaacagtcaaataatgtaatgacaaaatacggaatatttctttaaaactttcataattataaaaaactttaacataataagatgaaataaaataaagaatctagtatttgttatcaataactattattttgtataaaaaagtaataactattattttgtataaaaaatattaataacttatttaattcattaaataattataaaattatattccaaattattatcnnnnnnnnnnttattgctatctatatctatatatgtaatcttatttttctatttttaaaaaaataacaccgtaaaaagtaggagattaaattgagtaactcatttaatgttggttttaatctttatcatttatttttatgaaatttaataggtaataataattatttattataataattagatttcaagaaaatttaattataacatcaaagagtaactatttatctatatattatatctaaaggaagtttgaacttttgtgaatagtcggatcgaaattttaatttgtcaacaatcattaattgatttgatgtataaaaaaaagtttaaaaatttatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaatatatatcatacttaaatatttgtgagttattagatcaagatttgagttccacaatagccattaatttgactacactacttccactcaccctcccctccttaagaattacataatcttttctttcatctctccattcaatttcatcattttttgcatcctctttgtgaattctctttgcatcttatttatcttgttaaaacaattatttttgttacttttgcatcttttcttgatgaattttctttatgtgaatttatatcttatttatcttacatatctttattttgtgtgcatgtacatatttttgaattagaaaaatgattctttagtttgtgaataaatttgaggaatcatccttatctttgaaattgaacaaccatgttatctctaaaattgagttataatctttatagtgtattttttcttcttcaggtgttatgacaatacttgatctgaaacatagaaaaaagtaaagcaatgagcaattaattgatagttttggagattcagaaaataaaaataagcatagagaaataatttactttgatcggaagagggaaaacaaataagcactgagacacgcgaagagaaaaaaacttttgcattttatagacttttttattgtgttttctttttacgccttcgttcttttattaaagacttttgttatgtatttcatctcttctcctttttgtataacgtgtttattctttttgtgtgttattatatgtggtatcatatatgtcatgagtatgttttatttcaatgcttgtatgagtttattaggttcatttttaattgtggaagttcataattgtcatttctcattgtccgtgtcttataacgtgtcttttacttgagaacccatcatccactgttgacgatgcttgccaccaatgataccccgggtactttttcataggttcctgcaatggcttggtttccttgctttatcgagagaatgaccaacctatcccattaaaaaaaaaaaaaaatctaaatatcaggccagttaaaataaatattaaattgttaagcgggcatagtttaaggtagaaagagaatattttattggagggaatagtaaattatttacaggttcaataaataattgccctcactttcccagatcgtatgttatctttttaataattgctttcaattttccataaagtatgttatctttttaataactgcttatccttttatttttgtaaattttttcaactaaattgaatgataattgacagatttttattcaaaataatttaaaaataaactgtattgttttacaaaattaatttagttaataaaattaatttttaattaaataaaaaaatatttgaaaataaaaatacagttagaaaatctatttaaaattgatttaattcttataatcaatttaaactgattcaaaataccaatttttttgttcaaaatgatttttaaaaaaattatattattttacaaaactaatccagttaatagaaataattttcaactaaataaaaaaatatttgaaaataaaaaaaatagttagaaaatctatttaaaattgatgtattttttataataatcaatttaaaactgattcaaaataccgatttttattcaaaatgatttttaaaaaattatattgttatagaaaactaatttagttgatagaactgattttcaattaaataaaaaaaatatttgaaaataaaaaacaattagaataaaattattttgaataaaaatcattcggttatcatccaatttggtttaaaaagatgcaaaaataaagggattccacatattatggaaaagtggggacatttatttattgaactttaaatagttcgctactccctccggcgaaatattctctctctgccttgtcagtacataattcgctgcacagaatagagaactatgtgtatgcatagttcgttgggatgtctaacgaactatgccgcgtggcagtttgatatttattttgactgacgtggcatttagatatttttttttaaatggggtaggttggtcattgtcttatcattctcgttctcttgttatacatggatccactgaatacccggtccggttttggaacccggccactaggatcatgtccctaaatttgtctcacttaactttccattcatcccaggatcatgatattggctttgggtttggtaacgattatttgagtgacacatacaaggtggtcgttctccttttggacattaaatcaaacaattgggaggttagggtttgcaaaacaggttcagcccgctaggtcagcccgcttaacctgtaaaaaaacacggactgggttgataatattaacccgtaaatcaaaagcaaggtgggccaaatgcagggcggggaaggacgggtcagcccgttgggtctatattatttaaatattaaatattaaaattaaataaatatatttaacatattttgaaatagatatattcttttaatttatactctttatactctcataattaacttctaagttttaatattaaaatggttatgataatgataatttcaaataattttttattactagcatattacacttttagacagtctataaccgtaaatttcatttacaaatgatgtaattttgtgaattatcacataacatcatttatttatcattaattttaaattatttacttttatttaactttatattttttttaattatcatacttgtatttttttataatttttttgtattttgtttttgaaattgacttttttattctttttttatttttgatacgggttgatctgcattaaagtgggatgggctagcattttcagtatactttgtaaaagccggcccgcagtctatttttttccgggccgcccggtttgccatccctatggcaggtgagagttgcctgcttgggtgacactgacacttgttggaggagaaatactgtaactgtaacttgccttgatttcccactttggggaggacgcgatggtaagcttgtgagtggcactcttaactgtttagcagttcgctggcaaaccgatactgtcaatcagttggtaattttttcgtatgatctaaacaaggagacatataagtatttgttgttgcctggtggtctttctgaacatgctgataaccctagtcttggggttttgaagggttgcctgtgtctttatcatggtcaggagcaagtcagaacccgttttgttgtttggcttatgagggaatttggagttgaaaactcctggactccgtggctgaatatgagttttgagcttgttcagctctttccaccttggcaattattggcagcgcctttgtgtatgtttgaaaatgatgatgtcatgttgctggcaaactatccacgttcccaatacattttctataatcggagagataatagaatagtccgtactgaagatttcaacgacaaagtgccgctgttctcccatgatgattatgttcaaagcttggttctacctttaagctaccctacatttgcttgcatgaatttatgttaaattgtgtaagtgatttcagaaccttgccatttcatgtatcgacaggacagagtgtgtgaataattttggtggttccttagtttaattactttgttggatgattctatttctattggcaattgctaattgtgtgtgtctgctttggttttggcttaatttccttttcctgattgataccttgttctcatctccagtgaggcaagggaagtatttggggttccacttgaagtgcgtttagagagtagagatactcattgacataaatccactgaaaaggccaaggtcactgacagtaacaatgtattgtataactgtataagttatacatgtcatgtggctaatttgtactcaattatggttgttgcccttttgagttttgacaacaatgaaacaatgtatttttcttattatggtgcaaagtactttctttgttttacaaagttaaactgcggtgcatttcattactgaaacacatttcttataatggatatccaatacaaatgtgtacatttcattacttaaaactttacttttttgtttacatgggcatctatagttataggaagattaccaacccactctgatgcaaaatagcctttactgccaggtaccactgttagcacagttataacttggtctgtaaatgctataaaattcacatttcaatcataagatgttaaggtgtacatttaccaactcttgacactaaaataaatcatgtgctgtaaatttacaatttcaagccttccaccttggtctaaaattgctgtaacttacccagttacagtggagatatctgggccttggcagtaggaatagtttgtaatatgagtcattaggctaggtaagtttcaggcacattgcaagcgataataaggtattgtataaacagctgatcacatttttaagacttagtcttacatgccttacttgtagcagataagaaaaatggccaaattgtagctcatcacagcatactcaaattgatgtatttaataaatgcaacaggtgataatggaattattggtgagcagggtaaaataagtagacagtattcttaattttttttttaaaaaaaaatctggattcaaagtacaattgtggccatgtttactccactatttttattatttttttataatatttaaggggattgtagtaacttgaataattcattgacttcatatagtgagtaaacttaaagaagaaatattttagttttgttgaaaagtgaaaaggcaatagtatagagtatattaaccttgagtgatattatattttattttttatgggcactgttttgatcaattgaccttgagtaatgcattacgagttaaaatactccttacctgacatctttgtatttttttttctctcactctctcctttaccctctcaagtgttcaacctttgtagccaccgccaaagatggaagatgttgtcgaggacttgctaggtgtccatgtgtgattttagtttcgggtttctaatcttccatcatcttgtttttttacttcgcattttgtttttaatttgataccaatttctagggatccaaaaaatatcttttattgttaaacaatgtatattagtacaactataatttattttaaaaaaatgaatattcagttgaggaaataagtatccaattttgacctttcaattaagatgagaaataagaggaaggaaggagaaacacgtaccaagcagaaaacaacaacacgagcatatatacgaacaaaattcctttcataagaaaacccatccattacgttatcctttctacactacactgccaaacacaacataactacttccggtcaagggacaaatccaaggaaacactaatctagaaaaggcaataattttagcttattcacgcgtgtctatattgatatttttatttgataacttttttttatatttttataaacataataattatttcggaaatggttcttggtacgaaagataatacgtattaaaagtatgaatggcatgacacacgattccctttcatattgactttctttcagcaatgagccaaatatttcttattaaaatttcaatcgaagttcaagtcttccaggccttctcttcctcccttatggtagtgataacaaataaataatgtaaagcccacttataattgcaagtttttttttccttgtatttgaaaggcatcatttttttgcttattttatataggtgtccttcttatcaatgatttagggaccttctaaaaacttcataatcgaaatgtataatctattttcagaatatataccaaacataaaggacccttttgtgtcatagcacttgtgagagagcatacatgattagtgggaatctcggctagaatcagaaaaaaaaaaaattatattttatttttctaataatattttaaattattatttttaaaataattgcgttgcacatcagaaattgaaaacacacggctacacatcagctatttcttgcgttttggtctagtacattgctgtttttttatatcataatttatgcatcaacccaatgatagaaaatgcttttttcaccttagtttttgcttttcacgccccaaactttgtttgttatttctcattttttatacacctctgatggaaatgcaattttggtgtataatatacacaatgaaaatatgttttcactaaattaaggggtgcattcttcatataaaatgaaaaatgcattttagttatacacaatacacggcaaaaacacatttatgttgtataattaattttagatataaaataattctttttaaaaaatacctttttcagttcaacagggacaaataagagaaattacattaaaataaaagcggagttgacactccactaagataagctaggagcaacaaactcaacatagaaggaagttttagattcatacttttttttattcatagacaaaaggaagttgctacatcataaaatcatcctgagcatcacatgccaagtttgccaacgcataccttttagtagtaatacaaaatctaattaattatgacataactttctccttttaatagtaatcgaatatgttacaaataatttttttttcattgaaattaaattaggtatgatagaagttaacatttataataaataattgaattaactatgatacaagttactttttttaatagtaaccatcgattgattaaaaatgataatttgtgtcatcattaattcaaaagtattttatatcataattatttatattactattataacttttctgatcaattatcgttaagataatttgtatcataaagttcaccattgatgaaaagagagtattcaaacaaaattgaatgtgagggagtagagagagtgaaggcatgaaaattatatatatgtggataataaacaaatatcataaaaggcgcaaactctatatatttttgtttggagaagaccgcaaaatattttaatatgagtgactatattttggtttaaaatgaaattatcaaaagaaattgtattattttctattacagagggtaggacaacggataatacatctgttatatcgtatcggcgaaaaagaaaaaaaaaactttataacaattgtaaaataactatcatatcttttcgtatattagccaccaaaaaaactctaaactctctttggaactcatctttatattcttgatttttttttaaaaaaaaagtgaacatatgattctttttaagaggaacacgaaattatgtattcaggtttcttagggaaaaaaatatttatgtgattgatgagataattaagccaacagttcatatagaaataaataaatagaaataagactcgggtggtgtatgtaataccttgaatttcaagtacgtaactaagcctaggttaagccatacttaaagataaatgatgaggcttagtgtatttagaggaaggcttgaggaggagaggagaaaacnnnnnnnnnnttcatatagaaataaataaatagaaataagactcgggtggtgtataaatgtattagtattttttttaatcattcggttcattcaataaattatgactaatttagagtttagttaaaaaaataaataaagactaattatttttatcaatatttgaattcgagtaatatctataccattcaacattaactatttatcacttatgttgaatcacttagctataagtgtattagtatagatacaagatgataccacaaaaataaaaaaaggataaataattaaatttgtctttgaaagtgtaatgtggtgacaaataaattcttgaaagatgaaaatataaatttagtatttgaatgtgtaaaaaaataccataaattagttttgtagttaaatttgtgagactaatttgtcattaaattgtaatgttcaagaatcagtttaataataaattgtatttatggaggaccaatattatattaagttacaaagtttaagatcaatttgtcattaaattgtgtgcatgattaatttattgtactttttacatattcaagtattaaatttaaatttttcatgggaccaatttgattatttacccaaaataaaaagaaatgcttaatcaaatttttaatacttggaaaatagatcattttcatattactatctaatatatttttttccaaataagtacctaaaaaaaattatgtttcaacgcattatctgtcgttagtcccctttcattaagtgatgacgtgacagacaaaatgttaagtcattaaaccttatcactaaacacgtaagcagatacaaccatgtcattatttattaatttattaaaaaaaatcatccactgctgcctacccttctcacttgctacttttgtcattatcgccgccattgcatctacaccaaagccgtcaacgacagtgaaacctccaccattttcaagtatcctttattttcattacccttccacctccaaagaacaatcaatttagatcaaaattaaacctccattctcaatctggatctcgattgtgatacaccttataaacgaaagttttagatttttaaaaaaattctaaaattagaatgcaaatttgttttaaatgaagtgttcatatttagatcctagcaccaaacaacaccatgaaccaaccctgaaccgttgtgaaccaccacgaaactcatcaccaaaaaccattgcaaacccgccccaaagcacaacgaaaaagactacaagccactacaaaatccaccactaatcaccaccgcaaacccaccatagcggcaacaacaatgaattttcctctctttcttagatctagaaaccagagtttgttcctttctcaaattagaaaacacacacagataatctcttttatcaaatccacagaagaagaaaaaagaataaaaaaacaaagtgattctttcgtcggaactgggatcccataacgggttaggtttgagtttagagtccagggtctaggaggaataataaagatggacaacaccacaagtttggtggaattggtaaaagggggagaaagtgaaaaagaaacaaaaaaataataataaataatgacatggtcatttttgtctatgtatttagtgataaagtttcatctgttacgtcatcatttaattgaagggaactaactatatatattgcgttgaaatataattttttttcaggtatttagtttaaaaaaaaatgaatgttaagtaataatttgaaaatgatctgttttgcaaataagaaaaacttaattaagcctaaaagaagaaaaaaataaaacaaaataaaaatgggcttgggcgaaaagcgttgctgtatggtagtagtagcggtcatcctcattgggcgatggatggatagatagatataaaagactgcctcagtccgtagcataagagagagcttaaaaccctttcgctgcgcctcacccaatcctaaaaccttatctcttcttcatcttcatcttctctcaaaattcattccaatggattcttcttcttccgacccttctcttccccaaacctctcttctcgtctctgaccaatcaccctctctccctcccggttccgactctgagaacgacgatggcttcgtaagcggtgaagagggcgatttggaggccgaacccaccaagcccgttctcgtcaagtcttctgagcccgtcgtcgattctcctcccgacgagtcccacaggcccattgcgaaggtgtccggggacgatgatgacgacggttccgttgttgaggatgcgaacgacgtcgttttggaggaaggcggcgagaaaaaggaaccgggggaggcagtgaaggagggggattttagcgatagtaacgaggtctttgtggaggcctctggcggtgatgatgatattaaagagattcagagtggtggtgttgctgtggagaatggagtcgaactgagtggtactgataaagggtttgaggctgctgctgctgttgaattgaatgaggaagatgcgaaagagaaggaggtggaggagaaagttaatgacggtgtgaccgataattcggattctgtggtggatgaaaaaagtgagggtgttgatgttgaaaaggacgatggtggtggtgtggatgctgttgttgatagcgtcgaggttaatgtgttggggtctggggttgctgctgttggggatgaggtgggggttgatgagtctgagattaaagggctagacgagccggagagtcgtggggtgagtctggataatggttttgagcccattgagaagggtgaggaggaggttgttgataagcttgttgatgggggtgatgagtctgctgttgaccttgtacttgatgatcaatcgggtgctgaaggtgttgttgttggtggggatgatgtgtctgttgagaatggagttggtggagatgggttgacgagtgacattgttgttcctcccgaggaaggtggtggaggttcggagtttgttgagaaagatgaggtaaagatggagggtggtgttgttgacggagaaaatgggagccgtgtggaggagggtgataaggaggaggaggttggtcatcatggtgacagggagattgatgattcggcattggatgggaaaattgggagccatgtggaggaggttgaggagattggtgccaatggtgacagggagattaatggttcggtgtcggatgagaagggcgatggagtggtgtttggaagcaccgaggctgccaataagttcctggagaatttggaattacagcaatcacgtgccagcgggagttcccgggatgatgagaggattgatggccagattgttactgattcggacgaagaagaggagactgatgatgaaggagatggcaaagagctgtttgatactgctacattggcggctcttttgaaagcggcgtctggtgcggaccaggatggtggcagtatcacaataacctctcaagatgggtccaggcttttctctgttgagcgccctgctggtttgggatcatcgctctcgtcaggtaaacctgccatgaggcaaactcgtccgagtctttttactccttccattagtagagctagtgccatttctgataccaatttgagcgaagaggagaaaaagaaactggagaagttgcatgaaattagggtgaaatacttgagactgcttcataggctgggttttactacagaagagtcaatagcagctcaggtactgtaccggatgacacatgttgcagggaggcaaagtggtcaaatgtttagcgtagagtccgcaaaggagactgctttccagcttgaagctgaggcaagagataattttgatttttctgtaaatattctggttcttgggaaagcaggtgtgggcaagagtgctacgatcaattcaatttttggtgagacgaagaccagcattaatgcttgtggtcctgctactactgctgtgaccgaaattgttggggtggttgatggagtgaagataaggatttttgacacaccaggcctcaagtcctctgcatttgaacaaaatttcaatacaaaagtcctgtccgcggtgaagaaattgactaaaaaatctccccctgatattgtgctctatgtggatcgcctggacctgcaaactagagatatgaatgatctgccaatgttaagaacaattaccagtggcctgggttcatcaatatggcgaaatgtcatagtcactctgtcccatgctgcctctgctcctccagacgggccatctggtgccccattgagttatgatgtatttgttgctcaaagatctcatatagttcaacaaaccattggacaagctgttggggacctacgacttatgaatccgagcttaatgaatccagtttctcttgttgaaaaccatccttcttgtcggaaaaatagagatggccagaaggtgcttcctaatggtcaaacttggaggcctctcttgttgctcttatgctactcaatgaagattctttctgaagccagtaacgtttcaaaaactcaagaatcaccatttgaccagcgcaggctgtttggttttcgtcctcgctccccaccacttccatacttgttgtcttggttactgcagacacgtacctacccaaaactccctgctgatcaaggtggggctgacaatggtgattctgatattgaaatggctgatttatctgattctgatctagatgaagatgaggatgagtatgaccagctcccaccatttaagcctatgaagaaatctcaggttgctaagcttactaaagagcagcagaaagcatattttgaggagtacgattatcgggtgaaacttctacagaaaaaacaatggagagaggagttgagaaggatgagagagatgaagaaaaaaggtaacactaaagaaaatgactatggttacatggaagaagatgatcaagataatggaagtccagcagcagtgccagtaccattgcctgatatggccctgccaccatcctttgacagtgacaatccagcttatagataccgtttcttagagccaacttctcagctcctcacaaggccagtcttagacaaccatgggtgggatcatgattgtggttatgatggtgtaaacattgaacagagtctagccatcatcaataaattcccagcagctgttactgttcaggtaacaaaggataagaaagacttcagcatccacttggattcctcagttgctgcaaaacttggagagaatggatctgccatggcaggctttgacattcaaaacattggaaagcagctagcttacattgttagaggagagaccaaattaaaaaatttcaaaagaaataaaacttctgctggtgtgtctgtgacatttttgggtgaaaatgtgtctactgggctgaaagttgaggatcagattgctgtggggaaacgcttggtattagtaggtagcacaggggttgtgaagtctcaaactgattctgcttatggtgccaatgttgaagtgcggcttagagaggcagattttccaattggccaggaccagtcttcactgagcctttctcttgtgaagtggagaggagacctggctttgggggctaatcttcagtcccaattttctgttggacgaggttataaggtggctgttcgggctggattgaacaacaagctcagtggacagatcactgtgagaacaagtagctcagaccagcttcagattgcccttattgctattcttccgattgccaaggctatctacaaaaacttctggcctggggctagtgagaattattctatctactagattgtgtcttttgtttgcgttactagcaaggaaacgtagactacgagtttatcatatcatgttgcttcttttcgtgactgtcttaaataatgagttttttttttttttttgtagtttcgtctagactattgactctcctgctatagtagtgcttttatgtgcctgaaaattgtactgcaattgagatggaacctaaaaggaattgattcataaattttgttagcatctatttgaataatgttgatgtcagattatgctgttatttctgatttctttgctctataacttatgtttgttggttatacattgaaacctgattgctgagcaattcctgaatatgataatgtgcctagtttgattggcccagaaagtggtttgcaactcgtggtatctttatatatactattggctaaaggctttcttttttctcccattttatttctttcttttcctttgttttttttcctaatctccagcatgttgtgcattcttagatttctctttatgataattaacaatgcttgtctattgacatttatttgagcatgatttagcttttcaagttctgcaaatggactgaaatgcaatgtgaggtttttgatgtcctttacggaagataattttattcgagttaaggtaagatcattaatggatgacaaagcctaacgtattacattatggagaatatgatcgaatcacataatgtcagaatttattaattaataccgtttttcccattaagatgaacattacgaacttgacatcatagaataagactcaaatcgataggaaggtttgggcctgcccatgtcatttatgctgagctaaatctaggtacgtcgaggaaacgaggtttgtaattgcttctttttattaactttctctttttatttgtgtacctagttgtgtttttggtgaaataaatttaaaaaatatcttatttcctaagattaaggtctggagtttattttggtacgagtaaatgttccaacagaaaccactctagatatatattttatgtttaattgagttattgataggtaatttgttgaatgagaggttttagtcctatgatttcatttgttcaaatcaaatctccatacctttataattaattaaatctaatttaatatttaatttataatcaattttttaatgacgtgctaaagattatgtgagttgacatagtgatgtgacatttaaaaatgggatttgaaatatgcaaaaattgttttatccttgtttatgtttggttagaaaaaaagagggtttttttccaaaaattaatgagtttaacatcttcatttctttattttaatttaaatatttttctttctttattttcttttacacgatcaaactcacccttaaggttagatttgacctcactatcctttaacccacacatgagaagtattaaagacgaagaaatggataaacaaattattctttgccgtcattagtaaccatattcgtcaattatttgttaaccatgagggacctcaaagttcaaaagggaactgctggcatctttttgttgcaagtatctgattgtcttactgttacaaaaaactgcgtggtttttgttttcttatttaccagaagttgttggatcaaagaaaacttcttagtcatccttgttatttgcccttgtccacctatgaatatgattctattcttatcattaataatgctgctaaaaggttacatgacatattcaacatatatatatatatatatatatatatatatatatatatatatatattctttcatcatttaattacacggaaaaacagtcaaatcattatagacttacactaagcactgtaatcatagcccataacattcaggcatttgcttcctacaccagtcaaaatgcttatacacccagcaganatatatatatatatatatatatatatatatatatatatatatatatatatatactctttcatcatttaattacacggaaaaacagtcaaatcattatagacttacactaagcactctaatcatagcccataacattacctttcagaaaataaagaagcccatagcatttaggatttaagtagagctcctttaaattgtggtataatataatataatgttacaaaagaggcgcatcatatatgaattagaactaattaatcaataaatgcatttccctatcatggacaatcagcacttctacaatcagcctacttgtgtttttcttttatcgctcttctaaacaaaagatatagtataacaaaatttggaaattgacggagtcaaattttgtaacaattaccaaaagtgagtaccgataaaatcatgtttgggaatcttattcagaaatacaataataatgcttttgacttcaacaacttcttaattagttgcgacccagaatttgaattaccaagaacatgaaaagtttagattcataaccttttgttcacatatgaattgatactgatcgtggaatgaaccttacgttacctgctcaccattcttcaaatagcatcaatttattctgatgattcactattataagcgcattccaaattctgaagattatgaacaattgtcttggcggcttgacttgattccagcaataatttagtagtataacttatatataaaaaatacatttcagtccagaggacttgcatgatttcaatcctaagttttttttatagacattctagttaaattatggatgatattatcaagctagtgtgtgttaatattgcattattcttaatcccaaacattaaaatccacaaatttgaagtaaatgaatttcttattgagtatagaaatgtgtcaagtcaaattctatacccatatcatatctccatgaggcctaacaatttcagggagttttcaacatagtcaacacccagagtaaaactattccaaacaaacatcaaactttaggcgctctgtgttgcactaccaacatcactataagacatacacatttaatatgtctagtcagaaatatggccaccaaattaatcaattttaagatacaagtctaagatcaagttgaatgaaaatagagggattctaaaacacattttacctaaaaatacaattaaatacaataaaattatctgaagaccagttttttatgtgaaaatcaattggctaagttaattttattataattattaaaaatgtaagatagttattataacagttaaattatttaattataatattaatacaattaacttggccaattggatttccaaaaaaaaatatatggttagttaagtagagaaatttattatttattattaaattttgggtgatatgtatttttagtcaattttatctagtatcttaaaattaatgaatttaattctcacatttttaaataactttttgatgtaacatgatagctatattatacgtaacaatcatgtgattaacactttattgtagccacgccaataaataaatttaatgacattataagtgaaagtttaattccacaagtttttagaaatgcaaggatcacttttattaattttgaaatacaaagagtatgatcaaatctgattaaaaataaaaggacttaaaatatatttattttttaataataaatgactaaattaaccaactattggaatgaattttgtccatctcaacataatattttttattttcatttttcctcgctaaagctcctcacatgagcttccttcttctctctctctctctctctctcttatattcacgtgagcttcctttatgacccacccttggaaaatatataaataaatataggcaaatattaaagagttcttgcgatattgattaaaaaattttaaaaaaatatttttattaaaatatgtaaaattatattatttatgatttcttttacactttttcttacaatttttacaataaatgttttttatttttttttaattaatatcctaaaaatactgattagtaatacccataaatataaaagaatgaatcaatttatgcatgttgaattgatgatacaagacagccaagttgggaatttaattattaatcgatattatgtagggtaaataaacacatcggagtataacttgccatttaaattcacagtattttgttaaataccacaactaaccatgacaataataaatgatatcttgttataattaattgcagtgacattacataaacaacctatatataatcgatttttcagactcaaaactgtcgacatgccctttcacacttctttccatctttatatttccttccaattaagtatctcatcataggctttccaatccaagcttctaatataggtgcaatgtcacacaaaaagagagtaaaaaactctatccaatttctatgtatatcaacctagcttacatatttcttgtcgtgcatggatccctttgcgacacctcaagaacaagagtaagattcaggaaaggtgtaaaatgaaagtaatgacattctagagtgagaaagttggtgggaggggtcttgtaaagaaaatagaccatcactcatcacccaaaagtctaggacactcttttggtgcatgtcaagaaatagatcatcacccatcgtccaccaaggaacaaaaaagccttaggtccccccttgggacttgaaggggatctctaccttaatttatatttgtttttctattaagaaattaatgtattataatatgaaaaggagatttcagtggacccaacacgacccattaccctaaaactcctcctctccaagaagttatgggcacaaattgatttatccagaaggatgcaatcatgcaaagctatgcgtctatttaattacagattattacataagataattttattgatttttatataataattattcttaaaattatatttattactataactttttatttacagtgtacttttttttatcttgtcctattattctcttttgatatgaaacatgtaaacttttattgtggtccaaagtcagcaaatgagaaataaagttgagggaggagatcttccaacccaatacaatgcttacatttcattcaggccaaggcatccctcactcaattacgtacgtaacgtgggagtatttcgtatgaattttcatagttggcaccgaacgaattttcaaacaaagatgttgctagtatttcgtacgaatttgttaataccaaaatgtcacaaaccaatcatgatgtgtataaatcacacgtatagatgagttaaaatgaaaaagaaattacctgtcaaattgtatgaatttaatttgtactcttttgtctagtttgttttcgtattctttatcattttccaatttcaaatcctcgtaatgccgtaatgggccaagtaaaaaggtattcattgcaatttgccttattatggatttgttttctagagaaagtaccaaaagtaaattgcattacgtgcatcgcccattttttttttaaaattatgattggatttgattgtttaaagaaaggaagacttctagttttctgctcaatgttttaattataaatcatttttaaatgtgtaaataaataattttaaacgttaaataaataagtagtataataattacaaggctaaattactaatgtaatctctctatttatttaattactttaacttgggctatctattattaaaattgtaatttgtttccttaaatttcaaaattgatgcaatgttctccattctgcaatatctttttttaaagattgttatttttatgcatcagaaaatttgtaacttatgtttttttatcaactttttttctttttaacttcataatagtattttttatgtaaaagttaaaaaaaattattgcataaaaacaaaattaattatcttaaaatcacttttaagcaaatttatgcaaacaaaagttggtgtaattataatcgattatttaaataatctaaatttttataattattcgagacgtacccctttctcaattataccattaatcaaggaaataattttattaaaacgcgttcttttatattttttaaagacattatcatatgatttttaataaaatctttcctcttttaattatttaaccaaatatccttagaatacttgttagcaagactctaaatgaaaaatggtaaatagaaaaaaaaaacttaataactaatattttatatnaaaagattacatttgttgattttcataaaaaaaaaacctttaaatgacatttgtaaaagaacaaagatagtaaaaaaatagagtaactaatttaacatttatatatcattaacggatactataaaagtggttgtaggattagaattcaagaccatcaagttagaattactgtgtgtttggataccaagcataaacaatctcaactccaaaaaccatagtgaaaacttgaacagttaaaagtaacaaaaaagagttgttttgttgtgattgtaaaaaataattgaggtgcgataaacacaccgtatactcaaacacgcattcaattgattcacatactcaagtgattaaaaggaagactaaaagcaaaatgtaaattcttaaacttagtcctactaatcaatatggtttttgacattacaaaaaaactgtactagtatttatttgaatacatcttgttgtggcagatgtacgtgcaattaggttattattcccttaaccgcgagatgctgtttttaggtcaaagttagcaaacctgcaacctttacaccctacaccacactctgcaacaaccagcacaccaaacgcttgtccatatcttcctgtctgctatctcccttcaagcctaacgtaccatgtctacatccccatctctctctcatctatgcacatgcatcacatgccccccactcatgcatgcatcacaacccatcaacatttaatttcaaaccatttctcatgaaatgaaatggttttatcccacggattaaccctatacccaaattgttaccaccacctttttttttttctttttcttttaaattcacatgttgaattaactactttgcacctaacgttttgaaataacgaattagctaattttgtaccaagcgttgctttaattgatccacagacaaaatgtactttcaccaatatctttgtcttgctcaaagaggagatagattattaattaagcatttttttaagccaaaaggcttcctcattaaatagatgcgtcatatactattttttcctctctaattctgttttaattttattacaaaagtaatacagaataaatagtaataaataatcatcaagagggaggaaaacccctatcatctttaaatataatttggaaatcataatttaacttaataaaattgatttcttttataaagaatctaactcagttaactaaatataaaattagtatttttattcttacaaataaaaaagtatttataatttatcagaaattattagtatctcaatatcttgttattactttttacaagagcatctgagtaaatttttggctattatttttacaagactccttctatattttctattactttaattgttttatttcaaggtcaggttttacttttggtagtagttcttgatatattctaggaaaggttttaggatttctggaagtttttctataaatacttttagaaaaagaaaataaaaagaagaaaaatgaaatgagtttttttataagttaaaatgagttttttattagctactttgtaaatgttatcccatcttttgaagaagctatattggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtatagatgagttaaaatgaaaaagaaattacctgtcaaattgtatgaatttaatttgtactcttttgtctagtttgttttcgtattctttatcattttccaatttcaaatcctcgtaatgccgtaatgggccaagtaaaaaggtattcattgcaatttgccttattatggatttgttttctagagaaagtaccaaaagtaaattgcattacgtgcatcgcccattttttttttaaaattatgattggatttgattgtttaaagaaaggaagacttctagttttctgctcaatgttttaattataaatcatttttaaatgtgtaaataaataattttaaacgttaaataaataagtagtataataattacaaggctaaattactaatgtaatctctctatttatttaattactttaacttgggctatctattattaaaattgtaatttgtttccttaaatttcaaaattgatgcaatgttctccattctgcaatatctttttttaaagattgttatttttatgcatcagaaaatttgtaacttatgtttttttatcaactttttttctttttaacttcataatagtattttttatgtaaaagttaaaaaaaattattgcataaaaacaaaattaattatcttaaaatcacttttaagcaaatttatgcnnnnnnnnnnnnnnnnnnnnnnnnnnnnnnnnnnnnnnnnnnnnnnnnnnnnnnnnnnnnnnnnnnnnnnnnnnnnnnnnnnnaaaatatcataaaaatgattgtcaacctgattgtgattaaatcaaaatattggtaaacttttattaaattattctgtcatattcaaaatttggtaaaatataatttaatctcattttttatcattataagtataatattataataaatacttaaaaaaaatataaaaataagtataagttataataaatataatattaattaatatacactaataattttggtaaaccttataaaaaatgagaaattaagttaattgttataaaaaatgagacccaccttacatttattaattaatattatatttattattattttttctattttttaaatatttatgataatgttatatttataatgataaaaagaaaaaaaaaataaagattaaattatattttattcttaaatgaaacaaaatttaaaatctgatcaattagtctaatgaaaatttaatgacatttttttagtctaatatattcaacacccaaattgataattatttttatgatatttttgttggtgttatattaattctttcattaatattaataatcaaacttaatgaatgaataaattatcatatttttttattttcaaaaattaaaatttttattttttggaaatgaatctgtgaattctctcatatattttggcatcacacaatatcatataaagagatcgagacaagggttttgcaaaaaaaaaaaaatccaagtaaatttaaggagccaccactgttccaaccagcccctttcattttacagtgcctgtttgttttttcgtgtttgcattcactgttctacagaagcaaaaaagagtgcttttgttccatctctttctgtgggtgtgtctcgagattggtgtgtatgctcaagataaagctcactcactcagtcacagcagcaacaaccctttttccttaactcttgaaactgtgttcaaagtttggattttgagagagcatgatctgatgaaggaatgtggaggctctcttgggggagagggcaaggaagaagaggactactgaaaacaagtgttgcctttttgaaccccaaaaaatacgtttttttttttggttttgttgttatggcactttgtatgcagagtcagcagagagattcagcatcaaacaagcagctcatggattgtggcaagtatgtgaggtacacacctgaacaggtggaggctttggagagggtgtatgttgaatgtccaaagcctagttcttccagaaggcaacaaatcattagggagtgtccactacttgctaacattgaaacaaagcagatcaaagtgtggttccagaatcgcaggtagggaagaagagaaccaaaacatgcatatcattgtttggtttcaaccttgccacatcataaaaaaaaactatttttgtcatgttttgtgttgtgtgtgtgtcctatggttgaggatgctcaagggtgtttctgagcttctttctctttgtaaagttgagttttttggtttagtatatttgttattcagtgtttttttttgcctttttttccttttcaaaaatggaatgtcataaagtgatgtttcattatttgcattttttttaaatgtgttatttgggttcaattttagagaaaacagagtaagtcatccctcttgaaaggaagatctactgggaaagttacttaatttttgtcattttccttgtggttatccaactagttaagatcgatcgtttttatttatttatttccctcgaaaaggagtttcttttctggagttgattaaatgggagataatgacagctgactgttcatttttgttgatgagtttttttactgctttcttctgaccttcatcatttttgttttagaccattttctgatgtttctgtgtaagatgctttaacagaaatgttcatatgatcatttggcttttgttttggtgttggtcatagataagaggaaggataataacagctgattttaacgacttctcccactagattaatcagttttcaactttagcttctttttttctttcatttttcctctttaaagattttttttttcaggtctctaatattttctctttttgaattacggaagagaggagattatgttttgttctacactctaaacttttctcgaactaatttttcaccttgtccctgcattagtatttttttattaaatcaacatgcatatatcatgtttccaaccttttatctgcaattctgcattgactgattaaaacaagttttagtcttggtccgatagtaggtatctgaatttagtatgtaattcttgttaaggatattcacatgtataatattcttggtctgatagtgtaagggacttgtccaatagtaaagtgggaaacttcaaagagtgaaatgaataatgaatgattatcatacaatgttatggtaaattgtatgggaaagatgacctactctacctgccttacactctgccaattttcttctgtagatgtcgtgaaaagcagcggaaggaagcctctcgtctgcagacagtgaatagaaagctgtctgcaatgaacaagttgttaatggaagagaatgaccgactgcagaagcaggtctcacagttggtttatgataatggattcatgaaacaacaaatacatactgtgagtaactttatctttgagtgattgctcttctcaattatcattctgaatgttcattggtgtaccattctatctatatacaagtatatgtgtagtgtactattttattgttattgaagaatctcatttactggtttcttaacaggcatctgctactactactactactgagaatagctgtgagtctgtggtagtgagtggtcaacaccaacagcaaaaccccaaaactcagcatccccagtgggatgccaacaacccagctgggtaagtaacttcataatgcaaacaaatttgtttaattaatatatactccttcaccatcgtcacgagtctccaattctttattctgccagtcttcttgcaattgctcaggagaccctggcggagttcctttccaaagctactggaactgctgtcaactgggtccagatgattgggatgaaggtatgacttattcaaaaactcttcttcatggtcattgctggcataaatgtattggtataattatattttgcctcattttttctgtcttaatgtagcctggtccggattctattggaattgttgctgtttcccgcaactgtagtggggtagcggcaagagcctgtggccttgtgagcctagagcccacaaaggtattatgctgtaatgaagcttattcattgcagaattattttctttgctgaacaatgaaaccttgttttattgaactaattgctttccacatcatctcaggttgccgagattctcaaagatcgtccatcatggtatcgtgactgtcgatgcctcaatgtattgagtgtagtccccacagggaatgggggcacaatagagcttatgtacatgcaggtctactgattattttatgcaaaaaaagaagttgaactgttgtttaaattacttttaaattattcctctgttgtttttcttgatatttaaatttgatttttttccagacatatgcaccaacaacattggcagctgcaagagacttctggactctcagatacactactagtttggaagatgggggtcttgtggtactgagtggaatcttgattgttgtgtttttcttgatttactgtggcttctttcctaggaagagtttgtctcaacagaatgactattatttttttggccttgcagatttgtgagaggtccttgacttcttcaactggtggccccacagggccagctgtttcaaacttcatacgagctgaaatgcttcccagtggctatctaattagatcctgtgagggtggtggatctattattcacattgttgatcatgttgatttagatgtaaggaagattatgctattcaaatcattttttaaatttccatatatttgaacttcttcttcctacgtatattaactttgtttttgatgtaggttttgagtgttcctgaagtactgagacccctctacgaatcaccaaaattcttggctcagaaattgactactgctgtgagatttcttctaaccctgcattatatgtttcaccatgacaaaagctgttgatttaaatttcaaatattattgtgcaggccttgcgacatgcaagacaaattgcacaggaatcaagtggagaagttcaatatggtgggggtcgtcagcctgctgtcttgaggacatttagtcaaaggctttgcaagtaaggccctttcatatttggtggttgcatagttgggcatatgattaatcactttgtcttcatcaatccttactgaccaataattttttaaaatttgatttagagggttcaatgatgctgtcaacgggtttgtggatgatggttggtcactgatgggtaatgatggggtggaagatgtgaccatagccataaactcatctccaaacaagtttttcggttcccattacaatacatcaatgcttccagcatttggaggtggggtactgtgtgccaaggcatcgatgctgctacaggtacttctcagaccaatctatgaggaaattatcattgttctctaaattaactctagtatagtagcagcaatcaattccaagaactcttgctccttgttcccccatgtcccaacctgctagaatcttctggatttttgtagtgtttatcttcattatactcaattataaaacggtgttctgcagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccaagcagccacgtcattataccacttgctcatactattgagcatgaggaggtattaatcattttcagggaatgattgatgaacttcattttataatttttatttatttatatggtcattttccacccactacaatgatgcagttcttggaggtagttcgtattgagggtaatgcatttccccctgatgatgtagctttggcatgtgatatgtatctaatgcaggtaaagtcatttttgtgtttgggttgtttgtctgcttatcttatttaagcaggaacttgatgttactgtgaatgatttttatgtaccttattatgcaatttgatgtggcagctgtgcagtggaatcgatgaaaatgcaattggagcgtgtgcacagcttgtgtttgcacctatcgatgaatcatttgcagatgatgctctcttactgccttctggtttccgcataataccattggatcctaaaacagttagtgacatttctcagtagcttgatagttttaagggaattggtcatgaagttattttgttaggttttttaatgtttaattgccatttcactacttcattttatctttagtttgagggtctaaaattagcatgaaccatccaggttgtgaattcataattgtcatatcttggtgcttcttttatacaatttatatctagactgtgattggccgactaaatttatctatcttgaagtcttagttcacatttgtttcaatgaagtaatttgggcttttagcaaaaccaagcctttcttacagatgctatgctactacatttgagcatgcattgactaacaagatttcttttttctgtatgttttgcttttcaggatggtctggcttcaactaagacattggacttagcgtcaacactggaaacaggatctggtaatgcccgctcagctggtgaaagtgatttgaataactacaaccttaggtcggtcctcacaattgcatttcaatttacctttgagaaccatttgctggacaatgtggctgttatggctcgccagtatgtgcgtaatgttgtgcgatctgttcagagggttgccatggcaattgctccctcaaggctcagtacacagttggggccaaagtcacttcctggtccaccagaggctcttaccttagcaagatggatctgcagaagctacaggtttacaatcttccattaatcttgtctgtaagtctatttttgtaatgattaatgtattttcctaaattatttgatatccttgtcttgagttgtcttcaaggttagttaaagtacctatagagaacttaccttgtatttgttaacttggttattcaccttgtatttgtaatttttagctgtgtcctgtaattgtctgaaaaaggctcagtttcagatacaaattgcacaaatttcaccatcttatttcttgtgtctggtatgatatagtaaagattgtttttttcaggctccacacctgcacagagcttttcagcgttgagtccacatctggtgatgcaatcttgaaaaaactttggcaccatccagatgcaatattgtgctgttctgtaaaaacaaatgtaaatcacttgctgcatctatataatcctaatctgcctcaatttttatttttttccagaagtttcttgtttttagtccaataaactccagcaagtaagacatttgagtgccaaaattatgcaggcatctccagtgttcacctttgcaaaccaagctggacttgacatgcttgaaaccactcttgttgctcttcaagacataatgctggataaagttcttgatgaagctggcaggaaggttctctgcattgagttctccaagataatgctacaggtgattcacttgtaaactaacacatgtcctagtctttttagggtgtactttttttttattggcaaatgttagttgttagaatgttagttttgttagctgagggggatcaaagttttgacattttctccattcccttctcccttaaccaatccaccttatatctccttttagtgtgtacttgtaagaagttgtttacatcttttttcaagtcttgactataattagtgctcttatcttatttgtcctttttcatatcagggatttgcatatctgccagcaggaatatgtgtatcaagtatgaatcgaccagtgtcttttgagcaggccattgcatggaaagttctcgatgatgatgattccaatcactgccttgccttcgtgttcatgaactggtcttttgtctgatggggggggaaccatcatttagatactttattatatctattaatttatattttgagtactttactaagatattgtcacatcaacatcgaatgtaactaatgtctggatttcgtgaactcatggttgtgtgtgccattagattagctttgctctatgcttttacgaaggatgtacctttcttactatataaactccttgttgaagtatagcctacttattcgcaaaaattatcctttagtggcagtttagtttttatatttatttatgtagagtagttactcagtcttttaatttataaatctcacatatatctttttggtttttaattgaactctgcggcattgtgatttatgtagaccttcctagaataaggttttttattgtcttgatatctttgtagatattagagtgagatgcaaaagtaggattcttttcgttttaaaataagtcagatttagattgtgttacttatattaaaaaaaaagttaataaataaataaaagtgataattttacaaaattagttttagtattaatattacattgaaagactatagggatatttattgggaatattagtaaataaaagtaattaatatcatgttaaaaagttaaatatgaaatttactttggataattttttttctcaaatgtgatgcttaatttggtaaattcatgaattaaactgcgaatgtcggacttgaatttgtcaaaatactgcctaaaatatgaaattacagaaggtatatcatggattgactgcttaacaagcttgatttgtaggtgtaatgtgttgaattagggtttttctttgcaccttattttagaggcgttttgattttgacaacagatccagcaggattgcattgttgcattattattgttcccggaacatgtcatgattgtgttttacttgtttgttgaaggaagcgtgtcttgatttcgacagaaatcaatataatgagtgagatcttagaaggaatgttttatgaccaaatttctacctatttatcgtttgtatttctatttatggtctgaggaaattcaactttctgtctgtcacaattctttcttttcaaacaagtaatgtgaaattctgaactcccttgcagtgggttttgatgttaaacttaagattcaagtagtgcctcttccttctagagaatttaaaactaagatatatttttcttatttaaaatattacatctttttaaagagactattttaatatgattgagtgtgttaacaacagtgaattatgattgaatcaataataaataccacttaccagtaaccaaatagatttatttatttatacttgaccaggaaaaactatgacacaaaaattagaagtttattgatcactaatttgattaaaatgtttgtgatgtgaagcagatttacaagtgacaatatgaatttcctagaaaagtagaaaaataagaattgtatccgaatctagccatgtaacaggtatttgtattgtacctgtgctataatatgcatctggagcagcttgaaattttgtctcagttacatatttgccataatggattctctttgagagagcctgcagtcacaagaaaacaaaagttttcatcaatgtaacagccaaaatttatgattacaatctctacttactaagagaaatttctgaagttttcaaaataaagcaagctaaatgttgactaaggaaactcgcaagttacaataattctctctatggaaaccaagcactttcatgcagaactttgcacgaggcctgatcctgttttgggagtcaccacatagtacagagtttaccttcttaggaaaaaatttccactaatatgatcctgttataatcaagatcactttttttgttctggcgtgaaaatgattgtttcaaaaatatcaaaccaattggtcttgacattgcacatgtaaaaagttaagttaaataccaaaatagaaataaaaaaggatatgaaatgatggtatagaatatagatagatacgtatataattgataataatactatgcttcctttaatatgaagtaaattaaataattcaaaacacaaggtggtacaacccctggacatcatttcaatatagaaatgaatttaactaaaaggcaactaatgtgtaccagcaagcatattgtaagtttacaacaaaaacaacatggaatctagagttaacatcatctcccttcttggctattagtcggataggaactctgaggtgaaacctcaatactttatcattatattaattgaatcagcaatagggtgcaacacctattcatacacgacaaagaaattcagtatagatgcaattagcacataaaagatgaaccaacaaattcattaaatatgtagcacacacagacatttgctagatttttagcaacaatagtaaataattatttcatgtcacctgactaaatagatagcaatgaaacaaacacatgctgaactctgaatcaaaccatgcctaaactggaaggtgaaaattaacatgaacaacattaatattgtaaaccaataattcacacaataaaattacccatgataaaacaaagtaaactcgaatagaaaattgttaggccagccaattgatctcctaatattatcaagggattttatgcttatctatttttgttattaattagacttgtctgtttgttattaatttgaattatatttgctttgaattgatgataacatatcaagttgttatatacaggttgttaacctgaatcttatcttttgtaatcttttgtgtatatatacacctccaactccaaagcaatagaaaggctgagtcattatcattcaattatgagtaatgatagacgtacaacaatttcttcaataaattgtacaacgaatgtcgtgtcagccaaaaaaatcaaattttaattttaattttaatgaaaaaaaaaccatcggaagaaattatatgggaccaccaaggcaactatggttctaataagtaattttgtgatacatggacaaactaagatacaacaaacagaaaggtaacagtgttatcttttaacagaataatatcaaatttaaatcttccttaattaaattaacccaaatcttttacaaatcacatttatgattgatatcaaattcaaaactttcaaaagtaatactactctatcatcaagtttgtttatcttctcccacgttttgaaaatcataaatgttttgtcattgttataccgtgaaacaaccacgaaaactctgccattaattatgcatggtttatgcatggttgcttcccagaacaacaatgatagaggtggagataagagagaccataaaacatgaaaatctgattatttgtttttggtataaaaaatgtaattagtattattgaacagtgattattttttttgttaatggaaacttaattatcttttttgtttgttattaaaattaaaatttgattttttttggctgatgtaacatttgttttacaatctgttgtaaaaaaatttgttcgtctatcattgctcttcaattatctactacaaaaatgtttaattaatttaaatggactaaaaaaacagtacaaagggacattgataataaattattatttgcgtacacatccttactcttattgatatagtcaagactgtcaagttctgaccatatccattgtactccgatgcctccaaatttcatcattttaccttattttaataattacacagagcattggtcataccgattttgtactaaagtttacacacgactagaatagagacagttaggtaatgccaatgtcacactcatcactcatgctttgtctgtttaggaactttttttttatttagatggtgaaaattggttttattttttttaatcattaaatgtgtgtttggattatcgttgatagaattgatgttagatcaacttggttttaaattaacatgattttatataattaattttgaagtaacttaatttttgtttggataacatatattaaaaaattgatttttcaaaaaattaatgtttgaatagtttgagtcataattgattttaagtgtcaaattattaaaatagactttaatgtctttgaatatttatttgttattataatttgctgtttatatatatatatatatatatataaacaaattaaaattaaatagatatataactgacctttgagctactactcttaccattttttaagaaaatgatttttttatatatattattaactgacctttgagttaagagagtccagtatagtattatctgtaacacagcacaagattccagcacaatgttcgtactactcgttcaatgcagatcctatgaactatgaagtgaagatggtaataatctttctttaattgagagaacaagtaaatataataataaattttcaactaccaaaataaatgaaggtccaaggaaatataataaatgcaaataaaaaataagaagaaagaatgtacttgttcaattacttaagtatagcattttgcaaaaagtataaaaagtacaaggattttattgtggggaatatatacataatgatattttatattttcttgaatcaaaatcactgtaatttattgtggttacatccccaaaccaaacatgctctaaatgattgctaaaacccaaccttccctcatgttcttagatggcatgtctcaatttttttttaccttaatgactcttttcttctgaataatatcaaaaataaataaaatagcagcatgtgaaaaacattttgtcatgttttaaacatttaaaaaaattatatgtaaataaaaataaaatatttcatgtattaataaatcacgtgtattatattaaaatttatttatttattaaaatataatttataaaatattttcaatgtaattttttttcaaaattcataagatattctagaaaattattaatattgttttttccattttggtaacatttatgaaataataataagtattttagacattaaatacaaattatcaatatatggctaacataactttagaaaaataaattaagtattaataatataaaatattttttatattattaattaatcataaattatcatataaaatatatattattataataaatatcttaaaaattatactatcattaattttaattgattaagtaaaattattttatattattgatggatgtgattaaattctaatttttaataggataactctactgtcattgtagtaaaactttttttatttgttttcttactaataatattctaaaaacttagacccgttagtttattcaggtgaatggacaaatgttttcaaacaatataaaaggtcttatttaatttttatgttccacaaagcccattttcaccctatggccataaacactttctcacaccacaatgcagcacttgcgttaactgccagaaatagttaattaaatttttaatacaggaagatcttgcactggaagtgggccccactggatcttcagctgcatttaaagctagtataacattagcatccatcccatgtatgtatacgtatgaatgtttatgtatatgtcctaaacatatcatgcatcattcgatattatcatgcatgatgaattgatcacatgtcactacttttttgtgtctgtgttttccttttatttttccgaaatttggattgtccccggttaagtaaaaggacccttaatttttttttataagataacaatgatacatgaatttaaatcattttaattacaaatacaaattacaaacaattacatttaaattatttttatttgaaatattgttttcactttgttattttttattaatgctaaggctaaagttaaggaacaaatttatcaccgcattaatttcaaaacaggtaaataaatagactaacttttcaactttacaaaatcaaatattaagtatatgaatcaactcatataatattattttaatttaattaaaagtttcgaattcaaattttaatacgcaacacttaagaagaattttattatacataataattttatctaattcgataaaaaaataaaaaaaaaaactccacaaactcggtctccattccattttaacaagttggatccctttatttattcctctctcttatggtgcctctttatgatcgtcccaaaagtaaacacgtagatcttattagcatcaatgtgtggggaaaaagagagattcaaaataagcacaattttgcatgcagtgtttaatatggcttctgagcatgtaaaagttggaaagatatactgtagctctcaaaatccaaggaaagtgcgtatctaaattcctagctcttgtaatgtcacgttagggagtgagattccagatgcaaaaaagaaacacacatcgttgtcttgcagccttgcaggttttaaaagactaatcaaaacaacaaattaaagcactggagaagaagaaatcaaatactagtggggtaggaggatatttgtgttctgttctgtcatcatctgtgaacttttcactgttttaaacatttccgtgaactcaactgggtattaatttctacctcttttgcttcaaatatgtaatatggtacataataatcttttggttctcttaattggttactgtaagatggaaacaaccggctcgttcgtgtgtgtgtgtgtgtctgaataggactttttggattgttttgtttgtttcggttctagagttaataattattgttgttttattgtttttgggattttgtgttgggtcacggctactcaccctgtgaactttgggttaataacttttcttttgtcataacgacaatgaccttaagatttaagaatgctataaaacataacttattacagtagatcattttgcaattagggtttctttggtttaatttgtgatttaaccactctttgaagatcttttaactgaaaatcaaacatacacttaatctcttaaagtaggattattaattttattatgtactacctctagacttaaaatccatgtatacatatatatatatatatacatatatatatatatataaaagacaaaactaaagaacagaaggcagcccataaatttctggactagtcatgataagtgagaaaacttatagtatatataggtagataaataggtcagaaagggtggctcatgcggaatgaccgaatgatgttaatattaagcactttcatattgtccatatttagataaactccttgctaaacatttataagtaaagaaaaaaaaaacttaaaaggaaattgctaacatactttcacttttttcaattggaataggttaacaataccaaaagttttggacaaaaaattagttttttgttttaataaatttctttaggaatattaaagtcatttagtatttattttatttataaaaaaaaaactctttctctctctcatctgtcatatctctcatcgatctgttaccttacctctttgcatttcaccaaaaaatttcagacttcaacatttcgttaactctcaagagtttggttctaaaggtgacaggaacaccatcatcgactttgggggcacctttccgttcattcaatccgttaagtatttggttgcccaagaatttgagaacctgttggccaattacaatagaaccaaaaaaaaaaaaaatagaatgaatgttaaatgactttaatatcccttaagtaatttattaaaacaaaaaaaatacttttttttttccaaattttttggtgtagataacctactccaactgaaaaagtgtgagtattagtaattctcaaatttaaaatgtccatatacttattcaaaagcaaatttagaaacagtttttaagcattttcaatagactcttgttatttacaccctcatactccctttctacctcttaactattcatcatattatttttcttaaagaattacacattttttattttttggaaatgtatttctaaaattacatatacccattttgaaaatgtatcttcggaattataattcataatttcaaagatatacttttgaaatatgtatatatttttaataaatatcacttaagaattaagatgattgatgagaaataaaaaaaaatgattaatatttatcttatatccatatttgttagttttattttcattctatcattagttatctttaaatcttatctaaaatcttatttttcatcttatctttattatcctttaaattctaattttaaattatcttcactatatattcattatataataatgcgttttcatcattactatacaatattttgtatttttcttcatgtaaaaaggcatttcaaggaaagttcatcactaacttcatgtgggactgaatcattgatatagacttgaattaaatgaatgcacttaaaggaaataaactattgtcaaaagctttgctttgtaattaaggtgtataaaatataaagttaatgatgattgtaccttgaaacatagtgccacatgaagaaaaatacaaaatattgtataatgatgatgaaaacccagtattatataataaatatatggtcaagatagtttagaattagggtttcaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataaagataagatgaaaataagattttagataggatttgaagagtactgatgataggatgaaaataatactaacaaatatggatataagataaatatttatcatttttttatttatcatcaatcatcttaattcttaagtgatattttattaaaaatatatacatattttagaggtatatttctagaactatgaattatagttctcaaaatacattttcaaaatatgtatatatacttctagaaatacatttccagaaaacaaaaagggtgtatttctttaagaaaaagggtataatgaataattgggaggtagaaagggagcatggggtgtacttagaaatatgaagtgtaaataataagagcctttaatattagaattttatttcatgaatcttgttaacttttaacgtgatccagatccagaagcataacaaattggacccataggctcggtttggtgctaatcaaacgatgcgttttgcggtgttaacgaaagagaaagacaatgaaggaggtagagcaagtgcagttttgttttattggttgagaagagaaaagaagagaataatgtcgtcagagaaggaaacagagagtcggaagttgggttcggaagaaatttcgcgcgagttcaaaaccctagtcagctccaatgatctccactcccttaaccacatgcaacacaccatgtgcgtgtcacaatctccaattcaatttgtttgtaactttgtgtgttcgttaattgattgattgaaatgtgtttcagattgggaaggttgcaggacagcaatgcggtcttgtcgcatttcaatgacttctctcagcactgcttcgctgagatttccggcgacatcgctagaaacacgcgtgttttgaagtctgtcaagtctgaccttgattacatctttcagaaactcaggtattctttttcttttcatagccttggttactctccatgttagtaggtttgtgaaatatgggttccaacttttctatcattcttgtaaggctataaatatatatatgaccatattagttcatcaatataggccaagtttttatactctttactattttgagtaactagcaagtgatattagagccccaatcaaaatggcctgattctttatagagacttggagagaatatggcaacaaatagtggatttttgccaccagttattccaaagtttggtggactgattacttgagtatgctcatggagaattttctgcaatctaattgaggaaggagttcaacatagtgaagcacaaaagaaagccattgagggtgcaagagtgaaagatatgaaggcaaaaaattatctcttccgaagcaacgggatcaatgctagagaccatttttgaacaatatatatctaaaagcatctaggacgcctggaagaaaaagaatcaagggacagtgcaagtatagtgttgggaatgtcaattgcaaatttccaaactttaattcaggtgagtggttttgagatataataaattgatgaggaaaaagtggtgactattttgtgtgtgtgatgataatttctaagggggttgagtattggaattgtaagaaatacttaatcggtgtttatccaaaaactcttcaaaagtcatttgccgccattataagagaaaatccctgtgaagagaagagacaccaccttaagttgaagggggttcatatgaaggaccgaaaatcttaaatagaagagatgtgaagcaaagatgtgagaagatctcttgtgagtgagagtgttatcatcccttgtaactcttgagtgggagactcgcgtttgtagggtgataaactatttggggagggtattttcaaatttgtccagaaaacttgtaatcttatttgagatggtgcatatttgttgagatgtttttgtggatgtaggcaggtggtgtcaaactattaaaattatgtgtctttcactatttctatcagtagtgtgttttttgtgtgtgatcctatagtcaatctttcttgctgcagtttcttgcacctgtcaaatcatttacataaggagaattttgaataattttaatcctgatcaaagtgatggcacaacaattttctatgacagttattcagcaattgagctttcaaaaagtcatgtttttcatggccatagctagcacatagatgtcagatttcactttcttcgtgatctcacagggggtggagttgtaaagttagtccactgtcatactcaagaacaatttgcgaatatagtgaccaagccattaaagcttgatttgcatgtaaagctttgaggtctttgaggagtatgtgttggtccaaatgtaaactgaatgatttgatattcagtttaagggaggatgttgaattgttaacatttgcattagtttgactttgaactagtctttagatattttagtgatttccctctcttttagaaattagatattgacttccattttaatctcctcattagtaggttttactgggctgcaactttatgttattcttgtacatctatatatatggttatattatttttatcaacatagctcaaattttatctctctcactattttgagcacctacatgtaaaaatgtcctaatttgaagatgatagttgagaagggagtaagaagcaagtggatgattttgttttatattttgaagaacttattcttatatgctatgttcaaagggtgttattgtgaagctaggttatcgatagcggccgtcgcgatcgtggatgtcgtggccgcgatttggtttgttagacctaggtcgaaaatacactcagtatttaaagggctgggttacgttcttgtgcgacttgccttgactacttccctgtgcgaccttcgttcactccgacagtacctgctccggccagcagctcttccttctccggcggcactttgttctccttctccgtcgaggttctgttttcttactttctttctctccttcttcatcggtgtctcacattctcaccgtctctttcctttttggttacctctgtttcttctttttcttttcgttacttctgtttcttcttctttgtcttccttccctttccttgtcgttttcatgtcctctgcctccgccgtgctcaaccgagaaagagagaaatcgagaagaagtcaacgaggtctcatgggttgggagagaaagagtttttttataaataacattagtgtttttgttttattgggcccccagattgcttcttgcactccctttattgcttactttactccttctggttcatttttttttaattaaaaactggacttgtgttttaatgccaactagggataatctattatttgtgtttatgattttccttttattatattttattaatatgaaatacactctatatataaaaacattaaaatagcggtcatcctgctatccgctatcccagtcttgagggcggccgctccgctccgctatctgggattgataactatgttgtgaaggagcatgtcagatataaaatcatttatattgtgctccacctaacaacttaagcctttggttttcttttgtttgaaaattaatagacagatattcatgtaactccttcattggtcatgctcctagggaattagcagtcattcttcttatcaacatatcacaggatgttttaatggagatgggcctgctgttccctctctctaacagaagaagaaactggctttaacaagtcataatcaattctgcatatatttatttatttatttatctttagttgtctgaaatgaactgtcactgtacacctatgttgattcctgctatttcctgaggttgatctacaggaaaccacgaatttctcctctaattggttctatctccatactccctgtatgggctttctctccggtctcaagcaaatcaagtttatcatatatatttgtctcacaataaagattagtttcttaaatttcaatgatgtcccaaataaatacattacaataatacataatttagttgaattgttatacttagtgttggaggctttggttgtgatcgcataagcataaagttttccgcactttgttattgtctcctcatgtttttgttcatatggtgaatgcatttttgggtttcgacacttccatgtctctgtatctggttctcaaaatttcgtttttggacctgatctggcttgacaataagctagctggtgtattagtctaagatcaatcagcagctaggattttagacaaaaatgggtaaggctacttagtgtagagggaaatactttagtgtagtatgtacaggtgcaaagtgcaatgtgtctgcaagtatgcttttttatagatatctgtcttcaagttcaataattaattaaatgcctgaaataggttataattttaacagttctataaaatgaaaattcctaatattagtatacatatgcggctattgacattatatgtacataaagactagatgattttcttttatgttttctcgctataatgcttcctataataagtgttttctctagtatatgtttgggcctttggcacagtggctcggggtttgtaaacaatctaaattgaggaagaggtaaaaattggaggaaaacctaggttggttattgaaccatatgttgaactattgatggcattggtaacaacaggaaatatggtgaaagagaagcaagtaaacagtaggcgtgaaggggccccttgcccactccccttccccccattgaaggggcctcgaagccaaaaggcccaaagctcaattgtggcttcctaacaaataaagagatggaaacgatgataactatggaattgggtcttgtgttatttgcttagatgcaccatttctctgtatgttacaacttacaagtatcgagtatcctagctagatagctagtatctacattttgacgttacaaattactaagttttaggtcttcacccgaaaaaaaaaattacgaaattgaggattgccacgtgataaacatgatagatgataaagtgaggcaacagtaaaagaaggattgaaagagcataaggtaactgtatataatgtaattaaacaaccacctatctgtgcatgctaccccccaaaccacacacacatttctattttttgtgggttcttattttcttattttatttactttacgaagtcttgcattaaaagcttggttaaccctctcttgcagaagtatgaaatcaaaaattatggcaacttatcccgatgcgtttcctgaagactcaacgagcgaagtgattgataggagaccggatcttgaaatgcccaagtaactaatgttattagaacacagattagaaagagttatatgagagtttgtttttggtttttcttctacttttgtgataaacttgtcctatttgtcttaatcgttttaccagagcttcttgcccttaattaaattctctaaacttttgtctatacacttttatattgcagacagtaaatgcattacgcacaaatgataaaatattttcagatagaactttggttttgttatgggtgactatggaaatacgggtggcggcggtgcaactcgtgcggttcactaaaaaagatgagcaaaacgactgaaaaaagaaagagaaaccctcggtcaacattatcatttttaatctctgaaattataaaagaatctaaattttggaaattattaaattatcaaatgaaattcttaaaatcaaaattactgtcttatggattaatatgatcaacaaatttttatttcattagttctgtatttccgagatgagaaatactagtgacagtctaacattctttcaaatacttttttatatttagttaaaatttattgaaaatttaatgattatttcccctaatttattaaataaaaaatgaaacctatcaaaattgataatttttaataaattttaaccaatcatcaagagagtcttcaaggaaaagtgtcactagcattcatcttcttcttgagattactattatctttggttctatatataaaaaacatcaaacaaatcattaagatcaagaaaagtaaggtcccgtttaatgtcatcatatttaaattatattacaaaaatacccttatatttaaatgtgatattcacatttaatgtcaatactcataatccaatgaataagtacctaaaaaatttgaaaactaataattatttcttataactagtaacaaaagaaaaacacaattcgtttcctaaaaaagtagttatatattcacaattcagatactaaaatagtaattagtttgtgggggtcaagtgaggggtggtttgataatacgtttgagtggagaattggggagggtagaaatttaagattttggaaggacacgtggtgtgagggtgggtgtctaaaaaacttgtttcctagaatctttgttaattccgaacaaggagaagctaccataaaaaaatatgaggaggttggagtatggtaggtgagggtggatcttatttggcggagggagtggtttgagtagagaaggccttggtggaagaaatgtatagattggtggatggtgtcaccatttcgggacatggagatgatgcttgagtttgggtggaagattagttcaaattcattcactgtgagatccacctatgaagctttacatagattaagagattaagagttgggagccaagagaaggacatctttatgagcctatggaagatcaaagtgccaccataggtatccttttttatttggcgggtgttcctaaataggcttccttctaaggatatctcattaagagaaacattgatcttgaggatgataatggttcctgccccctctgtcacgaattggtcaagaacacttacatcttttattctcttgtcctgttgcatacaatatcggtacaatgtgctaggggcactctcaccaaaacagccttgatttgattggtaacaaggctattagtgggcaacaggttggagtgtcatcgtttggaacttacggcaacaaagttatgttatggtgtttgaaggaaaaccttttgataaggagcaactatggcacaaaatcatgttttctatgtggacttggttgaagtcataccataaagattttggtgcttcattccagcagtgacagtgcaatccctcggcgtgcttgttatgaggagtgatggactttctgtatgatgtgtggctgattgatacataaggctcgtatcttcccggatgcaggttctgtgtaaactaagattcgacctcttttggttagataggcggcagacatcttctggtttctttacagctattgtttcataggcctcaatttttgaggatcccgatgtgtaatctttgcacactttcttgtgcagttaatgatgtcatttgcttaaaaaatatatattaaaatagcgatttactcatttaataaattaaatatattaaatacaccgagactaacgagaagtcatcaagacaagaatgaaaatgtcttttatagggtagcttcctacgtctgatacaactagtcaattgttactttacagttttaccgcatgtattctagctatgctacatttttttcgacaatggtggaaacatgccatgaatgaatttaacgcatcaggataccacaattaatcaaaaagcttgctagattaaaaaaaaaataaaaagacggacatgtagtgtagtgacataataaggccaatcagtaacaaatgtgattgatttaattgaactgtggtgttaataaaactaaagaactaaatctgagatactagctaaaattgacggtgaaaaaaatctaataagagcaggaaggactactagaactaaaacaatattgtgacctacttcatagccagaaaacaccctattacataacagattgtccactaaatataaatctttttccagtatgcccaagtcaatcatcggatagaaaagaaacagagactaaattaaaacgaaaactcaaaaacttaaaagccaactatatttcagtatttcccaccttgcttctacccctgttgaaagtaacaaagtaagctgctctgcaacaacgtagatctaaatgtacaagacaggaaacgaccaaccaagtaatataaaaagaaagaaaaaaaggcaaagtgaaggataaacccgaacaaaaaccaaaagatataagcatcttaggcagaaaaccctaaaaaacccaaaaaccctaggagtaaaccctgttaggagctaaccactgtaaacaaaacccaatgagaagggattggtgctagcattctatgaactaactccgcccagccaatctcaatatacaatctttatcttcactaggcaaccaatcacactatcttcagactgcaagagaaggcaagacaaatcaaatcaggcggtaccaaattgctgataaatatacttctaagagccaatatatgccactgaagtgggttgggccgcatccttcgaacacagtagagcttagacaccattagaaacaaccccattggctacaatcttactctcgggaacaactggtttagcaccctttggggcatctccagtttttgtagcagatccattctcgggaactttgtggtcatcactatccttctcagcaagggtagactccttgagcaattccgagctaacttcagatttttgagtattaacttccccatttatctcaatcttctcatcagctggtttcccttcccatacctgcatcagtagagttaaggtaacaaaaagacatcatcagcacacgcaatcaattactttcacttaattagaataattgaaatgtgacttgcctgctttgggaattgttgctttgctttcttctccaaaatagttttctgacgggcctcatagaagccaaaatcatccagaatgcatgtcttgctggtatattccttgaaaattttaattaatttcagcccaggctccaacattacctgcaatcataaacttggttgatcagattaaaaacaaaactacattacaaagaactgacaactacaagtgcagaaccaaattacctcttgtgtatccctactgttagtgaccggtttgttctcattgttgtccaaggtaatgtgcctcaacaaattgttaggaacatccttaacaatgtgccacttaagaggaaagcaaccattccacttgtcttgctgccaatactcaacactcttgttaaaatcaacaggaccaaccatctcagcaagccccacaaattgcccactggtattaacctgcataggcacataacacattagctatatataaccaaaactgcaaataaaagtaatgactaccatcattcacagaaatacttactgagaaaaagagaaaaacaggggtgccaccagatttctgctgtgcctcctgatatgcagcatcaagcttcttgttgccattttgtgtactagcccacacattatacttaatactcttatggatatcatcctcgctgtaagacttgatgacaaaaaatttggcatcagtatattcttctggaaaatcagctatgttatattgatcaaattccagaatggtactagtcttgtctttctcttcatctgtgcctaaacttgcaggcaaattctgtcctttgactgctaaaatagttggtgcaaaacctttttggattttgccacccttggccctaggccctctgttcagttcgttcaaaccatctacgttctcattgccatagccaaagtagccaccacttcttcccctagttttgtatttactgtcaacagctaaccaagcccgtccattagtgcgagaatcatacccatgtgtaccataacccattccagatctgacagtgttcccatattgaccgtatagtttgtttgggtacatcctatttatgaagctatgggtggctcccatggcaggcactggtcttgggtggtgcaacccctgacaccaaaaaaacaaattgtgaataaataatcataacagcagtctagatagaaacatgacagtatgacacagtaagctctatcagaacagcacagatggaccaagcaaccaattattaggactttacggccatcaaatttaacaaatagaacaaagtaaaaccagacacttcaaaataggatacataccataaactgagaattagggcggaaagtctggttccttgaggcagtgttgttgccacctgatatcgaagaagtgatggttgtgctacttacaggccttggctgcccatctgaaaataatggggcatctagccaggggataggtgagcgtactccatcaaaaccaaatcttggatcctgataacctgaagttggaccacgacctggcatagcaaccctttcatttgatgctttggaactaaaagatgaattctgattgacctgtttaatagaagcagcagcattattacctttcccgttgccaccatttgcaacaccattagaatttccattggctgcatcaacagggagaggcttttgatcagcagccacagaggtggaaacctcaccctgaggtaggacagcaggagtaggtgtgaatggcgcactggttggtgttaacggttggaaatatggagggtactgatagtgctgaggcccatacaactgaccatcattccccatggttggaactggagaccctgctggcgaataggggccatagggcgcatatccatatccatgatgataaagtagagacccattatccccataaactccctgcaactgttaaaatatattaatgtaaataaaacatttgcagcagaatgaaaaagcctgcactataattttggaaaatgagaaggaaaaaaaatacttaccgaagtcatatcaactccttccgaattcacatatctagaataatcatcccactcgttaccagttccatcatatcctataataaacaaaaccatgtcaacttgaacaagatttacgtgttgcgttttcagaatttttcaaaaggcatttcatgtcgtttttcagaagcacttatccataaacttaccaccgtaataataggcagtagatgggtaaccatttgggaggtaacacatagtaggatcaataaaatcctgcaacacgggcgttacagaccggtcatacgactggatctggccattcgcagcatttcctgaatcaactgatccatactgattcccagtggcctgcacaattgaacaaatccactcaataccacacaattcactaaaagaacacagaaccaggtacaaatacatctcgctgaacattccaaatttataccactaacacaagagagtgaaatcgtgaattttcagtagcagccataaaaaatacaagcttttaccttcttggtaggctcaggaatctccaagggcttgggctgagtttctaacgatagcttctgtagcaaatcagttgcttctgtgcaaccaggagtaaaggaacacaaacatctcgaaaaattgaacttttcaacaaccagaaaacctaaaacccgcaacacacaaataaaaattcaaaaaacctaaaaaaaaccaacaccccgcaaccccaaacgagtgaatcagccataaagtcaacaccgtcaaaaacttaagcagattaacaagaacacaagagtagaaaaaacccaacactcgaacatcataaatcagcaagctacccaacaaacactaaaagatcaccctcccccgaacccaaaaatcaagtttcagaaacgaaaatccaccggatccaataaacgattcaatacagcagatcaataaaagataaacacaagagagaaactgcatagcagagaaggatacgatccgcgggattagcaacggtggccatgacgaaccaaccacgagatctggtttttctttggaggcggaatagagaaacggaagccctaaatccgaatctgaatcggagagggtttaagcctcaaatcgaaaagttgagaaaaccctaaaaggagcgaagaagagagggaaagagaaaaaaaaagaagagagagagagaagagagaacacaacgggtctcgcagccgccaagggtttgggtttttggggagagagggttttgttcctccaaaagcagtgattcaaatagcaccaccacctctctttaggcactctcgctctctcactcgcaggtcactctgtgatctcattcgccttctcccattggtggatccagccacgtggcgcctctccactggactttttctttgtaaattatttctacggttggtctgtcgtgcttgtttctttaaggtggtgggtgatgttagtgagaccccttgtgaatcttgtagatgcggggtttgggcaaaagatggaaaccctaattagaaaatgacacggatgtcctcgtccagctggacttgtggtaacccttcttcgatttttttctttgggcaccttctgtcatgtgctccaccacacacacatatcgtgttcaaattcatttccagtttatcaaaagaaaaaataaacaaataataattaattatatgtttaaattttatacgttattatgcgtttcaattaatatttttaataatagaattcaattattataaagataacttggattttagctttaagaatattggcaaattttatctacattagattaatccttttaaatttgaaataatatataaaatgtttattattattaaataagtaccttcgatattaagatacgacatttttaaactatttgttggtcaagatggggaagataaagataggactaccgcttaaattgttttgattaaatatatctattgtttgataaaacaataagataaaaaatatttttctttgccgtaaaaaacacaaatttatcttattttatttattagatcagatgtttaaatttcattgaataaaaagtttgtcttatcagaatagaaaaaagtttgaattacaatttcagtccctatttttacaaattgacaatttggtcctcttgatttttatttagacatttaatccctctaatttcataaattcacgattttgatcattctatcaattaacatcattacatgctcgccattaatcacttatgttgacattgcttactctgaaacacatttgaagtgtgagcattttctttccgatacatgtatcgatcattacttcaatttcacttagacataacaaacaaacttgtatgtgcgagtactcttctgattttgatgggaaatctttggttttaacgaacacggtacaggtataagtaacacctattttttttaaatagggttgggcatgggtatgtacctgcctgtccctacctatacgcatatccgaaaatataaccactaaattacccttaatgtagtattgtgtataatacataattaattttattaaacttttatacttactaatcattgtttatttttttaagactaaaactaaaactcttaaggcaaacataagccataagggattacaatctctctcaagtctcatgtttcaagacaattttaggtgacgatgactaccaagacattaatgtttggatcagatcgttttcggattgcaaacttcaagactccatggattgttgtttgaaacttaaacaaaaatatggaaaagatgaagaaatgatgatgaatgtcgccacgattcgtaacgaagcgataagtcggaggaggattgtcacaaaggaaagcttccttgataagaatcaatttggtttcattcaagaatcaacaagagactaagctctcgatgcaagcaaaatgcttaatttcattaattaaagttgtccaaaaatagcatagtttgagtacttatatagctaagcctctaatgatcacctaaaaacgtaaatttaggcctattttgttaatattaaagcccattacaaaaataaacaaaattacgaaagtcctcgcagaggtggcgcactgagtgagacaaagtggtgcactgggtgagcagaggtgtgctaagcctaaaagctctcaatcaggaattaggctgagcgagccagaggcgcgttgagcgagcagaggtggcgtgctgagtgagcaaaggtggcacgttgagtgagcaaaggcgcgctaagcctaaaagctctcgatcaggaattgagctgagcgagctagtggcgagctgagtgagcagaggtggcgtgctgagcaagaagaggcgcgctaagcgagctcacccataatcttcaaggtgcttcaattcagctctttgtgtcttccttcattcttgcccttattaactagtccaactatgattctcttggtcatcttttcttgaagaagcttggctttggaccttgtcattggacccttcaattcatggagtgcttctagaacttcatgatcattggataatcctctattaggtgataggaatatgattttcatggattttttttttattgtgataggattttatattgggtgttggcaagttgattgtctaagcttgactccttgaataaataatatatttagttttgtttaaaaaaattaaaattatttttatgattttttgtatttgttttaaaaattattaggtagggacgggtattgggcgggtatacccaatccccaatgaagactgggataaggaaaaaattcatacccatcgaagaagggatgaggaatcacatattcatccttgccccgtctcgttgccatgtttaatctcaccactcaacaccgacaaaaatattaaccaaacttacccttctctttgtaacaatatcaaattctcactatatactcccattgattttctaccactttttctcctttgttaaaaaaataaaactagtgtgttcccattccctaatcctctacatcgcgtcccatgtcccttaccataaaatagaaaagaagagagcaaaatataaaaaaaaaatcattagtacatctaaaaaaaagccattatcatatctaaaataaacaaacaaaatagaaagataaattggagagagagaaaacaagaataaggtgatgcatggtcaaaatagtgtttcctatatctgtttttgtgtttcatgtatttggtggagaatggggcttagaagaaaatcaagtggttgttagggaaattcgcaatgagagtgaggttgaagagtgtgatgatgtgtgaggacgagttcacaaaagttatgaggttcatcttcgcaaagtgtgcgctgacaataacgacgaggagggtgaggatggttcaaaagcaaaagtaacaacaaagggtatggtgggaactttgattaagattgtggtttatggtgttttgttttgtttgaattttgttgtttatgcccatttaaaaataggatttggttttgcatttctctaactcaggattgaatttggtgttgtgttcattaattcatcagtgtttttttatttgttttatgtccattgaagattgggatctaatttttgtctcctgttaaaatgtaagattaggagcaaggtcgaaaaaaggaacacctgacattggggactaggaatggttatggtaagagggatgatgttactcaacgttaaagtatagcggtcaatgagtcaattgacggaaaaaactaaaaaaatcatttttaaacatttagaggaccagctaaaattgtgaatttgggatattaagaggaccaaaattgcaatttagcttagataaaacatactttggtttggtgaccttataatacttatggttgatttgaaatttttgggtattgattacaataattatggaaaataaaagactaaattacacaaaactattatgaggtttgtaaaaaatatatagacctctcttttattgttgagacattacttgtacccttttcgttttaacattgtttaacctcatttacttattttctatatattcattgtatccctttgaaatcagtctatcactctttatttgtttccaagaacctcacaaactacaactattggacaacttatttagggttctaaaagaaagggaaaattcatgcatcttgttcagtctttgacaaaccaaatagcaatggtgaacgggtgtaatgagctcgtgcacgatttgaaacaacgatgttaaggttcgttcttgattttaaacaatggtgacgatatttgatcacgatttaaatcaggggtggtaaggttcgtgcataatttgaaaacaacaatggtggggttcacgcacaatttgaataacgatggtgaaaggggttgttgcacgcaaagtctaagttttcaaacaacaaaaaaaggtgaaaaataaaacaaaaaagagtgtaaagcaaaacataaaagattagaggttgcataccgaagcaccaaaacccatgaaatgttaacaaattattggttggaacgggttaaccaattatttcaacaagttcctatagtcttcatatgcagaatgagtcactatcttatattgtttttttcttttttacattaagatattataggttgaagaaaagggtatttgggagatgttatttcaattaaggtcatgtgacaacaccattttctcattatactaacaacttaaatggagatagtggcttagggaatcataatatacactcttaaaataactttcacatggtgcataaggaatttaacttacacatcgtagcctccatccataaaacatatatttatacatgatttattggttatcatatgacacaattcaagagtgtaaattatgattgatcattcaatacattaaaagtaaatgcaagggaaaacaaaggagcaaagttttggtaaaataaaaataaaagtatattttcatattcaagatggttacgacttggagttttataatatcttttgaagagagaactatttcctcagtttttttttttcaaaaaaactatttctagcatcctcttcaaannnatatatatatatatatatatatatatatatatatatatcaaaaagggaaacttaattgaattgaaaatgtttttgaaaaaatagaaaagggaggtatatatatctattgcatgtatagcgcaaaaatgctcaagttcaatttgggcttgttaaacaagctcaaacttataaaagtacaattgttgagcttttaacgacttttgtggcttggcttgtattaagatgtgattgtctaggaataaaaggttagtgttttatttatttataagctagaaattttagggtcaaaccttagcttttcatccaccatgttcggaccgacttaattgatctaacccattccccccttttaaatatgagtatttatgaaccaacccaattcaatgagaatcaagaaaattgattcaaaaaattgaaaataaaataaaattaaaaacaaacgaatcaaaaaataaaaaaaatcaaaattttattggattggataaaatttagatttaattttcaaaagtcattcaattcaaaccaaacggaacttgtatgtacctgtatatatttattcataattgataatatcacttatgtttatagttttatttttattatttgtaaaattattacataacttatacatatttataaaaaaatatttaattgaagatcactttttactaattttgtaaattaagatgcttaaatatagttatataatgacatataaataaaataattaatattttaaattagagcaaattacactcgcacctcgcgaggttagtgcttattacatttaaccccactcatttttttatcatacataagactcccttatttttttagcatccattacattgtgactccctggccctctaacactgccaaagataatgcaaaaaaggagaaaaaagtgaggatctagtgacgccgtcgtcatgtccttgatcttgatgaaagtgacattgtcgtatttgatgaaacaactgagttgcaatgcaccattgtaggaggtgaagcagcggttgtcgagttgggtgaccgcaggcgacacgctgtgaaaacactagtcgttggcgaggtctttgtaacattggaagaagccgtagacgatatcaaaggaggtgaggacattgaagttgttgtggttggcgaaggtgacaatgttgatgaggaaggtgaggagtgagttgacggtgtcttcgtaggcaaaatccaatgtaagctttggctggaagcagacttgggcaagagtgataggcactgttaataaatgatgattatttaggggagataaaagaaatgcaattttaagaagggtgcaagtgtaataaacattaaatttagggcgatgagtataatttgctctttaaattaatattttctcaaaaaaataaaagtatgactaaaatcgaaaatctatcttactcaactgtttaaattgaattggattaaagttttgaacaaaataattggataataaattaaacaaattcaaagtgactgaattgaatgatattttcgttcaaaatcatccaatccataaatagtcatacttctaaataaaaatgtagattttaatttacgaatccaattatacaactcaattaatattagacagccttaacttaacagggatagttttcttaaattcactaaatcattagaagttccgatcgaacatctaattcttattgcaaataataatataacatatacacatacaaaatctcaaactttaggttcaccaaggtgaaaaggaggagggggaggttacaaacactccaaacctgttgatcactccgataaatttgggtttgttcctccacagtaacacttggatcctccattaaaccgtaatttgtcatggcaccatggcaatctttaccaacatcgcgcacaaggttgcggtaacaattttgctaacttttccggtgtcagagaagatcttctggagcatttggtcgccacagtttgaacgtaacttgtgcatgcaattaatcatatgatccgcataaggttggagacttggagtattggaaaccctccttcatgtccagcgcagtttcaagatatcatggctaataaagtggcaattaccgcaaacagaatcattattaggcaaaacttgttaagggtccacgccatgaccactgtttttttagatgaaatctgattattgtggggtgtgatgaaaagctttgttggtataggagctgaatatgtagtaagacctatttacagttaaaaaaaatgaagtttaatttcaagattcgtattaatggatttttgctcaagtctaatgaaacaaacaaaataatttgatcattaattactgttatagttaagttaataaatggaaacctttgctttagcattcattacgtgctttttattcccccagtaacgaaggacttgtttagagtggcagttaagtttattttttttttaaaacaaaacattttggttgagccgaaaaaattgagacatcaaagttatatataatttaaatcactagtaactgaagtcctttgtttttaaataactttattttatttttataatttgattataatagaaatatagtcaatataaaagtttagattgaattaaaaacagtcttaattaaaataaattataattctgcaaattgcaggcacatttattataattcaatagttatacatagttaacttatgcatgattattcctcaacaaacagtcccacctcaagatcttgaatttgctcaatacgtgggtcctcaaacttaaaccttcgaaccaccattctctctcgatcttcctgcttgcaagaaaatccagatgacagtccaaccacatatttataagattttaaacaacgtttggtatactctagttcagccaacaataccttatttgaatccttgatatttaacaaggcttgagactggatattcagatttggcaccctctgttgccacaactctcttttgagatgatgaaacaaatagttagaaatcaaaacaaatgtaaaagaacttaaccaaagaaaaatcaacatgcagaagatacaactctatttccatgttttgaaacaccattggcagttgattccccaaccttagctttcgatgttgcaccctttgaaactgcttaccataaattcgtcaagtggtcacttcatccatagaaaaagacattgaactcttgcaatttacacaccaatgcaaaaacactacccaattcaacaaaataacacatgtactttttttttttaacaagtttcgttttcaaagatatatatcactaggcacaagtatttttcaagcacattggaaaccagaaagatggagttctacagtgtatggaattactagaatcttataaccaatagctagtgtatttaatgcaactttcctagtttcaccatccagttctgcagtcaaatttgcaacaatttgcaatgactttagctgccactaatctgtcgacataatgcaaggagtaactattcaaggaaaatttacgtccttctacaccaagtttagagtccatcaaagcaattgcaatatatggaacctacaggaaaaccatgctaaggacacagataactagacaaaagaatgaaagaacacaggaccagcacagaacacagaccatttcaaccagatggatagcagccagccaagcgtctaatgtattcagcacacattctctcatgtgcttcttgttgtcaccaagacatttcaatatatcagacagaataacctacaacaaaccatttccagaaatgctcaaacagaaaacagcaaaacagcaccaaatggggggaaaaatacgaaaacagaacagaatcctgttacctgcttgccttctctgtatccggggcactgagcagtgcaggctttacatcagtaagaagaaaccctttaatgtctgcaaggaggaaaaccttagagccttgaaaacaaaattgagagaacaaatcaacgcagaacacccaagaacttaattgatgcatttctagtagcagcattacttgactgcaggccaatttctttaagaaaatcaattaagtcctgcaaaataggatttacaataaaccatacaaacttccaagttccaacaacaaataaaatatctaaaaattttgtaaattcagataatgcaccttaagctttatatgtgagaaaccaaaatcttcaacagcagaaaccataagcaaaattccctcactaagaaccttggggttcttatgctccttcattatcttgtaaagctacagtaaaattcacagtttttcaaacattatttgataatacaaaattcccacctcaagatcttgaatttactcaatacgtggttcctcaaacttaaaccttcaaaccaccattctctctcaatcttcctgcttccaagaaaatccagatggcagtccaaccacatatttataagattttaagcaacgtttggtatactccaattcaacgtttggtacttaacaaggcttgagactggaccgctatatcttgaacagatattgatcagacttggcaccctctgttgccacaactctcttttgagatgatgaaacgaatagttagaaatcaaaacaaatttaaaagtacttaatcaaagaaaaatcaacatgcagaagatacagctctatttccatgttttgaaacaccattggcaattgattttccagtctttgctttcgatgttgcacccactgaaactgttctacctgactcaaatgactctaaagacaaaaaaaaagaggagttaagagaagatatgtaagcacaaattcaccaacattcgcaaagaagaatgaaccaaagaacgtgccttgaaaagctccatatggtttcaacttctcaacaattagcgtcagtgctggtccatgaatgtctttaaccatcttttcaatctaaaaataagtaaacaattccaagattattgatatttcaagaatattaaggaaacaacggaagaaagcaacatttttgtcatacacataccattgcatgtccactaactctcagtatctcatcaatacaaacctgaaagagtgataggtggtgcccgtggtgggtttcaggggaagaatccaacacttctggagcaattaacacgaaaataggggtagaaagaagatcaatacttccttcttgaaaaacaatactttagaacaagtcaccttagtcattttctttaataatttcctgcaatatatcttatcaatgcaatcaagaactctgccttaaaagatgaatacataatagataaaaccttaccttcaatatcggtccaagcaattatctaaagagtgcgagaaagaagagaaaacataagagaagaaggaagacacagaaaaaatcattattctctcatcttcttccctctattagactttttctcttccttctttaatagaaatcctgaaataaagcatgcagaagcaatgtatttatagatgaataaattgaagcgtctttagaaagaacgaaacggtcatatcaaagatctaagaaagaagcgctaaacgtgatatttattttgataataatatcattagcggataaaaagaaaattgacaaaattaaatattattcttatgactctattatacataatgttaaaattgtaattannnnnnnnnnnnnnnnnnnnnnnnnnnnnnnnnnnnnnnnnaatcattttgtaaaataattaaattaaatttatttgacattatatcattttattatcatgttatatatataataaatttgattgtcataatgtaataaaaaacatgaaaaaacaaagaacaatgctaagataataattctaatttttaaatttatttgtttaaaaaattgaagcgtcataacaaaacaacatcaagataacaatagtaaaagaatgtctctagtaaaaataagatagtgtcagttaccttccttaattcatgaatcatattcataatgaattataattaacaacatattaattgttacaaacttaaacgtgatattttgataatttacaactttaaaactagctcttgtaaatagaaaagtctttcccaattaaacttttttaacactgaaataccaatatagtaattcgaagatttaattagcatttagttttgtaaatattgaaagacataaaataaccaaatcacacaaattgatagtgttggtttggttgagaggtttgaggaggaggaggtaaaagaggcaatatgacaatgtggaagtgctaaaagcccgagtccgaatgaatctagctttaaattcattaagactttttggcatatcttgaaggaggacatcatgaggtttatggaagaatttcatagagtttgggttttttcaagaggctcaaattcgtcattcataagtctaatccctaaggttgacgacccacaaggccttggggagtttagacctatctccctagtaggatgtatgtacaagatcgtggcaaaagtgttacctaaacgcttgaagaaaatacttaatgatgttattgatcaaatgtaaaagtgccttctttgacaagagatttcttctacatagtgttttggtggctattgaggtggtgggagaagctaaaaggaaaaacaaaagttgtttggtcttcaaggtggattataaaaaaacctatgatttagtgaattgggatttcttgctttacatgcttcaaagattgggttttaatgaaaagcggattagttggataaggtgttgtttgcaatcttctataatgtcggtattagtgaatgatagcccttcaagagagtttgggatgcaaaggggattgagataaggcgatccattgacaccatttcttttcacaattgtggcgaaaggtcttagtggtcttataagtgaggcggttgcaaaaaagctctattctagttataaggtgggggtcaattttctacaatatgtggattatactattttcttaggagaaacactatgaaaaatatcttgatcataaaaagcattatgagatgctttgaattggtttcgggactcagtgaaattccataagagcagtttgggaggcattggagtggaagagaggatgggattgannnnnnnnnnnnnnnnnnnnnnnnnnnnnnnnnnnnnnnnnnnnnnnnnnnnnnnnnnnnnnnnnggggggggggggggggggcagaccctagaagattggagacatggagattggtcatcaacaaattcaaaaagaagtcagcctcttggaaacataaggtcctctcttttgcaagaagattgtgcttactcaatttggtattgacttcattacccttattctttttttttaaaaaaaaaaaatccaaaggtggtgttacataagttaatttgcttacaaaaaatcattctctggggtggagtggaatgggagaaaaaaaataggtttcttgggataaagtgtgttgtcgtaagagtgagggagggctaggggttaaaatatagtcatattaaacttagctttattagaaaaatggagatgaaatttatttcataaccaagattcactatggggaaagggtggtgttatcaaaatatagggattggaaagggttgttaagtgatgtgaatgacaagttggaatctatatggtggagagatttaaaaaaattgtgtggggattgagtgatttaagatggtttgatgaaggagtagattggaaaatggaaaaaagggataaaataaatttttggtgtgatgcataagagggagagcaaaactttgccaatttatatcccaaactattcctcattttattgcaaaaatttgacaaaattggcaatatgggaaggtgggaaggagcactactagaaaataggcttttaacatcgatttttttaggctttcaacatcggtttttaaccgatgttgaaactgccgacgttaaaagtatcaacgttaacatcggtttttaaaaaccgatgttaataaaattagacaacatcggtttttattaaaaaaccgatgttacttaatgaaaaataaataaaaaaaaatgtaaaatatgcattaaacaacatcggtttttagtaaaaaccgatgttgttctatgtagattaacatcggtttttggtaaaaaaaccgatgttgttataggtagaggaaactttctacatcggttctgtcaaaaaccgatgttgattagtaatataacatcggttttgttaaaaaccgatgttgaagtgtctttttgacatcggtttttgacaaaaccgatgttgtatagtcattttttacatcgtttattacataaccgatatagaatgtcattcttttaaaagaaatatggtatatgctctttatttctctccttgtaattttaaaagacttattaaaagctcaaattctatcaacaatttggtagccataatagttaataaaaatataaaattatgggatcaaaatttgcattgatggggaaataaaagtaccaattgaccaaatgttaaagataatgagagaaaatggaagaagacttattatagtgcatggattggcatattgaagcttaaattaccaaataaatttatacatgtataccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatctccaaagaaactaatgttattgccctagcgagacacagagagaaaacggtccaaaggaaacaagggaatggagaaagaaataaaatggaaaggaatcgaaaatggagtgtgcggatttgtttttttgtttctcttaaaagcctcaacatcggtttcttaaaaattttgaaaaccgatgttaagtagttcaccttaacatcggtttccttcaaaaattttgaaaaccgatgttaaataattcacattaacatcggttttcttaaaaaatttaaaaatcgatgttaagtagttcacattaacatcggttttcttcaaaaactttgaaaaccgatgttaatatcaactggttaacatcggtttttaagtattgataacaaaaccgatgttattttgatcctttatttacgaatttgccaccgcgttttcgttaacatcagtttttcagaaaaccgatgttaatgtagcgatgttaaaagctatttttttagtagtggagagacgtggagatggaaatttagttggtgtaggaattgttttgtctaggaagaggacttgctaagaaagtttcaccaacttgtatcaagaatgggcattgatagcaaacagttggatggttggaggtggaaacgaaatgtggatgagtcttatttagtaaagacaacatataatctcattattgggaatgacaggaaccaacatacaaacaaaattgtcggtgctatatgaaaggtaaatattccttcaaaagtgatattttttttgtggagattatttttgaacaggttggtcactttggacaacttaacaagaaaaatgtgagggtagccatgaataattggttatacctgatatgcactttggaggaggagacaacggctcacattcttttctctttcaaattagtagttggaaaagtggtaaattcatggggaaggctctatactacctaccattatcacccgaggagaacttttgacaaaaacacgggtctacaatctgaatgaaatttatgtgatgctattatttttggatgtgtaatttttgatttggaaatttaaaataatttaaaccaaataatcgaaacaaatgacgttaaaataatcaatacagtatgtaacaaaatggataaaaggttttaatgatcaatgatttaacaattgaattgcttaatagagttttaattagcccaaagatatcaaatggtggattttgctatgaccttggtgcttttccggaaagtagtcaagtcctctagtccaattcagttttgacaatattagttttttttttttacagaacaataatactactagttaatgatgtcattattcgaaaaatataaagttctaattagtccaaagatatctattcgtggattttgtatgaagttaataagtacactcctgacatgatttaactctaaaaataagaaaaagtctaagtgagagtggttaaatatttttttctttctaaatgacatatatattttgagttgaataaaattattatgaacaataaaacaaatttagcaaatatttaacaaaattatatacgaagactcaaacctaaaattactgattaaattatgataattacattttagttcatcaatgcgtttaattagtgataattaatttattttacattgtattattcaagagattctcgaaaatatttttagagttatcccttttcgagctacatatgaatagattatatagattacaaattcattattattgtttataatgtcattgagtgcatgttattgcatttaattattgtcattttaataaccatctcaattacatcaataacacaagggcacaattggctgctaacggatactttccttcgattgtgtatttatatacagattaaggtgtaccttttaagagaaacattttaattaaacgattaaggcaaaaaatatattatcaccataattattagtagcatgttttttttcttcttcctggatttaataaaagctatgatactaatagttattctaatatttctttttaaccaaaaaaactcacttattggtcataacccttttcattggtttagcacaaaagaagaaagaaatattttatggaagaaaccaaaaggttaagaatgaaaaaagggtgattagggtggtggttgcaaagtttgtgtgttggatatgaaaaaatatctctctcccaatggatgaaaggattaattggagagaagtgagaacaaagacagagaagaaaagggtttagtaaacgaaagcgtgagagtgttgtgcgctggaataggtagagagtgatggaaaaagattggtgggtatgcattataaaaaacatgcaccttctatattgcccgcactaacacattaaagtgcaccaaagccacattttggatcactacactacaccccagtcgatgtgggacctttccatcttctccccatagccaagccaacacccaactcatcaacatcattgccttctctgaattatctcccactctccccttttctgtcaccaaaagccatgtccccgttcacatttgataatcataatacttaaccactagattggactcaaaccatgttattttttttcctcctttgcacaacttcttgtttgattttgttgtgtgtatcccttcctcgctcctaaatctaagccatgtttcttgaggcgtgagataacaacacacaaaaaatagtaaaagaaaaaaaaaaagttttggcttttgtgatggggtgttgatagaggagctagctggtgctgcaagggtgtgtttggattttgtataatgggtaattgctggtgtaggtggaactcatcagagtatagagtctcatccaatgtaaagtcaggttggtttactaacaaaaaaacttacctttctctgttttggatgtttttcaattatttatcattgcctggaacgagtaagtgtttttggtttgtgatttgttgagagttttgattagattccttgttttcctccttctggattctgttttcagctcttgaaaatggtttactcatctccttcttttctttttcaatattttgtctttgatgggcgttattctcaaggatttcatgttttggagctttccaatgttccctccttaattgctttcttaatcaccctttcatctggttctttttcattgaagattttctgttttgatcatttgaatctagcttgtggaactttgatatgtaatattattagcttcaaatagctcatccttgtaggcaagttgatattctgcaaatcattgaaagacaaagagaacaaaaaaaacagaaatcttcatataggagttacatgttgtcttcaagtcaaatattttttttataacttttctaaagttacttcattgtagaatctgttaatatgacccctaatcaccttttccttatgtgtctgcttcaaaagtgggtcggcttgtaattctcacgtggatagtggaaagcctcttcacaataatgcgttgagtattatcttaactaaatttctatgaaaattagtggtgggtttttaaatataataatccgctgcttcacaattataatatattcccaccatcttatgctttggaaagtgtactaatctttcttctctttatccaatacgagagaagaagtttatatataattttttttatttatagatagtgaacttattgataattttgtgtataacattccaataaattaactgattaatgcaacatctggttagtttttctgagaaaattggatgaatatatataaatgggaataattattctcataactttcagagtttcattaaatgtgcatatcatttgttctcatttctcttattgattcaccaaaagaacaaaaccagggaaccaaacaaaggcatgatgatagtaagttaccatcgaatcctgaagaagtagaagatctacggcgtgactcagctgcaaatcctttgatagcattcacttatgatgagttaaagataatcacagcaaattttaggccagatcgtgtgttggggggaggaggattcggaagtgtttacaaagggtttatttctgaggagttaaggcaagggcttcctacccttgctgtagctgttaaagttcatgatggtgacaacagtcatcaagggcacagagaatggctggtagactttttgttgcctttctgtacattttttttatagatgataagtctttctatggaagcgtgctaaatctgcaagacttgagagtgtgtattggatactctttacaaggagatatacaaaaagtatctttttggatggggggaatacccatgtcgcttcaacttctggactgtgaagttcccccctccattgtctttctgaacattgtttcgtatgaagttgtctaactctaaagtcatgatgttgcttcacatgctatgtttattctactatttggcacacataagttaatgtgacaacaaaaatatattgttggtttaaaaattgttgtaagattaataaaattaaggttttggttgcttcataggcagaagtcatatttttggggcagctttcacatccaaatctagtcaagttaattggatattgctgtgaagacgaacatagggtgctaatatatgagtacatgtcccgaggaagtgtggaacacaacttgttctcaagtaagtatatcttgccacttgttcttgatattgaaattaaagcttaggacaattgctaatgcatgtatccatggctagctaggaatctatttaaagatctcatagcaaaaaatgttaactgttttgctttagtagatgcatatgcatctatatttactttttacttagttacccctttatgttgtctccgacaatgttgacacttaaaagaaaggaatttaagataaagtgattttggttccattttgtagcttcgtggaaaaataccgagttaggaagttttgggcttaagacgttggttctttgtcacttccctaagacatgtggtttagatggatttcataaggacataagtttgacagtaacattacataaggaaataacatgttgttttagctatactacatacaacctttagtgatcatacttgatgtcaatgttaaaaaagactatgactattaaccctcaacattcctttcacttttgcgatttactccgtaaaaacgaagaaattacaccggcaactctatgattttttcatattacatatggtatttttatttttttttaatgtttacagcgattttttaattaaagacacacaatgtaatattttaaaataattatgaaagttagtataatatattgaaaatgtcattgtgatactttctaaatataagatattagtgtacagattagaaaaaaaatgagatatcaagtgtaatatgaaaatatctcaagaagcacactttttagaagaagttagagcaactttaatgggagatcttggggaggaatatgaagatctctttttttccagatccaccactaaaaaagaaaagcatctccacgtgaagatgcatatcttctccaaaaaccttaaagatatgcatgaagttcaaaaaaaataattttttatatgataagatgaaaaaaataaaaaaaaataaaaaaaataaaattaaaagttaaaataattgcttaaaattaattatatattttattaatattcatatatttttttcatactttattaattaaaattaattatttaattaaattttaaatatttaaaatggagttcatgtgagactcattaaaattatctaagatttcaatttggaatctatcaataaaggaaaaaatgtcataaatcttaaaagatttttaatcctaagtgacactgtagaatctaccaaaaaataatctaaataagatctcaatttaacatctatcactaaattttctttaaatctaaatcctcttacctcgtgagcagttgagagatttctgaatgtaaattcttggtaggtcctacaccattgtccaatgcaatgagccaaggagtatttttgttctcggaagaccacttactgttttaacttttaagccagctactaacttttccagttctagttttacaatgttttccgaactttttcactgtagattagttaatgtttgggttactattttttgggttactgaggttgacctttaaaacaagggttttcgtgtgggctggaaccccttattttgtatgagcccattaagtacaagcttcaagaaattagacacaaaagtcatgaacttttttgttttgtttttgagaataacaaccatcatcaacttaatattgcccggtgttgaaaaaaaaaaacttgctacttatcacgagtcacctcttaatctagcactatgctatgtccaaagtaattcctcaatcatttttttttattcttctcaaggtattttaatatattgtggatgagattgatctggtttgatgtttaatggcatgaccctactaactatagaaacttccaatggaaataactattggctacaaaactcagtaatgtataaaaatgatataaattatttataatatgcattataattacaggaattaccaatgatgctttaacgaattctcctaaatgacccatcaatccagcaagcgcgtttcattcccatgaaaaatggtctagttaatgtgaagcaaatacgacaacctatcacataaagtgggtttagcaaaccttttttttcactattttctttcattttaattttttaattttttattcctcttttaatttctttattacagtattcaatatatcgcatatctcttactttttctaccttctttttctttctatctctattcaattcatttcatacttcacaagagggatgaaagaaatattcttttctaatgtaaataaaccttttctcattcatcttttcctctcccatggctggttggaattctttagacaccacttgattagtgggacctgttaggccctagcagctctaataaaattttatatatatatatatatatatatatatatatatatatataaatctctctagtcataagaaactgctagtgtgtgctacacgagtgcataaattatcagagttttttcctcacataagttactattccaaatacctaggtgccggggctccacaaggccagccactctatgtcttatacgtgaggagacaagtcagctagacatgtgactagcaatattagttttagctatgttcaaacacaagaacttcttaatcatgcacggttcatcacattatcttttaaataattaaattattatttgatatgtataaaaccatattttaaaaaaagtgcattttgttataattcttgcaaactaaaagtttgcacaagtcaaataacaaataaagtaattacaataaaccgtgtctaataattaaaagttgttcttttaataaatggtaagataatattattacattgaacaacacaatgtatgtcatgtcaattatatggatcaccaacctatttaacttccatctacaacctttaaatttcatgttgaatatatttaatatatattaaatattaatatatttacgtacaaatctaataaattattatataattatatagactcatatagattattaggatttttcctaaattggacataactctattgaacattgcatatttgatacctcatgatgtaatactttaaacatccaacattaaactcttttctctctcaaaccccttatcttcaacattccaaaagattagcatgagttatgtttaattagtaaatgaaattatgtaaaaatattgtcttctagcaaaaacaaatgtctatgtagtttctctgaatcacaccccctccactatgaataccactttagtacttcacttttcagtttcacactcacattctctcagaaatttatggatcatctcatctttcacacgtggaacatcactcaatcagaacgaattctaggtagttgaaaaagggagactccttaacccaacaagataaactattttcaggatttgaatccatgacttcagagtcacatagctgcaaccttattattaatatattaagactcactcttaagtctctaattaaataatgaaagttctagatctttgcaaagaatcacagtgaaaatctcccttaatagctaatggaaaaagcattacacgctttatggattctccaaatattaaatgtttttgttttgcatttgatattttttttttaaagtaattgagatattttaagccgattgtttaagagggttcaacaatattagacttggattctttttgtgtcagaggattattctgttggagaaatatagacgcagagttaatgttgcaaggatcctaccacgatgtaatcataaagtccactagttatattcaaaactgtttgtctttattcaacaaaagaagagactttaatgtttattattgtctttttggtttgtatatctaatgtgtcttttcttgaatattgcagaaattttgcttcccatgccatggtccataagaatgaagattgcgtttggcgccgcgaagggacttgcatttcttcatgaagcagagaaacctgtcatctatcgagattttaagacatcaaatattttattggaccaggtcagcacacttaaatatgtcaactgaaaatgaatatatagggaggaactaaaatttgtatatatataacgaaaatgtgtagacactagacagatgaggaattaaaatttaaccatttaagcatatatagggaggtgaaaaaaaagtgctttccataatttatttgtttagggtctaatttggatgtagggcagattgttatgaatcaaacaatcacacaataatcgagatatgagaaaaaagaaaaaaattatacagagtttacccacacactcataaaatgcactcagtttacaagaaaatatataagtttaaaaattctaagcacaatagttattcatgagtccaagcccaaattacaaaaataataaaatacgagatcaataatagtactgggcctcgaaaaaaattccgagggcctgccccctagcccccgttgaggagactcctgcatatctttgctgacggcacaatataagccatacccaaaacagtatgattctttggagttacacgctgaaagtaaaggacacaaagctattgaggtttgatgctcaatgctcacaagaaatttagctattaaatattgttgttgaggtcatgttgattattgtgttcttcaatttaaaatatttagactttcataacctttggtgtttatgatttattttatactaaacttattgcaaactatagatactgcttgcagttatgttgtcaaattttttatcatagcaaaacgcacatatgctgctgtttaagacacaagactctcgccagctaactatagatatagataagctttactaacaaattgtagttatgttgacaaatactgtttttttcaaagatgaatgtactattaataattggcattgttttagttatttcgtggttccgcttaagcaatcatgcacaacgaaacagtatttgtcacaagaccaaagcacacaaactagtattttgtgatatctctggttagatttcaggtgttgaagcaaacagcaaaatgtaatttttgcattagtttctactcttgtacagcaaagaccacagtgtttccaaaataagccagctttcaactaaccatcttggccttttatgtttcaaaaacaggactacaatgcaaaactttctgactttggcctcgctaaggatggaccagttggagacaaatctcatgtttctactcgagtaatgggaacatatggttatgccgcacctgaatacataatgacaggtaaagtatattctgaagctggagttctgtactcatttgtgaatcaaagttcatattttcactaggcataaattaaggccaatgtagagaaattatggttgccccagatttttgatagagtttaatttttatgcatagactgtgttaagattctttatattatcaactaataaaaaatcacatgaggtataatttttaaggtaacttatataaaagaataaatctatgattggatgatagacgataatataaaaaccctttaaattaaactcttagtatactacaatttgacatcataattatatgttgtgcaggtcatctgactcctagaagtgatgtttacagttttggtgttgttcttcttgaacttctcactggaagaaaatctttagacaagttaagacctgctagagagcagaaccttgcagaatgggctcttcctttgctgaaggaaaagaagaaatttctaaacattatagatccaaggctggacggtgattatccaattaaagcagttcacaaggctgcaatgcttgcatatcattgcttgaaccgcaacccaaaagcaaggcctctaatgcgagatattgtagactcgttggagcctttgcaggcacacacagaggtccctattggaaaaacattgaccataatcagtgaggttcctgaatctggtttgaaaatgaaagatgatgcaaaatgacttaaaagagggtgttgttgtaggttatcagtttcacttctcatgttcactgggggagaggttttgccttaacttcttgtgtttattaacatgacatataggcaatttctttctattttatccccttctttgcttttcaacatggttgtcatatatgtacagctggattattgtataaaccgatatcaagttaaacagaaacaaacaagcaatagcagcaatacaggatatgattagacgttcttctgtttcagaaagaaatattttatgccctgagattgtttaagagtttcacactgttttctgaaattgttatgtatggtaaatttattaatttttataataatttaattgaaagtcctatttttttttataatttcttatttgacaaagtaatttcttttacagtgcatagaaatgaaactctttcttttatttgaatctaatatctttccaatataatgagataaaacagttaattttttttctagccaaaaccttttgaaaatgtccgttatcccaatagttcttgcataaatcagtgaagaacacatgaggctacctagacccgaaccagtagaggctaaggaacatgaactgaaacacattttcactgaaatattataaattaaattttgtgtacttttcccactgatatacacttcctaccattttagtttgctgggtaaatttaatcttgaacactgttcttatttttattgttatctgaccaggaatccttgcaaattagactgagtttaacccttaggtcaagtgtgattgtttctgagattaacctcttaattgcggatattgttagcaaaagtcctgtctaaagttgtgttttgggcctatgtctgtggcccatactcaataacaaacatcttggcctagatgggctttgttattcttaccccgttcttcgctaacttcacactcttatttacaaatggtgtgacttaacctaaattttttttttatctttactgaaaaaaaaaagttcatcaatagtaattttgaacaattgctaaaaacatttgttcatgaaattagtaattaaaataatttgttgaattgatattatatttaacaattaattaaaatatcattggttttcaaaaacaattttattactattatataaaacaccttttgtcattatttataacatatatagtcaataactttttttgactcttattataagacttgagaagtgttagtaaaacaacctttctaacactcatttcatccattatgacttaaaatttattgaaaagtataaatgtagaagagaaagttattaaataaattgtgagatccatcaaaatttataatttttaataaattttaactaataataaagaatatgctgttagtatttctttataagatttcattttatctctcttatacattaataatttgttgactaaaatatttttatttattttaatctataattaaatgttcatttgaatttttactttctcttttctataaagattaaagaagatgaatagattctgattaatgttaagaataaatttttaaacaaatattacagttaaagataaatttaatactaatatctaaattaattaattttttaataaacataatttagacaattatgtagaaataaaaagaataagttttattccaatcaagattgttagttattattttttttaaaattttcatctccttaatgaaattgttggtgacttggagttggattgtcatagaggtagtacagccacgtctcaaactcaaactttgcaaaatcgaaaaagtacacgtggcatgatactagtgaactgaatggatgttgcttcttaaatcttaaccacttcagcaatctacgttcacaacctctcatccatgtctttgtggccctaacaaactgttaactatgcacaagcacaacttcaagcaccaaccaagggatgctccactcatagaactcaatatagaaactggaactagaagtagcagtccctaagttttgtgcataaccttaaaccatgtcattgcctaccaccactagtagtcactcatctatttactctgcacttacattgccaagaaccacccaaattcaaccaaccttgttttctcccaccaccaagttcttttcttccagaagcccctcatattcaggtgtttcctattgtttctcaaacacccttttgtcaagacctttgctttttgctgtcaaggcttcatctggggttggctcagaagcatccaaacaggatagtgacaagagtgaagaagaagaagaggaggaaccgtatgaagagtatgaggtggaaattgagcagccttttggactcaaatttgcaaagggtagagatgggggaacttatattgatgctattgcaccaggaggatcagctgataaggctggagtcttcactgttggggataaagtaattgccaccaggtgtgctattcttgtttttttaatttttctctttctgcaagtttcttatttggagaattagatagaaggtttatagatgtggtatagctttgatattcgtggttggatagcatattatgttcaagagagtttattggaggtcttatactcttatttattcttggttggtttatggttgtggattttgatgactttaacttttatgcacagttagtgtaaaaaattttacaatgttactaattagaaataagtatgacttttataatatttatcataaaagtcaacaaacttatcatatatatgaatatatcagtttgtgattagatgacccttttcaatatgactttatttagtaacaacaagaagaaaagtctaatcccattaggtgagtgatccatgttttggtatatcaacatgttttacattggctcccaagggcctaacacaaccttcttcctttacttggtcttgggacttgttatgaaaccattagcgtcatttcatactttcagtataactttggtccttaaaaataattttgacatgtcatagaatcaaggtttctgaatggtcaataaattatcctatgtatattatatttggggtggtggtgatggttttgggggggggggggggggggnnnnnnnnnnnnnnnnnnnnnnnnnnnnnagaagtaaacttgtatactttatgtttgattcataatgtctgagatatgaccaatatcttcaatatctgcagtgcggtttttgggaccgaaatttggccagcagctgaatatggaaggacaatgtacacaattcgccaaagaattggcccattactcatgaaaatgcagaagagatatggtcagttcaatatgtatgcatttttgctatgtttcgagtgctactctagtaagtagtcacttgtgacctttgctcattgatctcagagtcatggttccttattttgacaggaaagagcattgattctggtggtgagttaactgaaaaggaaattatcagagctgagaggaactctgggtttatcagtaacagagtgagagaaattcaagtaagtttcatcatgatgataaaactgcaaaattgtagtccatacattcattctcaaactattttgtatataatattttctctactatagaaagatgtcactgctgtacttccatgtggggtacaaacatccattatcaattctcaaacttgcaaaattttcagatgctaaatgctttgaggaaaagggaacagaaagagaacagggaaaaggatttgagggaaggattacaactatataagtaagacttagcaactcaaaatcattttctttttgaccctctatgatgtgcccagtattcatttcattgtccaactttgcaattatattcttccgaagggagtagtaggtgaggtatgagaagagttattcttgattcttgaccatggaactatatttagctataatcagatataagtaaaaccaatatttgatcagcaacgcatgattggttatatggtcaagattagcttcttttacctttcacactctcacttgatacaccttatatatatatatatatatatatatatatatatatatatatatataatcttcaaggttgtgctagatttattaaatttttcctttaggctaattactcacgtggtttcttaattttattttaggttgcgatttggtcccttatttactaaaactaacactagtcgtttttcaattttggggcatgattttgtagttttttttattgattcaagacgtgaaacttatctcattagattcacttacgtgaaaactatgggtcattcagaccaaaaaggacataaataagatgaaaattgcatgaaaagtgtgtcttatgaggatctggaaaactgaaaatctccaaagatcaaccagaagattgctcatgagacataaacataatgaaaatcacatgaaaaaatttcaaaatcgtgtcccaaaattgaaaatgataagtgtgctacaacattatttgaaaaggataaatgttgatccctccattatttgaaaaggagggatcaacttactccaagagtaactctttccttatcctcaccattcattttcagtcatttgtctaactgattgaaaccatccatgcttatggccaaaaactggttaaagaaaatacttgcttcactttccaagcatccaatttgcatcatatctaaattaaaagactgactagaattgatgctatctcactactgataagtgataatactactgtgcactctgttcctggattaaatgctgaaggaatggcaaatatgatgaagcactagagaaatttgagtctattttaggatcaaagccagaacctgaggaagcagcagttgcaagttacaatgttgcttgttgttactctaagctaaaccaggtatttgtttccttccgttcgctacttggaacatgtaatttgatcttggattagttccttattatccttgcggaatagatataatccctttacatctgaatgtaactaatttagtccagtaaataaaaggtttattagtccttattagaactagctaaatttttcctataacatccaatatctagttttacacctgctaggttaggtgatacaccgaagtcctatagcattgaccaatcccaaacaaaacctgtgaaaattaagtctcctgtttatcttacatttccccatgtagagattagtagctttcttgtagtcattggattttcaacaacaagcatctgattcctcaattttattttttgattcaaagggaggagtggaactctggtaccaagagatttataataactcacacacattgctcaaccaataagctaaaccaccattggttatttttattaattttaaagcattgaaattggtatgagtattatatgcccatatttatattaataaggacaatatacttcttaattaatccattagtcttgccaacaaatgattctataatttatctatctattaatatactaatagagtaataaatatctcttaacagattcaagctgcactttcttcactagaagaagctctgaatgctggttttgaagacttcacggtaatcaacctacttcaagttattccattatcatattggctaagcatctaacattcttgcaattttaacagagaataagaactgatcctgacctggctaacgcaagggcgtcagaggaatttgatcctttattgaaaagatttgatgaatctttcatcaatgagaatgccatcaatgccattaaatctctttttggatttggtaagaaataacccattgtgtggacaaaagcatacagtttggctgactaaggagttggttgagcaatatgataattatttcccatgtataactttatagtttaactacacaagtccctcattttttgtcccttaagcgggatcttgttttatgtactagtataatcaagcaaaattataagaaacttatttatgatcaataaaattgtccatttccatcacctcctactttgttgcatgttgtttcccacaaatggccccctaaagaacctgatttgttttgaagcaaccaggtatatatgagaggcttgaatcaagaggattgtgcttgttacatgtcatggactattgtcctcttagttcatatagttgcgatttacgaagcaatcctgggcatgacttgagttaaagataatgcagcttgtgattctcaaaatctttaacatctatcttgatgaaatggcactaactccctctttcttttgatgaaactactcatttttttatgatgtttcatgtagctgtttttcaaccatcaatagatacctttctataaattgcaatttttttatatttttttactgttttcaacttttaattcgttcacaaaatttcctttgtttctaaaattttacataaacattttcatattttataaatggattgcaattaaatctctatagtgcaaaaatttaaaattattaaatatttatactacaaatttttttgaaataatatgggagtaacaccaaagataaactaacataacaaagttgtaggttttaccaattggattattttctcttatttgattttggacttgaatttcaatgtctcgtttctctatcgcaatgacgattagctccataacagtgattattgaaaccaatacttcgttgaactcatggaagcagatacaaaaagctggggctaatcaatggagcataaagtttattttctaatgctaatatagtaatataagatgactacttagaaaacttctaaacaatatattatgcgtatgaaggtatttgactagaaatgggcaggatgaagtcgaatttcaagtccttttactggttctagcaagggatcatacttaaacttctcatcaggaatcaccaaatcccacttgaaccgtttcacgatattatgcatgaacacaagaatctctagtttagcaaactcttgccccaaacacattcgggggccacctccaaatggaacatatgaaaatggtgtaggccctgccccttcaaaccttgaagcatcaaaagtttcgggatttgagaagagtgtcatatcctcgtgtgaagaaccggtgttccaatgcaactgcgagaacagatcaacatgagacaaggttctctccttgtagcgaacatgcacttgttttactggtcttatatttgtaaaaagagaaattatcaccaacaattagtattgttgagtctcaaaaaaacaaggaagttttggtctatttaacaaaagaaacctcgagtagttcatggaaacaagaacagcaaaaaaagatataaaaaagatttcaaagattgaaataaggttaaattaaacatcaactgaattagtggcctaatttaaaaatattgttggctgatgtaagaaaagaatattaataattgacagcaagaagacaagttttaaaagtacactatagactgtaactagtctctttagctttgatgttccattgtgttacagtaatatcttaatggtacatatgaaaatacaaatttgaagcgtgagtatgaagtaaagttaaagatggggtagcatttggctatctgcaatcataaacgagatattcccaagtccaaggtatgatatgaaaacacttcatgaccaaggtgtgatttcaatgaatgcagagtgaagaaagcatgataatagtataaaagcattacaaaagaaatgaaacataccttccaccctttagggatgttataatcagcatatgtgaaatcctttatagcttctctgtaagcaccactaacaggtggggacagcctcatggcttcagatgcaacattccaagagtatttcattttctgaacatcttcccattgcaacaattgctctgcctctttcccttgactaatttcaagttgttctgtcataaagataacttcaacatttaccctgatcaagttttaggtaagagcatatggctgaaaattaaaggattttattactaacctttcaagacatgttcataaacttgaggtaattgtccaagatacttcatgaccaatgataacactgatctagaactatcgtggccggcaaaaagtagaagaagtatgttatcaataacctccatttcggtcataaaccttccattgggatcagatgtaacaagcatgtgtgatagaaggtcttgagtaggtgatgccctcttctcctccaaatccactttccttttctttaaaatcattttaatttccttccttattacatctgcagctttcattgcacgatgaaaccttgttccaggaatgttgaggggcaggccaatgatccctttcagaaattcatcaaattttaacgaaagctttgatatatggtcagagtcttcaatgcttaaaaacaagcaacaagccaattcaaacgtgtatagctgtatgacgggatagacaaacacacctgctcctttgcttcaaaattgcaaagtaagaaatatagtattcaactttgagaaaataggcaatgcattgacattgtaaagtaatcacaatccatcatatatgataagtttgtcgatttttataataactaccttaaaagtcataccaacagtgatttaatattggttgatcatgctatttttttttcatttctgatgaataaccagttttattagtcaaaaacaaaataatatactcaatcaacactgtttaatcatcagaaaacctgtaaaacaggtgtccctcttaggactacttctgatctaagaggttataaatctaataatttatttatttatttcaggatgaatatgaaaagcagaattttcaagcttgagtataaggcccttctgtaactatttgctaatgctaaatcattatgtacctaccgactaacccttaatcatatatacagttgcaagtgttggatttaacccaaatttcattgaagattgttattgatagttttctataatatcgatacatatgtaagatttgtgtaacagataaaatatatgtgagatttgatagatatgtaaaaggtatgggatatatatgaaagatatgagagatttgaaaaatatgtaagagtctattagagatttattttaataggaaattgggtaagttttgataataaatttgattcttctcatctatggcaataggcaagttgggctggaccactataaattgtttatgatttgtttgtgatgcttttacccactcactagtagttatgtaagcatatgaaaagaggatatgatatttcccaaggatatggtattccccaccaccaaggatggaagaagggccacaaagaacaaggtattatttaagtaccattagtaaatagaatttagctgttatataacatttcttaccttcccaatatgtgtctatatgacgctgagcaatgctatccatttttggcaagtagtttctgagtgtttctgcattaagaaagctcatgagcaaccttctcaccatctttgcctcatcaccaaccttattaaccaaggacaaccttaacaacctcctcactgaactaggccaccacacttggacattcttgttctcattgctgaataggaacttgttcccggctggcccgcaaaacataacaacaggatctccaaacattgaagtcttgaacaccctggagtcatatttcttcactctttcttgtatgaaccttaacacgtttccctcattcattgtacgcagaaactccaaggtttctccaacaacaggccatcctaatcttccaggaggaagattgaggtttggatgtttcctgagtctgtcagctttagtgatgaaatgaagagaaaggacaaagaatgccgaaactgctggcaagactacaaggttggtcacctccataagatttagtgtccttaagaccttaactattgatgaaggacacaagacaacggagagtatgaaagactattctgggaaccaggaaaactaaggtgtaagatggatgacagagagattgctctttggggactgaatgaaccagataagatatataaatggaatttaattttcatatagtatctatgtaaaattgtaaatgtaacactggaataaatagaaatcatttttaattgtttgagtaattataataatagttaataaactgtttttttcttggaaaaaagtttcacatatccgaaagttataacactaataccagaaaagtagaatattagttaagaaataatttttctctccacaaatattactctatttacattgtaaaatataagtcaataaatttactaacttagcatacatatgactttgtcataagaatctatatagtgacgatatttgtctcctgtttttataatttgacccatttaagttgtcataatttttttttatcttttattgactagtttcttttttatattttgtttcttttatgctttatttgattgaacattttattttatagaataagatatgttttttgttcctttaaaattttagaaattcaattttaatcttttaaaaaaaaatatccatttttcattcttttaattttgaaatacatcactttttttctttaaactggtttagatacctatatagcgctttgaagataaaaaaaaattaaaatagaaagacgagacaaattcttttagaaaatctaaaatagaacttttagacaaattataagaaacttatttatgataaataaaattctgcatttccatcactttctactttgttgcgtgttgtttccttcagatggccccaaaaagatcgaacctgatttgtttttcaatgaaggggattgtccttattgcatgtcatggactattgtccttagtccccatcgttacgaagcaatcctgggcatgacttgagttatatttatgcagctagtatttattatttctaggttgtgattcccaaaatctttacttatcttgatgaaatcgctctagcttcccggcccctttcttttgatgaaattaaatttttttattatgtttttcacgtagctgtttttcaaccatcaacagttacctttttataaatttgtcaaaaatatttttttattgaatacaacttttaattcgtcatacaaaattccctttgtttctaataaaaaaacattttcatcttttgaatggatttcaattaaatctctattagagcaaaaatttaaaattataagatatttagactacaatttttttaaaaataatattggagtaacaccaaaaaaatagcataacaaagttataacttttattaattggattatttcaaattagggctctcttagcattcaacttgagcacaatttggatttgaaagcaagaccaacagtaactcctgtttaaaaaaaaaaaaaaaaatcccatgacaaacaagaaaatatatttgtctcctttgcgtaaaactcttctatacttaggttcttagggttcaactgtgtgaattggtttgtctaggttgtgcaatgtgcaattttagtcttttgtcagtttttcgttaactatttaatgtttttttgttgaggactgatatagcagatgatatcacatgtgaaaggaaaagaatttgtcaaagcactaaagtagagatggagttttataataaaaatagacatgaagagggggggaaataatataaaaaaccattacgttttcctggtgtagttttgcagacaaaagtattgcctcatattctttaggaattcatctgattttcttatttggttttgtacttgaattttaatatctcgtctcgcaaccacgattaactccaaaaaactagcatcaagaaagcatatacatttgttcaaaaaaaaaaaagaaaaaagaaagaaagcatagacgtgtacataacagcataatcaaaggtttattgaaaccaacacatcatagaattcatggaagcagttacaaaatgctgctaatcgatgtagcagaaagttttattcaaatactaataacattgcaatataagatgactacttagaaagcttctaatcaaatgttatataagataactacttagaaaacttctaatctatgtattatgcgtatgatgaaggcgtttgactagaaatgggaaggatgaagtcgaattgcaagtccttttactggttctagcatgggatcatacttgaacttctcatcaggaataaccaaatcccacttgaaccgtttcacgatattatgcatgaacacaagtatctctagtctagcaaactcttgccccaaacacattcgggggccacctccaaatggaacatatgaaaagggtgtaggccctgccccttcaaaccttgaagaatcaaaagtttcgggattcgagaagagtgttgggtccttgtgtgatgaaccagtgttccaatgcagctgtcaaaaaagatcatatatgacatgatcaacacgagacaaggttctctccttctaggatactagcacctcttttacccttttactgtatattatatttgtaaagaaccaatgattttcagaatttggtcaccaacaatcgttacttcagtattttttagcctcaacagaatgaaggctggtttcggtctagtgtaacataagaaacatcaaatagttcatagaaacaagaactgaaaaagaagaaaaaaaagataacagagacttaaaagattgaaacaacagttaaattaaacatcaactgaattagttgcttgatttaaaatattgttggtcgatataagaacagaatactaacaattgaaagtaatatgacaagttttaaaagtatagactgtaatgtaactagtccctttagccttgatgttgttacagtaagatcttaacgatacatgaaaatacaaatttgaagcgtgtgtatgaagttaaaaaggggtagcatttggctatttgaaatcataaacgagatattttcctaagtccaaggtgtgatatgaaaaatacttcatgaccatggtgtgattccaatgaatgcagagtgaaaaaagcaagatagtagtaaaaaagcataacaaaagatatgaaacataccttccaccctttagggatgttataatcagcataggtgaaatcctttatagcttctctgtaagcaccactcacaggtggggacagcctcatgacttcagatgcaacattccaagagtatttcattttctgaacatcttcccattgcaacaattgccctgcctctttcccttgactaatttcaagttgttctgtcataaagataacttcaacatttatcctgatctagttttaggtaagagtatattgctgaaaattaaaggcgtgaaaatagttgtcagcaatagcttgctacaacaattttctttatactacaacaaagtaaacaaacatgttcaaggattttattactaaccttccaagacatgttcataaacttgaggcaattgtccaagatatttcatgaccaatgataacactgatctagaagtatcgtgaccggcaaaaagtagaagaagaatgttatcaataatctccatttcagtcataaaccttccactggggtcagatgtaacaatcatatgtgatagaaggtcctgagtaggtgataccctcttctcctccaaatccactttccttttctttagaatagttttaatttctttccttattacatctgcagctttcattgcccgataaaaccttgttccaggaacgttgaggggaaaaccaatgatccctttcagaaattcatcaaattttaacgaaagctttgatatatggtcagagtcttcaatgcttaaaaataagcaacaagccaattcaaacgtgtatagttgtactattggatagacaaacacctgctcctgtccttcaaaattgcaaagtaacaaaagtattaattattaaactattgatcacaagtattctttttctttttcatttctaatttataaccagtgctattaatcaaaacaaaataatatagttaatcaacaatgtttaatcatcagaaaacttgccaaacaggtggccctcttaattctttaagactacttctgagctcagagaacataaatttaatgattttttatttcaggatgaatgtgaaacaaaagtttctagcttgtataagaaccttatgtacctgcccgctagtattggatttaacccaaatttcgttgaagattgttattgatagtttgctatactatcaatacatatgtaagatttgtttcacagactgaatatatgtgagatttgagagatatgaaaaaagtatgggagatatttgaaatatatgagagatttgaaaaatatgcaggagtcctattagagatttgttttaataggaaattaggcaagttttgtgaggatgggtcgtgagaatgaaaataagagtgagggagagattgcattgcaataaattctacaagctagatttgtttggattatagcagttttctgctccacacttgactacccagcgtttaccgtgggcaccataagtggcaaaccagaggtgtgtccttccctgtcctctcaatgctctaatgcccacaccagatatggacctgactcaatttgattcttctcatctatggaagtaggcaagttgggctggagcactataaattgtttatgatttgtttgtgatgcttttgcccacccactagtagttatgtaaccatgtgaagcaaggataaaatatttcccaataatgttgaagaggatgtggtattccccaccaagattgaagaagggccacttagagtaagttacctctatctctatcaatcttttgcttgatcattgattcataaatttaatcaacaaggtgttatttaaccatcatttagtattgatctaattggaagtctttggtagcacaattctcatatgacctacccaacacagtttagttgttatgtaacatttcttaccttcccaatatgtatctatatggcgctgagcaatgctatccatttttggcaaatagtttctgagtgtttctgcattaagaaagctcatgagcaaccttctcaccatctttgcctcatcaccaaccttattaaccagggacaaccttaacagcctccttactgaattaggccaccagacttgaacattcttgttctcattgctaaatagaaacttgttcccaactggcccgcaaaacacaacaacaggatctccaaacattgaagttttgaacaccctggagtcatatttctcctttctctcttgtatgaaccttaacacgttgccgtcattcattgtacgcagaaactccaaggtttctccaacaacaggccatcctaatcttccaggaggaagattgaggtttggatgtttcctgagtctgaaaactttagtaatgaaatacagacaaaggacaaagaatgccaaaactgctggcaagactacaaggtttgtcccctccataagatttagtgtccttaagaccttaactattgatgaagagcacaagacaacagagagtatgaaagacaactctgggaaccaggaaaactgtggtgtaagatggatgaaagacagaaagagtttgctctttggaataggactgaaccagagaagttcaagttatataacttaaaagcacttgaactgtgaactacaattcagtttatgttcattctggtttttgttttaaagcaaaatagttggtcctccaattacaaaacatgaaagtgacacttcaatattaatgtatctttccctgttgctccaatgaaaattagtccttgatggcatcactataacgatcattgaaggactaaattgaatatttacttaacattttgtatcttacccttttgctccaatgaaaatcaatcaagaggaataaagcttaagaaagtaaacattgtattaccgaagttgtacatatggatacaactagtgaaccgacaaatggaagcactaaaataaatgggaggaaaggcttagtgggatacatgataaaccatggcatcgtcaaagatactaatctctttgttgggacgatatttagcattgtaccataacatttgtgacctgcggcattgccattattagacacttggtcagatgaaagctatgccataagtccataacaaaccttgtggctgttaaatagccacttcagtgtttgtggccttatgagattattttctcgttttgcaatgacaaaatgatcatgtttttgtctatcccttcccctctcttctgttccgctgatgaagttctgtcatgtcatgtgcaatggttaacttctatctatactgatgataagataatatttttgtgattaaaaagaaaagtaaaaaataaaatcagagagtttttattaaatagtaaataaaggcatttccttataagataatatttttgtgatcaccaataaaattaaccatgtgcaatgttctgtcatgtcttgtttctaagcctttctttattatttaataatcatgttaatcaattattttgtttcaaccatgtgtaatggttaattttgtttcaaccaataatcatgtgacactaaataattgattaacattccttaaattaagggatagcacaattaattcttgttaggtaattaatgagtatatctttaatttaattaatatatttttttattgtccatgtgtcacatgattattaattgggaccatggatgacatgatggtcctggatcactcaataatttttcgaaactagaatacatcttgagtatattgacgataataacctaacttgtgttttcgtgctagtatttgcaagttacataggtggaataaatattgcaagatgataattgtcgaaaaaggacacatgacattgctggattggtttctttatttttttttgtcataactcttcgatttactaggaaaaatggatcccgactattccagttagtcaataattattttcgccaaaaattgaatttgaatactacttgaatgattcaaccttaacttctccacattaactacttatgtttaatcacttgattaattggtttctttgtttgatagaaaataaagaaatggaatggatgaaaataaaaaggaaaaaaaaggtgaaatataaagtaaattataaaaagtatttgattaaacaaaaataaagaaaagatcgagataaacatgagtatatatatatatatatatatatatatatatattaatgtcttacaaggtacaacaatgataattttaaacaaattcgttatgtttttaaatattttaaattttaaatcttaagtgtacaaacttagagattatgatattatttatatttttaatacggataatgagaatcaactagtgatttatgagtcagattttaacccattaatttagtaatctcatcaaatcaaatgatttactcgagtctcataacattgacagtaattatatatacatggtatgtttataggtgcgtgctataacgtgtaaatgagtgcacaacaacgtacccttgaactgaatatcctttaattttacgtggtgacccaagatcgatgaatgccttaatcgcatgaaagtgcataacccacccacacgtacagaaaatgggaaggagattttgtgattcatgataaccccacccacgtgtcccatttattaaaggaaatatccttgtcaatactgaacctatggaagcgtaagtgacgaacccaggtcagattgattggtagagtaaagatacgttggctagattgtgttggctctatcctcgtttggctagaattttaattcaatcatccatcatggttgtttaatacgataaatgaagtggatgacaaatgtttcaatccacaaattattttatgatctcgttttttctcgaacgcattgatcgagttacaacatactagtacttacattttagtctctaatattaatgtcacgttcaatctcatttacttctattaattcaaagtccatttaactaataagtcactacataaatattatttcacgttcccttatgactttatagttgtcaaatatcttataaaaccatcagcgtgaattcaagtctggcataaaaaaactatatataaatattaatgtttgcttttagtcgttcatgatcattttttcttgtcttaattcgagtatctttatactttcaaattgaaatattccatctctttgaagatattgaaattgctctaaatagagctatttttattttaataatcaaattagagtctttggactttttagtaactttctaaaatatttctacaaaattctattgtttagattaattatgcgactaattttcaaaactttgttatgcttaaaacttttaatgatatcttacatgaaaattgaatctaaatctttttcataaaactcagcttatattattaacggagtcatattcatttggtagtgttattatagttttagtatataaatatgagacacagacaaatacatgtacaccttaacaagtgaagttttctacaacgtgaatttaatttaattctgaaacaccggattcttatcaataaattgtttgccctatcaaatcatattcccagaagttatggacctccgcctcatagtggtgacaaagttgataagttatggatctccgctctgataagagattagtggaaggactaatggacgaatcaagtggtgacaaagttgatggtttcgttttgaaaacatgtactgttgaacatttgaaacttctgtggttgagattatccaagacaaattgtatcgcatttgtctactcctacatcatcattgtagtgactcttgctaatttagaaatatgccatttttagcaacaattctgtgcagactcactattcaaggcctccatcgtttgagttttatttctagccaaaacactaattttataaccaatgtatttaaaaataattattgtttgagttttataaccaaaacactattcaaggcctcgatcgtttgagttttattttttaaagtcttctagagtgagaggtcatggaaaataaattatttaagagggaataaattggtatacaagctcctacaagattacttcaaaagaagaaaacctgggaacaagatctaaaaaaatcttataacttgtgtatgcatataaatggatttgaagataaccaacgaaagttttcacaagcagccataattgttttataacaaaaaaattctgggcagagatgtttatgagtttctttgggtatgcataattaggcatgattcaattaacacaagcgggaatcaattgttctgcctctcactatatataaagcatgcaaatggggaaatattctctaaaagaaaagaagtaaatcattttgaattgaggattgcgtcaatgattaaaaagatgcaacaacaaaaatccataatattcaagattgcaaacacaatatcatataaggaaattcaaatagaagcaatacatgttaatcggggagctatatatatctatgaatgattagaactattcaatttctttttgaggtctatagaatatggaacctttgccttgcaattgtttgcatcccatacggcatgcattttggcactctgaatctgctgcgaattttatcttcatgcatatcttcatgcatttaccgaaacatgtggttacgggtatcttgccacgttcaacttcgtgacctgttgttgaatctactgccaccaccaatggcatgtatagaaccaagatcaccgccaaacctaaggatttgtaaaccattgtattgtatttgctgtgggccaaagaaatgcaaatatatcgaaatgtatgtaaaatggaaatttccttggaatgttgcgtgtgtgtggtgaaaaatcgatcaattggttgactttgttctaaattgggtttaggaatttgttttccaaaattaaaaattataggaatttggaatcacgagcacggtaaagaagttgtatagtactcaaagaagattaatcatcgccactccaaataataataataatttattattattattattattatgataagaagataaaccattaacttggtaaaaaaaacaaataatatagaattcaatacaataatttatttaattacatatcatagaatatattgaacgacatacagttgttaaacataaccaccacatagcaattaaacagttaaataaaaaaactcgtcattctaaaaggttctattttaattaacaattaaaacaatggataaataattaaatttttctaagaagcactcgtaaattaattcctgaaagaatgacaaatttaaagttagtattcgaacatataaaaaatacaacaaattaattttgcaataatctaataataaattggtttctaaaattataacttaatgtcaaattaattctaaaaaatataattatttatcaaattgatcgttaaacattataacctaataaaaaattgtttcacaaatttaataataaaactaatttgtcacattttttcacatttaagaactaaatttgtatttttatcttaaagtaaccaatttatcattatatcacactttgagaaccaatttcaacatttacccttaaaacattcataataatcttattgattaattatataagtatttaatagcatcaaatttggaatcaggaaaagaaaattatgtgacatttattgggatggataatagaggtgctcatgaattgaattggatcaattttaaagaaaaaaatcattcaatttaagtaatttagttttgttaatttatcatttaattagtttaatttaaacttttaattcgatctgatccgatctaatttagagcaatttggattagaataattttttattttaatcctttttctaattttttcagaaagtactaaataaaatgtgagatatatatttaaaatggcaaatattttatttatatgtcattatgtaactaataataaagtatttatgtattttaactcaaataattagtaaaaaaatctttaattaaatgcattttttataaatagatataaattatataatacttttataaatttatgagacataaaaataagtgatattataaatttatgaataaaaacatataaattttaattaattgcagtgaacgtggattgaacacatacgttcagatcttcagtctcagactctcccaactgagctatccccactctaaaaatattatttggttaagagttaatataactaataattaatataataaatcatcttacaaccttaaagattatccaaaaatataaaaaaaaaaaaaaaaacatannnnnnnnnnnnnnnnnnnnnnnnnnnnnnnnnnnnnnnnnnnnnnnnnnnnnnnnnnnnnnnnnccacgggagaagtaagtggacttatccaccctttcatttctctctttacaatatattgacccttttttagttttagttacttatataataatagtataaatagtaaaacttaaatgggtacgcctttaaaatttgaaaaagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttgatatattaattttgttataattttgcatatttcaaatgcattttaagtaaatattgttcaataattcattttcatcaaataaaaacaacctcatttacgataaaattgtgtcattaattgatattaaaaaaaagtgaaatttttcactctttaacaattgtttatatttattttcacacttaggacaatcattttgagtgaataacacaggtataggtaaaataaactgtttgattttattataaatgtttatgcacttaaatattatatttattgtattaattctattatgattttgcatatttcaaatatgtttttagtaaatattatccaattttattaaataaataaatatatttaaaataaaattattacattagttaaataaataaaaagtataagttgttatattatttgacagacgtctatatttattttacagtttaataaaaaataaaattcaaataaaaatgcacaaatcatatgtttaaaaaatctatatattgaattgtttgagagataattataatcaattcatcaaaactaaatcatcaatcatcaattgttttccaacccctagctagagatgttgaagctaggccatcctcaatgtcatcctttgaccgtagaacctacaaatcacaaatatcatcatagaacaggattgtatagtctttatagataattttaactcttatactatagattgttttattttcgtgtaattatatatgaataaatatagtcaacaattatcttcttttacagattctgaaataaattctatcaagaaataaactaatcttataactcataacttaacaatcaagattttactctttttattacatctcatatactatttcaaaaaaattgaatgaaatatataattatattttctttaaaaaaatatatagttattaatcaacaattatatgtacattttttaccctaacgtgcggccattgagactggtcaactccatggagaagaaagaaatgcgaagagtaaacccggaggagataagaagtgactaggtaggtcaaattttgcacatgttcatgagatgatagagagaagggaaagaggaataatcgataatcgagaatcgagatggtgtggaacagcatgatggtgttgagagtggcacgtgtctctgctcaagcgtggcagtgcattgcggagcctgagcctctgagcagtgagcagatattggatctgctttgctgtttccctctccatcaactcgctttctctctctactcctttttctgcgctcctcactccaattattcctatttcccttctcactccgactccgactctcaccacgatcattcttccgatttcgattactattaccaatcctattcagactgaaaccaaaccatattaggtactattgccaattcaaatttctccaacaatgcttttattcaaattccatccttattgttaaattatgttgaaactcttttctaagcctgatcttgttgccatttatgatttatgctgtaagaggaatcattttactagagaggaaggaacatatctacatatttatgacttttgtttttgctggagtactgagttacaaatgtttctattaataattacggaaacgaattgctcattgtcttgagagtatcattccttcatctcagaataagggaataccaaacataataagaggagtgagactttcattcatttttccattactattcccatcaagcaaagccattccaatgaaccaaaagttagctaattggttcgtacagaaattcacagaatgccatttctacgctagtgttgtcatcacaagagttgctatggttcgaaatgttatccaataacctgcattatgtattcaccttgattcattactcaatagatctaagttcttgtgactactcctgcagttaaacaaattttgacaagttgctagaaattttgagtttatatattaggaaatcctgcttaaatttcttcaatgaaatgttgtgttcttttgggaatgtagattataagaaggatttttttgctttgtatttgtccaaattctgggataatttgctgcgagttattgtcgttagactctttattatgtctctgctgactatgctttatgcccttttgacaggaatttgcctgctaattatctccatgaagtgatgtattgatagactttgggtggtaagacacgagatcctcaattgcagtctcttgtttctcagtcagttccttatctgaggatgaaagcttttttcttttttttttcgaggactttagtagtgttcaagctgcctccattgtataaaagcatcttttacacttagattcttgtggttgattgattgatctcttcacattttatacccttgtaaagagtgatttgtgagtggtaatatataattttaaactgcccttgaaagggagttttgagatataagttacttcaaaactgaactttgtatagtatatagtatatagcatataccttcaatcatcccatatttctgaaaaattgacctttttttatacttttttctttcctataacatgaggttttgctcatgaaggtaaataatcaatggtagcagtaccagaattcaaaactaggatgtgcagtattcctctcaagtgtttttagtccgaagaaagatgactattattctaaagattttgaatggaaggaaaaatgagagggcaagattttcttccttttcatttttgtctcctctccaatattagtatcaggataatctggaggatgttgacaaaattattctcaagattttagtaaaaaattatgtcttttaagattttagtaaaaaaattattctcctacttacatacaatattgtggtcatataacgtaagatctccatatataccagatcggggaaatgagatagtaaatgatgtgaatttctattaatcacatcaccatttatgagaaattgcacaattttttttagaaagaacaaaacaaaatagatactatatatattatatagggataaaaaaaaacttattaagagtactgaatttgactataaaaaattattgactttgtcttataaataagattagagggaatgattttttgtctagatcacaagtattttttgttggaaacaatcctattcaaatcagatgtttaatatggaaaataaaattttctttcgaattatttaacacaattacatttctttcattagataaattaatttatttaatgaaannnnnnnnnnnnnnnnnnnnnnnnnnnnnnnnnnnnnnnnnnnnnnnnnnnnnnnnnnnnnnnnnnnnnnnnnnnnagaatgacttaataaaaattagtataagttaaaaaaataattgatatttgattaattaattatgttataacatataatatgtttatgtatagttagatgtcaactataaatatttattaataactaatatataaaaaaaaattaatgtacaattatagataatatataatagtttaatttatatttcataaaaaaattgtagatgtctacaagtctttatatacggttatgactatatataaaaagacatgccataaagtttatgtgggttttatcttgttgtctggttctctctctcgagttcctgttctgcttatctgtgagaaatgttactgtaagtgaataagagaaaaatgtttttgtttacaannnnnnnnnntataacgtaagatctccatatataccagatcggggaaatgagatagtaaatgatgtgaatttttattaatcacatcaccacttatgagaaattgaacaattttttttagaaagaacaaaacaaaatagatactatattatatagggataaaaaatacttattaagagtattgaatttgactatgtaaaaagttattgactttgtcttataaataagattagtgtaaataattttttgtctagaccacaagtatttttcgttagagacaatgctatttaagtcaggtgtttaatatggacggtaaaattttctctctaattatttaacacaactgcattcctttcattagataaattaatttatttaatgaaattatttttgatacatatagttatatatctaaatctgaatagttaaaatatatggaatttgtattgattaattataatgataagttatttagatgatatgaaaatattttttttatcggtttgagtcttttagaagatgtaaaattggaaagtggaagatttaggatacaaatatttaattttatgttctgattttttggttgaatattaaatatattataaaaattatatcttttggtaaaagtatattataatcatgaaatttccttcaaacaatatatattaatatgacgtataatcagttttatttggtaacgtcaaatcatgatgaattggtaagtcataacatcgagaaaactcaaatggttgaaatacatatcttaatataataatgatcgaggacataaattattggctaaattactgtccataatctgcaaattccagggcccaaaaggataaattaatgttgttcttgattgaggctcttactactatttgatttagtcattaatatcattattatttctgattacatttttcctccaatagtgcatgtactcttatagaatatataaattctcatcctttgtccacttttcacttcacaagcaccttctagctagctccatttagattatttgataactaaagtatagtagtatcatttttatttttttatctcaaagatgaaggtcatacttgccgtccttctaaactttgttattacttcatctaacttgtgtgctagagtaaggcctgaggcaagtcccagcttcaatgttgttagctacggtgccaagggggatggcaaaactgatgattcacaggtatatttttcctagtttcttataattgtatttataaatgaggctatatatatatgtatatatatatatatatatgatgctacattaaacctatttggcaatacttgtaaaggcttttgtgaaagcatggcaagacgtgtgtggtgcaactcaggagactgcaacacttgacataccggggggaaaaacattcatgttgcaacctgtgtcgtttcagggtccttgcaaaccagcaaccattaacattgaggtaaatcatagtaaatgaattacttacagtacatataaatctgtgaatatatgcatatgccttaattcagccatatattgcttattaaagtttttaattagcacatcttcaatggtgcaattatggtaaaattgcttaattcacttttaatgtgtcttacaatgttaggccttaattgatcagccaatatatattatgcttattaaagtcattaattagcacatcttcagacttcaatggtgcaattatggtaaaattaattgcttatctcatgcactcttagtgtgtcttacaatgttatttaagagctttcaaaatccaatggtacaagaacataaaatgaattctacaattattaatttcacagttgtttgtataagaacttttacatcaatgttacttaaattcaattggaaacggtttcataatatatatatatatatatatatatatatatatatgaatatatgatattctttattaattaatcctcatttgaatcgcagcttgaggggactatcattgccccagaaagcgttggcgcttggaaatggccaaatggcgataggaaatggatccaattctcgaacataaatggccttgtaatcaatggaggacaaggaggacaatttgatggccaaggtgatgcatggtggaatgatgtctctaataggcccactgtacgttgaaaattagtaaaatcatgacttaattactcttcttttaattcataccccaaaatcgaatattaatttcattcattcaaatacttatgtgcatgcaggctcttcaattccataactgtggaaatctaagtcttagcgccacgactcacatcaacagcccaagaaatcatataagcattaatatgtgcaatggcgtaatcatttccaatattcgtatcatggcaccaatgcagagtccaaacaccgacggtatagatatctcagcatcatccaacatcttaatacagaattccaccattaaaaccggtgatgactgcattgccattatttccggttcgtccttgatcaacataagtcgtattttttgtggacctggtcatggcataaggtgggcttagttcaagtcaatttccagcttattatccagtatatataacatgaattaagaaatttagtttaattgattgaataaagtatgtgagtgttatattctttgatatttcctttagtgataaattcagcagatttttttttcaataggggcaaaaaaaattataattttcacaaaatacataatattataagaaaatctaaaatatcaatatttttacaaattataattattctttaatattttcatattttaaaatttttgtatgattttttattgataatactataaaaaaatacaaacataaaatataaaattaacaccaatttatctcttataaatatttacattcatcttaaaaatatcttatgggggtaacttcaattttttatgagggcaaaataaaatttattatacatagacaaataaaaaaaatattatgcgtgggaataattgcccgaataaactactatatggatccgtggttcactatcttctgttccttataagaaaaaaaaagcgtatatagcatgacctttaactcgtggttaatttggtgaatcctagtgttgggagcctcggacgtaatggagattatgctagggttgaagaggtacgtgtgagtaattgcaccttcaaaggaactgaaaatggagtcagaatcaagacatggacggtaacgatatgattgattaattggctctctgtctctctctctctctctctgtctctctctctctctctctctctctagctagttaatactactattaatcacaattaatgcatattatgtgttatgtgttagggaggatccggttatgctaggaatatcacatttgaagatattgtagttgttggggttaagaaccctctgattattaaccaaaattattttgggcttgaagaagaaagtagtggagaaggaaaagcagtgcaaataagccatgttacttaccgaaatgtgaagggaacttctagtgtgaaggatgcagttatactgaattgtgatcccactgtagggtgcaccgacattgtattggatgatatttgcataaccactgaagatggcatgaaaacacaaggatcatgcaccaatgcacaagggatgtgctctgactgtgatccaattgtctcatgtctttccaacaaagattaatttgtaataaacttccactagtgtcacgtggagatcatccaaatttcttgtctttcaaactattgaaatggcatactgagttttgttgttttttaaaaatttaaaaggctatattataaattaagttcttcctttcttttgaatatataatattcttttctttagttgttgaattttttttattcatttatttttataactactataaaagtaatgaaatatatatatatatatataaggacacctgattccatcttttaagaattagaccaaaggttccttatgtaactggtggcatcctccttgagtccttgggttgcatggatgtatataacagtatgaaaagattgcgtttgttttgttttttttttttttttttttttnnnnnnnnnnnnnnnnnnnnnnnnnnnnnnnnnnnnnnnnnnnnnnnnnnnnnnnnnnnnnnnnnnnnnnnnnntattctattgtacacggaaaaataatttcatgaaaaaggaatgattggaaattagtaaaaaatcactcacatggatggtgaaaatagcaattgctgatataagaatagcagcgcattagttgggctacttctgtacagtactaataagtccatttatggatgtgactggactcagtccaaccaatgagcaatatttgttttcattgtaggttttttttttttgttctattttagaagttatgtatcttaatttcattttatgaattcatcttcttacttttttatataatgacaaaataaatattactgtaaaattttgtaattttatatttcactattgagcttattttaagttgagagctagtcaggaaaactaaaagaaaaatattaatagtcctagggcatgtttcactaaatctaaactaaaccttattaccttcgagttagacagcaaacagataccactaatggcaatggcatggttttaatttttaaataatctaatgaattctgagtttggtttcattctaaggcaatgcaaggaaaggctacgttggattcaaaactctagtaggaaatttgttggacaacttgcctattctttcgttagggtgtccagattatatgttagtcaacattgttttgagtttattataaattgcatttaagtcattattatgattggcatgattattttgcagtaaaaagaaaaattaaataatacttattcgttatatttatatagacgacggatatttaaataatactactttgttgctgtggatttcctctattttttaagtctactctcttcttcctatataactatgagttgtttatttttttacatatttattaaatatatatttctcttaaaaaattaaatatttttctcgcaatcatttttacttttaatgcttatgttcaaattttatccaaattacaaaataccttaataatgtttgatatatctactagtgttattgaaataattttactttatattgaagtttttttttgcaatgataacaataaagataaaatctaatacttcatgcatattacttaaacttcttttcactaggctggctcactaaaaaatttaaaaaccaatacatcgaaaataggttattattggttaaacacaaaatgtaccatcaaagataaaataaagtattcaacaaaaatgattaaaatctaattgaaatttatataatcgatacccaaaacagaacatggaacatgtatgcctgtattcaatgttcatttcgttctctctctttttcatttatattcttatctttttcaactgtttaaactcctttttttttgtttacttttatatatgctcttctctttgtaaattttgtttatttgtttttttaatttttcagaatttaaaaatgaattggggcaaaatatggaatttagcaaacgctaccatttttcaaagctccattgaccgtgattctaaagcagggataatctttgcctatgatatgggtgagtgatgcaaacgtttccaagggtttagaaccagatccacactcatgtagttttatattcttgattaactttatgttggtcaagtcgtctatacaaccacttttagtcaatttgttcacatgaaaagactgatgaaaattgaaaaatgctaatatatatcagtagcgttttgagtgggtgatcttttaaaaatgaagtgatgaaaacgctaatagtattaacgtttttatacacgtagtgtacattgttaatctctgaaatccacgtgttgtccatttgagatatcacaaattaacaatatcctacgtgaacaacatatggtgcagtttatatttagaaaaaaggaaataaataatttctggaaacactccattgagtagcgtattctaccgttaatttcccaacgtactttaataatacgtttcaaaaaacaatcctaatctgattaaatgtttgtaaagtgaaattactatgatgaaatgatcaagcagccaaaaacaaaagcaaatggaacatactaaaaataaaggcccaattataatagtaatatcacatcccaatgatgcacctcattttctttgttttagttgctattttcagaaattgagtgcgtatttaattcagaatatctttaatttttagaacttcaaagaaaaacatttcagactttattttttttaattacccaacatgcttggagtgcttttctttgtttttgctctgagtaagaattttttgcgttggtggggtgtgttgtcccaatgtgtgtggatgtgagctactaccacaaaaactcccttaaattacggtccaatatccaaactgattcagagaagaaaataatccatagctaccgcagaaccttcaaaaagcatttggtatcttcatatgccttttcaaattcaatgatacaccattaggggaaaaaagtaacgtttaagtcaatcaatcataaaatttatgagtaaatagtttattgtaaaaaaacaatattatcattcaattgttaattgtcatatagaattaatggtagtgtatttggtttgtggtttagacgtccatatgagttttacttctcataaaaatcattttcatagttgaattaaaatcttaaacgtaatttctattcaaattgaagttaagtttgaagttattcttctattattttttcattaaacgtaaaagtttcaaacataaatcaagttatattaaacttgtttttaactaaattttacaaagttgggatcaatcaaatttggctttctcaattataatccaaacacatactattttaacttttgtgccttgtaatgcatgttttttcaattagttgcactcaactcaactggcgttgaaaaaacaattactctcacattgctttggtttttgtgccataaaatgttttttttttcattgaatatgaatttaaacaattaactaaacacacactaagttattgatcttaatcgaaatgagttggaatgcttaagtaaaatttaaaatttgagtatagtaaataaaaaaatatggttgaaaagttcaaatttttttaataattttcgttatgaaagtaataataatttatcgcaaaataaaaaatgttcatgactttttaacaagtaattcaaataattcataagaaaaatcctacggcaattcaagacatatatatcttcaattaattagaatgtcactctttcaatcattgaagtaactgtgagcataagatttccctcttatccatgataacccgaacatatatctatcgaagtacacattaaaaaatattacaaaattaccaacttatgatagctaatagcttacttatttaatagtacgatagatatatgtcatataaaattagtccattgtgtcaaagtactgctttaaataacattaacgcaaatagcatatgaggaataaattgtcaacatccaatgtcaagactcaagaacaagaatattgttttcattctctttcgttatgcatttcgatagttcattcatttccaaccaaacctaccatatttgctaatgattatgtgatatcccaccttgttgaaatgctttgctactttctaagatctatctaatctatagtacatataaaagaagacaatgcattttgtagtcatcatatagagctgacccattaaaacactatgatcacgattcctgtaaacttttttttttagaggggtaaaagtaaaacaatagtttgcaaacttaaaaagatgaaaatatgtagaccccaaagaattgttttgatcaaaatttccagcttgtattccttcccttttttcatctggaacatatatactatattcttctctaatactataagttatttcaatcctacctttaagctttctaggaccatttgcaaaagtctcccacttgcccaccattataggatcctaaaagcgcaataattcgataaaaaagaaagtcgattttctatcaaaacctttacggccttgctatagtttttatttatttatgaacatttgtttttgtggttcacattaatattgggatatttgaacgagacataattcatatgaatctgattttagtatggagttgtgcaatggaaatgcgtccttcagaagaaaaacaccgacactgacacgagaacatgctctgtttgcacattctagatgatgctggaaaatcaacactgcaaatatagttggctatgcataattttattataagaaaaatgctttctggtttattcattgaaaggcctatctttatatgtgcaataacaaataaaggcagatttatatatagaggaatggtgtaaaggaataatgatgagagttattttaagagagagaaaaaaaaaagagaaaaaaagcttaaagaagaaaaaggagaaagatagagaaggaaaaatgagcaatcttttgtgtcatagttgtaagaatcaaatccaaccaagattacatccttattaagtgtgtttttgatggtgtagaagaaaaaatatataaagaaaataaagaaaaaatatttaaattaaaatagaaagaggtgaagaattcatgctatttttaaaaaaattattcttaaataataattttctcttttcaaccaaatcattcctaaatgaataattcattcgacagcagcataatttaactgatttgtaaggttaggtcggttttaatttttgctagcaaattagtactttatatctaaaaaacaaattagtactactttttatttttaaaaatagcaaaatactacttttcataataagacattcttatgtttgtttgttttttaaatgctaaaattatctctagaaaagataatcttatttaagttgaatatcataattataattagtaaatatctctttttaaatgttgccctaaatactttttaattcttgtaatttagtgttttttatttttagttcttgtaattttatttttatttttaattctcataaattatgtttttttcatcattattacatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttaatgttctctttcattttgaaagagattttttttagaagtgtatataaatataaaagaaataaaaggtaaaaataattatatataatgttaaacgtcatataattaattgattttgaaataatagaattattacttggcatgctaaatattcgaggagatttgttcttttatgtttttcctcttaaattttcctcttaaacaaataataaaatataatatttttatcctatcatttatatctccttccttctctcttctttttaaaacaacaaagggattagtccttgtcattttttttttacaaaatagattaataacgtttttttccaaaaaatatagaaaagattaaaatttcatatatatatatatattataaacataaaaagagatatattgttgtgtatatatatgcatgagggatatgtgaccaaaaaaaatatataaataaatgatcaaattatatcattnnnnnnnnnnnnnnnnnnaagatattttattagatctatatattaggtcagtaacaaatatattattaatatataaaaaatatttgaatttatgatgtatcttacaatcaagcgaatgtaatggaaaacaatacatatgcattgtttatctttaattcattcttatttatagctaattgtaattttgtaatattaaattgattacatctttacatcataattaataataatgctatggacaattttaagccatatgttatattttaacatatagcttaaagtgtctcattttttatttttatattaatatgaggcagtaaaatgaaagtatgtaaaataaataacatgaaataaaattgtcattgttatgatcgttaaattaataaattaatattttattcataaatttctatacgatataaaaaaaattataataattcacccaattaacaaagaattagaacttgttagttcataaaataaatttgatgtattatgctatttttttatatcagagaatggacgttaaggatatttaaaaataaagttcctcaatggtggaaaaaatgttctaaataaaatattaaacacgcagtaacacataatgtttttatcttccccaggacaatcctgtgtcacttgggtcaaagaccaacattggattccttttaaagattcgaagatccaaccgttgcgtaattcccatttttggattatttttaaaaatttaccattcaataccgtacagaaatggattcagttctgtgatggtcacgggcgcgcctgtgagtgtgatgatgagtcgctgtacacgtgtagggtcagtgatgcactttgggtgaatgtgaatgggtctaatcaccctggtacatgacgaaatctctctcacttacccttgctactacttctgcactggattatcatatctcaaattttccatgatcttatgttaaattcactttactttttttggattaaaactctcattgactatgattcattcatatcaatattattacattgttctagaccaaattgatcttaaactcattaaataagatcatgagttcaaatttaataaacgttattataaaaatagtcttcattataattagtaagaaaaattctctaactgttattaatattttttatcctatatcaatgatagcggaagtttcttaattcattaaattagagatctatttcaatctagatacataatttttgttgggccaacactttttgtacacataaaaatcaaacataatctgctaaataaatcatttactaattgtggtggaagtgtgtaaccttacaccactaccgaagctctatgggttttaaaattattagtataatgtataataaaaaaatgagaatgacttaataaaaattagtataagttaaaaaaataattgatatttgattaattaattatgttataacatataatatgtttatgtatagttagatgtcaactataaatatttattaataactaatatataaaaaaaaattaatgtacaattatagataatatataatagtttaatttatatttcataaaaaaattgtagatgtctacaagtctttatatacggttatgactatatataaaaagacatgccataaagtttatgtgggttttatcttgttgtctggttctctctctcgagttcctgttctgcttatctgtgagaaatgttactgtaagtgaataagagaaaaatgtttttgtttacannnnnnnnnntttttttttttttttgtaaatgttaaattttattaatctgatcagattattacgcttactaacttatataaagtgtaaatatttataacttgtaaagacattaaattactaagttataacaaataaattatagaagtatgttatgaaaatgaattaaatattttttccatgaaacttagtattttttttttgtttgtctttacaaaatattttttttatttttcgttcttaaacgttttagataatgttttgaataataaaaaaaatttaaacagtaaaaaatgttatttaaagaactttaagaacaaaaaataaaacaaaaatattttgtaatgattaaaatgaaaaaaattacagatacgnnnnnnnnnntatatcattattattttgactaactattatatcattcattaatttttaattaaataatattttagattaaaagtttttctatcatagatcatatatgtaaatttatgtattaatccaaatttatttactattttatttatgtagattaaaattaatttaatataattttttttaaatatattaaaatatgaataatttgattatctttttattgatatttttattgataaattattatgtttaatttaaataaaatttgacacaaataataatatataaatataattcaataattgaatgaataaaatttatattttatatcaagttataaaataatgtaataattatttaagttatattaatataatttaatttttttctctcgtgtgtgtatacgtacatatattagtttttaatactcactcttcaaataatataacactgtattgtttactttttgtgtgtttatttttttcttgtttcccttctcccaaaattttcctacccaaacatagctaaggcaggcatctattatgtcattgaaatagattttgtcgaaacaagcttaaacaaagctgaggcatttattatgtcaatgaaatggattttgtcaaaacaaactaaagtcaattctcgatgctttaatgccagctaaagctgtagtacacacaggacatcgttagtcagttgataaagagcgatgaattcgcgagtgtttggtatatataacttatttttacaaatttatcgacattgttttaaacaatgattgtttcccgaaaacaaattaaaaaaatgtgtttttttcagatcatgttttttttttctttttaaatttttagataaaatatgttttttgtttattaaatatttcaaaattcaacttaatcactataaaaaattaatgtttcttcagcctttacatttcagttcccaataaagtacatggttttagtttatgataagagactaaaactacaccacattttataaatgtagaagttaaaaacttatgaccttaaaatttgaatttttttagggataacaacatatttgatcatatttcctaaacaataagaaatatttaacataacaaattactcaaatgagtaatctatagcattatcgtgtttactaattgaagctatatttactattatacttgtgaaggtgtaccggatttcaaaactgaaagaaaaaaaatgttaaatgaaaatgaacccgagtcatattctattcataaagctagtaagtactcagtactcaccacataggttgttagaaagaaattgtgctaaagttatttgagattatgaaactgatttactttattacaagctttaattttattttaacatattttttaatgaaaaatattaaatttataaacaaagtttcatataaccaggggcaaaattagaagaaaaatgttagggggccaaaaaaattaccataggccgaagactaacgaacttaatgcttagggtcaagggtttgtggggacgaatttttattttaattaactataaatgttggaggctttttgatattttgaagaacgactgtccctgtacccttacacctagttctatccctcaatatacagttttttttttacatttttttttatggaattggtgtttacttaaatagttaatcaaagtgtagaataagtgtggaaatggatcttttacatttcaaaaattaactacacctaatggtattcttatcctattgtttttctttatacttataactttttatgatagctgattttgatgattgtagttatttgtagtttaaattttgggatatacatgttaataatatgaagtattaataactttaccagtaactaatttttattaaaaaaattgattgattatttttagtaatttttttttcatctttgattatgggattttaattaaatgatatgaacttagtttcatttgaactcatgacatgtttggtttgaaattttgaataattataaaactgcagttcgtctgctacaaaattaagttccttcaaatagacagatatttaatatttttttaataagtactttcaaaatgttcctttaaagattattatttctatttaaatattataatttaaccacgcgtcaagcctcgattattaatacagtaaatttatatcaatttaaagttaacaatacagtaaataaataaataaaaactttatttataaacctacattctataggacatgtggtctgcgagatctagaaactagtgctttcgtttgcatagaatatattatcacctgtttaattgtgatcgacttctaagctgtatgaaaatgtaacaaaaattaattaaaaatatttattatataaaaatatataataattatcattttttaattatttaaaatcaaccctaaaaactgatgtgtattcctatcatcgcaactattttcttgagatgttatgtctattgggtgatggagaattgcactacgattccttaaaaaatcgaatacgattcaaaaggaaatatcatattttagaattggaataaaggaatcattgtctttagattaacactaagataaataaatgaaacacatggccgtggatgcgacgccaagttacacgtgattgtctcagagaattgtgtaattaagtatgtgcatacaatatctgcaaaataatttttccatcggattcccttgtgaatgattaaatataacactttttttttttttactgagaaatggacccacttattcatttatcaaatgatgaattgttgattgacattatcctttttgttagagtggaagaataagagtgggtactaattgcagtaatgagccaaaaatataacatactaattattattttctttaaatgagcacagtgagaattaagtgacctaaggtgataaagggcatggacaaatttctttagaagtatttttaaaagaaaaaaataagaaaaaaaataaaatgaatttttttaaaaatgaaaataagttatttattagctaagttttaaaagttcaccaatataacttctctaaaagatgagataatatctataaattagctaatggaaagttcattttaacttatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttctttctctaaaagtacttttagagaagcttacatccaaataggtccaaaatagattaaaaaatactgtgataaattaagtgatttaactcgttaatctattttaagtggtcaacccaccaatttattggattgaaggtggggtcaagacgagttattctatttagcctattaacattaataacatgtttaaataactttataattttacataattaaaaaagaatggattacaccctaaaaataatgttgatacaatgaaaatgtataaataacatctattgttttatttttctcataaaaataattgattcagtatcatcataaattaacataaattcactctctattaatccactcttcactaatgggttaacccacctcgcacttatgataagttgaatgtgagtttttttttttttaggaataaataggcttgtgttattcagannnnnnnnnnnnnnnnnnnnnnnnnnnnnnnnnnnnnnnnncagtgtacatcttgcactaaacctcttcaagccaataattatctctgggagttttttataattgtgaatttaagcttaatttaattaaaattggtttataaactaacaattgttttttatttatatattttatcttgatattattctataataattttttatatcattttagaattataaattttatttaactcaattttataaaattattttttaaataaaatttattctaacttatatattctattttgattttcagtgtggttaacgtgggatttgagttttatttcgctaggttaatttgttttgccaatcataagataatcggacatgtataataataaaaatagtaattaaatttttaataagtgattttttttcattgaatgaatctaataataatggaagagtaacggatagtcacggtcagaacttgggacaaaagttgctcctccttttacgcataaaaaggaaatttccagtccttttgttgctaaagaaggaaaaaaaaaaaaaatagaagaaaatttcaagtcaggttgcctgaaaagtgaaacccgtttaaagcaacaagaagtatactagaaaaaaaaactcttcggttaaattttataaattaaaaaatcaattaaaaatttaagttaaatagttacattatcttattttttattatcaacattttcattatttttatatattcacgcattttaaaaagccttttcctttttatttttatttttgaaatgcataggataaaacggtaaaagcggattgggtctggcacagtgccacggacacaaacactgaaacacgattcacagttcacaaattcacatcagtatctatctaaacgacaaaattaacacaaatataatatgataggaatgttagataaatcttattttttaagtatgtgattataaatttaattaaattatgtatataaaaatatttattaaaatagattaatttttgaatatattattatctccaaggattaattcttaatttttggacaatgataccattccaaaagaaaaaaataaatttaacatgtgatcattacttaaaaataataagaagagtgtgatcacttcattcatcaaaattataaacatatatacttacaaaaattatcaaaaaaataacatttaaaaaaaaggaaaaagtaagaaggagatgatgatattgttaatttgaaagtgagaggaaaatgacaagaaagagggagctagaaagtgacggtttttgtttaattatttaatgaatcaattattcaatataatataatgatggaaagtggaaggggcgagagagaaaaaaaaaagtatttttttttaagaaagagggaataaaacaaaagagggttagcttagtatggctgtttggtgtttagtgggtacccttgctttcatacgaagtgagaaactaggctagttagtcccattggttttttttttttttttgtggctgaagaaggtgaaaggggggcaagtttcactcttcaagggttttgaagggtgtcaacttgcgttttgagactctgaggttgttgaggttgaggttcaagctgcattttttttgaagggtggggatgggctctagttgtggttgtggtgtgactcttgttcttgttttctgcttatggggcgtgttgatctccctctcttctgctgctaggctcagtgctgcaaggcagaagcttgaggttgctaagcatttgaatcgcttgaacaagcctcctgttaagaccattcaggtctctctctctctctcgttctttctctctctttacttttaactttatgtttgtatgtgtgttttggggtgttcttcatccacccctattttggtgtttcttcttgttttaatctgtttggcacccaatgaaatggcctagttttgtgaagaaaaaagaaagattactttttttttgttttgcccttgtttgctggatgggagatgctactgaaatggttatgtacctttcaaacattttcacttaaaataatccatcttgcaagctgctgctaccgattttttttttttttttaagtattaggtgatttcttttcttctctgtgttttataaaatgtagatcttttatgtggatgtgctgatttctcaagccaactaaaatttccctttaattttttttcctcctacttacacccctataaaaaaaatatatagcccatttgatgggaactattgattgaattttgaagcagtaactagaaatactgtaagaaagaagtaggcaatgatttgcctttttttgtttatttgttttccctttctaatcagctactgggttttgagtaatagaaagatattggtttcaattttggtacatagtatttcaaatgttgacaatattataatgtgattttgtcaatgttgcagagtccagatggggatacaatagactgtgtgcctgtttcgaagcagccagcatttgaccatcctttcctcaaagatcacaagattcaggtccattttcctcactcaagatctattttttctgttctttgtttttcttcatttttatgtaattttttactaacaccatgctttgatttaatagacaaggcctagtttccaccctgaagggctttttgaagagaacaagttatctgaaaagcctaaagcaaaaacacatacccccatcactcagctgtggcatgcgaatggtagatgtcctgaggacacaatacccgtcaggagaaccaaggaagaggatgttctgagagcaagttcagtcaaaaggtatggtaggaagaagcacagagcaatccctaagcctaggtcagctgagcctgatctaattaaccaaagtggtcatcaggtaagaactgttttgagtgccttgtatttttattaggttttcttgtttcctcttttaagtaccttggtctaatctcctgatggtgtttttgtggggggttgtaaatcatcagcatgcaatagcgtatgttgaaggggacaagtattatggagcaaaagccactataaatgtgtgggaacccaagattctgcagcctaatgagttcagcttgtctcagctttggatattaggaggctcatttggtcaagatcttaacagcattgaagctggctggcaggtactaagaaataagaatcactattcatttataccaagtgtgcaatctaagtacatgcccttgactctgaattataactgtaaattgtaatgactgttgtgcatgataacaggttagtccagatttatatggtgataacaatacgcggctattcacctactggacggtaaactgtgatgttatttttttatgcatggctttgattttttattttaatgtttgtgttactccaatttattattatttttttttttttttatcaaactcacttgctgcattttgcagagtgatgcatatcaagctactggctgctacaatcttctttgctccggatttattcaagttaacagtgaaatagcaatgggtgcaaccatttccccagtttctgcataccgaaactcccagttcgatatcagtatacttatctggaaggtaaaatcccaggaatttcctggtttttaatctgcaaatggaaaccacccgttaagcatcttggggtctcatctcattaatcttccaactaggtgtttggcatgtggaccatggtaatgtcccccctagtgtttggattcttggacacctctatcatctttcaagcatttgtatgaaacatgacatgtggagatccaagcctatgtttgctaattcatagctaatatgggaatcttgagtttttaccgtgttcacttattaactggccagtaaaagcctttttttttcacctagtatcaatagcattcttcgtggtagtggcaccctagttagaatcatctttatagcacagatccctggtatctcctcccagtttcttttgatcaggatatggaccccaattttaattgatgatggggacactgttaacaattcagccatcaggaactttgaaaagtcatgaattgcttatactcatttctataaatgcacagaacacatgttgtattttcaaccttcataccctttttaatttacacacaatgctcttttctgttggtgagctaaacaatatacttttaagtcattaactttgttactggtactaattagttatcttttttctatttttcctccttgtaggatcctaaagagggacactggtggatgcaatttgggaatgaccatgtattgggatattggccttctttcctgttctcatatttggctgacagtgcttccatgatcgagtggggaggtgaagttgtaaattctgagcctgatggtcagcacacatcaactcaaatgggaagtggtcatttccctgaagagggttttggcaaagcaagctacttcaagaacattcaagtggttgatagctccaataatctcaaggctcccaaaggcattggcaccttcactgagcaatcaaactgttatgatgtccaaacaggcagtaatggggattggggccattacttttactatggaggccctggtaaaaatcctaattgtcaatgagtaatgatgagaggaaagttaaaaaaaaaaaaaattgcaacctctcttcttgtatcattgaatgctagtgttaaagcccttccttctcttccatcttgtatacccttttttctgtagtggaaagttttgactttttttcttctaatattgaaagattctccatgtaagctagtggagaagtgtggccaagtttctcaaaagcctaaagaaacaggcctgccttttataacatctttgtattttatttgtttgtccactcctcctccctctataagagtgtttgtcaatggcaatggagctggtcttttgtgattaccaaaactagaacttattacttactctcaaaatgagtcactaatgttgttccattaattttaactgattattatatggtacctatggttatggctatggccatgctttgaatgaaaaatgagtcaaataaaaaagtgaaaagtactgtgagaccagtgaaagaaaaaatgaaattgtattattattaaactttggacttaaagatgcttgaaaagggttgcatgtgagtggctgacagtactatttgttttgcatttcaacttttttcgtgaaaagtgggcccacttcttccaccctacattttcaatcgctttctccattctgcaaatccatcgttgtattaccattaaagcttgtgaacaagcggtgctaaaagtcgtaggtccagctcctttatatggatttagttttcttgctcgataacaaaaattatatattattaattaagagtcactaatattatcgtcttaaactaaaagtagaaattttaaactctgaaggattggtttagcagtaaacttgatactaggcaagttatgcaatggattatgtggagacactttttaaagcttttagttatgtaagttagttggtgttaaattgatactaggtgggtgttaaattgggtattcctgcctcctattttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcaattcgttccttaactttcaaaagttcttaaatggtttgtaacttatttaatcaaacactctttagtcgttctattccttacttctcattttttattttcaaacacgattttgaatcctttattaattgattcaaaacgtggaatttgtcccattagattcatctacacaaaaactatacaaattaactaatgtttaaaaaaagaatcataaacataatgaaaatcatatgacaagtgagtcttgtgaacaataaaaaaagaatatgatattagattttttttgtttgatactcatgaaactaacttttcatgcaatctttaccttgtttatgtcccttttggtcggcacatgaattgattctcataattttcatgttaataaatctaatgagacaaactttatgtcttgaatcaatcaaaaaaagattcaaaattgtatccaaaaattgaaaatggtaaattcttaaaaatactaacatgtcattaattaaataagtaaggtgacaatttttaaaaaatttaaaagtttggaaactaatttagcaaaataaataaattaagggagcatttttatattttatcctcaagtatattaaacaaaaggttctcagtgactcattggatttccaggtgagttagctctcttttgaagataaattctaccaatataaattaagctgacaaaataagatactaactggtccactcaagtaagtttgcattaggagcaaattggaccaatctatctcagactcttacatagacttaatacattagttctcttccatcttgcgggccaaatgaactagtatgcgggcttaatcttttaaaaaaattacaatctcaaaataaatatttttttctctttaaaaaattaattacactcaattatatatatatatatatattttaaaattctcaataaatctttaataaattcccaattattaaagttttaacacaaccaattaaattttcaacataaatacaaagaaattttgaattgagtttttaggattaattaggtttaaatcgaacttggtggttgcaagttttcagtccaactcgcggatcttatggtctaaattcttaaagttcgtgaatgatgaaggacggatccaaaattctgcataaccattaattttttaaaagaaatggtccatgactcatgcataccctgagctccacaaaccgattcatagactttaacctgtttacggtttacccatccgcaatggtaacatgcaagctgtagggcgattggcagtaatgagcatggctccgacccatatcattcctggcatatatgcttccctaatctacagaaacacgttgattggacaatgttctgatttctgaccaaagctagtccccaaatctgcacgagacaatgagtaaggttacgacttaatctactactcttcaaataataattgatgtaccatatcaagaatgtacccacactactagtattaatttgtgaggtattgtatgacttctttgtaaatattcaataaatttgattgtgaaatttattttactccagcactgttttataagaatccaaaagaattgtcttaactatttgatcgagcgttgcattgagtcaattacatttaattatgagtcaatccttgcaacatgcaaaattttgatcttgactttttcacttttttcgtttgtcattttttaatccgtatacatcaaagacatctactagtgattagttaatcaactgagatactccccagaataaaattagctactttatctctttaaatcttgtacacttttgaggatttgttgcttatttgatatgttttatagagatttgtttaatagtttaacactttgaattagaacatattatacaaattatattaacttttatatatatatatatatatatatatattataacatgttatttccgtacccatgtaaccagagcagagcctagcctggcagtgacagtggcaggtttacatgtcggtgatggcaagcacaaaactcattgcaaacccagtgatttgtcagcggctgaatttggtgtatggtttaggcattgtttagtgttattggttaatattctgcacaaattttggaaaggggcactgcaatattttctcaatgtgtcaaacaaatgcaatgaaattgaatatttgaatacgatcagcatcaacattaaaaaaacgtaggatatataattcaaaaacgaaattgccttccagttctgtttctttttttttttttgtctgttacatatgtgtgcacacacatgtattggagtgccattaaaacgtatatagatccatagagtatatacaatcttctatcatttttcatacttttgatgaatagtatggttctgagatggaacgtatgtttggaacgtgagaaagagagtggaaagaaaaaaaattgaaatgaaagaaaaaataattaaatttttatttctataaatcaactttctttttctttttactttttcttaatttaaaaaaaaatatattattattcatgttttttctctatttttttttcttcttatcaaacatatcaatagattttcctaatatttctaataattaaatttaacagattttgagcgggagtgaaaggttcatgaatggacaaaaagctaacaataatgaactttaaaattgtgactacaaggattaggggtgttcacgggcatgagtcaccgtgaatctgaactaatctcaatcgattcgaacagtttgagtttgatcatttatgtatttaagtcaaaatcaaatcgagccgattaaaatcattcatgtacgagttggatcatgaatttagatttatagatacgtgaacccgtaataaaaatataaattttattatataatattaaaatttaaaactaaaattattttgacaataaaaaaaaacgtggtaatgtaaatgtctaggtcgaatgaagggctacctcataatcatgtcatctcatttttattgtgaaggtgtggtactataaatgtcacatgtttaggttttttttcttttgcgcttatgtattctatctcgtctcatctccttctctacggttctgcaccagctccttctctattctctctcgtctcatctcatcagattgatcaaacattaggttttattctgcgctttctttttcttttctatagttgtttaacttctcgtgattttttctggtttgtattcattgagattttgatggaaacagggatgagaagaaaataaataactttcattattgaatgttgactcaaatttttggttatagcaaaatttatcacaagaaattaatttgtaagaaatagttgtgattcatactattataataaattttgttaaaaatcttttgttttaatttatattataagtctattttagaacattatgttgatggtattaaatgaatcatttttactattttcatacatttgataatattgtgttaattgtattggatatttgaaaaatcatgatataaaataataatttaaagggggaaaatttaaatagataacccgttgacccgaaccgttcatgaatgaatttgattaggtttaaaaaaaaatctaacaaatcaaatttaattgaattaagtcttaaatttaatcaaaactaatccaaactaatccacgaacaccccgattaatgtgtagcactagtctttgtaacgagggaatattctagccgaacacgagaaattgagatgatgtttacgtaaagattttaatattcaactcagtgcatgcattacaggatacaagatataaaagttagacaacacctccattcctatggaatctatttatattatttctccttcgcctattgtggcatttcctcatcaataatggtgtgacacactaagcaaatagtacaaaattgatatattaattggatttggatcatgattaaattatttacattatattgtaattcgtccatgatccaaaaggttcttaatgaggtgcatgggaggtttgattatcaatcctagtttattgggtcaactaaaaaaaaaacaattatcatttgtcaataattaaaacaatcctaaatttattggatcaactcattggctcattttttgtgtgtgatgtgtccacctcttcaaatagggatcaagaacaattatccccaaatcaatgggcttggttataatcgttcttctaataagtttaaggttttttcttagatttcatcttattttagataagatagactcttttgttttttcgactctagacttctaaaagttttttcttttgtttgttttaggatttgacagtgtgaatgtgcatttgttttgatggttgctttctcttaacgtttttggtttttgtccaggtttcttctttttatattgcctatctttctttctatcattcttgttttcaaattttttttagttgagctgggttttgttcatccttttcattttgctagccttttactctgcttctatgtttggttaataaaagaaagtgaaaggaaataaaatgagaagagaagagagtgaaaaaaaaaaaagacatttacccatacaacatctttagttataacttaaatttagattttttttttcaaatcaaactatcattaattaaaaataacaatctattaaaacataaattattcataataaatctagaatataatttatgtgttaaaatatctatttactataaaatctaactataatgtaatttatatatttagaaatatttatttattataaattaaaaaatcaatttcataaataaaatatttattatgttattctgtgctcgggttgcttataaacaacatgtggtgagacccacgacacaacctagctatagctcatatcattgttcaaagttcatttctactcgcatattttggatcaaaagtactacaaccatatttcactaacttagtctcaacttcaaggctacctccttgtggtttaaagtttccttgaactcacgtttcttatttacaatacgacatcattgtattgactaggacttttccatgtcctttttttgtaaatttaatgattttaaactttttttgtatttaattgtgtatatgattaaaattaaaactattttgaataacttctcatcaaatcattaattttattttaaatgtgttttttttctgattgatggtaaacaaacaaaagtaaatcagtaagtaagaacacaaaatgactcgagaaaaaaaaatatatcaacaaaaagtataaaaaaaaagtcataaaaaatgtaaaaacaaaatgatcataataaaataaaacttattttcgacagcaatgtaaagcagcatagtactccattattagaaccttgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagcatccttaaaaataaaactcaggacaggagcatctttaaataaacaaaaaaaaaaatcttaatatctataataatagaatgataaagaaatggaatgtgggagttccaatgattaagaagagttgggatttaaaaaatcaatgagttagaagaaaagagcatatgaattaagaattactgttgacggctactctcttgatttcgtgggcaaacatttatttttgaggaaattacatctgcagttcgtttgttttacttaaatttcatttcatattcatttctttttctattttataaaaagttttttaattatttaatttatattacactcagattctttctatcttacttataatttaatcatttaataaaaaagagacacatgttggtcatatgatttttaatcaaattttatatttaaaatattatcatctccttctttcaactttagaatattttaagactttattttttttattattctataattggacatgaatccatctttttgttagacgtgaatccacgttcttggtacacgttattaatattctttcttcttctatattttagttcaatatggtcctttgcttcaaatttagtgttttactcctgcatttgtatttttattatcctaaacatcaacactattttaatcaataataataaacaaatgattttcaatttattcattatgtttcatgtggtcccaaatatcaatactatttaatcaacaataataaacaaattattttaaatatcataagtggtctcaaactaatcccccttaaaatttcatttagaaatagacaacaatagataatcaaaattagataaatattaagtaatctatatataaggtccaatggtcacttacaaacataaccctaatatgaacataaatcgtgaatcaaaaaaagaaataaggaaacaatggaaaactcacgagcaggaagagactaagacacaatcacgggaagtaaatgatacatagccaccaagaatgtaaagaatttcatttaaaatgtcaaaatccaaacttttaatgaagtcactattatattattgactttctcagccaatatcttagcttcttttttaaggaagcaacaatgtttaaaaaaatattaaaacttttattataatgataacacaagaattatttagcaaggagtacctttttttatgttaatgatattcaatattttaatcaatatttttagaagaattaactaaaatacattaaaagcataaaaagaaagtaccattatagtaaatttgttattctataataataaatatcttaaatattatacttaggatgatttttgataagatataatgcaattttttatattaacattatatgaagattaacattttccttaaatatgcgctaaaaattcttattttattgtaatataagttgacaatatattttttaatccactatttctaacataatttttattataaatgaataaaatttaagtacattatttaaatgtcatgactcttattttccatataatgaattttatctatttaaaaaaaaatataaatgccgaaagagagttgaaaagggagtcgctgctggtccagaaaaaactgttaaaataaataaaaagtcttaaaccggtaatataaaaacgttaaagcaattctttctgcacattatttgtctttactttctctctcatacgtagaggagagagaaaaagagagaatttaattttatgtttactttgatatagttgacagaggctgagccaagagaagaagaagggtgggtgtagtagggttttaatcttcattcttcactaatccttttatccactccgagtgtgtgtaagaaagagagacccgaacaaattcacaaacccttcttctctctttttttcttctttcaatttcaaattttcttgttactattactaaccctagcttccttgaacactcactttgaaaccctagctccttcagccatggctcatttcagctgaattcgccactatgttgctgccatttcaattcacaacagcgaggtaagttcaaaacccgttcgttccgtttcggcattctcaatcaccgtcgcaattaacgctgttttgtttttctttggcggtaatcaggtgcatgcgcgttgtttgagtggaggagggacaggcatggaccgtgcgcttctcctcgcgtgcgtgatttgcgggatcctcttctcggtgttaggcttggcgtcgttcttcatcctttgggctgtgaattggaggccctggcgaatttataggtatctcgtcaagattctgtgtttccgtttacctgtttttcacttggtgctttgggtttgtttgtagttttaagattaaattgccatgctgcaatgttaatgctgttgattttttgtggcgcatgtggtttctgttgctaaaaattagtagttgttttaaagtattttataatttgatatttactggcattggctgctgtgtactgtcgctgaattgcataactgattagctacatttgtttaacaacttgggaattaagtgtgaatcattggggtgctttttctgtttttatgatggtctgctaagtatggtggttttgtgccgtttttgaaccttgtgagccggtaacttgagaattctgtacacgaggttgatgcttcctattcctaagtgctttgctttcttttactttgcactccttttttaagtaaattggtcggaattcacgtgaagatgcatttcagtaacgccttaacggctagtgtttttagtgaacgtatcacacataggatggtgccaaatgtaagatgagaagtctaacatttaaacattcaatgtgatgtacttatggacatcgtaggaaataacctttttttttttatctattaatcaatgtgtttgttttaaacttaaaaaaagaaactttataataagtgcttttttaagaagaagataggatttgcctcttaaaaaaagcagaaaactgcttattttaagtacaagcagtttatacaattacatcagaaaaacagaaatctacttattttattaagaaaaatgctttttttttaaattaagcttaaacatactggcccaatgttttgggataaaatggatgtttaattgaatttccctttgtttccttgtagaaaaaaggatgatttggatagagttgtggaaattctcatgaaacttgttgtcatatatattaggtttacaatttagtatatctgttggaatcttaattaacagttgtctgaatttgaagaaatgattgcctggtttaacgaatataaatataaaaaaattgagattacacatctgtatggttcatatatgtgatttgtattaattgagttgctaatcaaggaaataatagattcataatcttcagtaggcctttgattatttcattgagttgctcttatgataaaactgtatcaccaattgcatttagatcgtcaattagggattggattcaaaggtgatactaaaaaatagttcaatcttaaagcattgtgctttgaagttccgtgtgaagttttctgacctccgcattcttgtgaaattgaaaggagtgaattttatcccataattgcccagagctttttcatctgattattcaagcaagcgtattgtcagaaatagacgattgtaaccaagagagaagcaactggtcttcttactctgatgtgatatagatttcagaaatgtgatttgccccacattcttcatgtgtgcgaaattatgatggaattactgtattggcgagaaagtggtgaagacaacagccttggattattggttcaacttgctggcactgaagtagataatttttcaaatcattttctaggaaacagagtgacaaaatataactgcggatgatgccagagaagatcccatggaggagagaggtgttgacggaggatgcaatctcagtggcaagcatgaattggttgttcagaggccatcttgggttcgagcaaagctctcgaagtcatgataaagttgtgaggaagagaaaatgaacactgaaccataaatttataattctgtaaaatgaaaggctatacatagcaccctgggctggcttcagctcatcaagatatcctataggaatgggtacaagcatattacagagagtgagagagttacattactctaatatagatacacctttaaagaagaaacctttgaagctaataagaaaaggatgtctcgtaaaagttgagttggaattatgttctagcagatagcaccagatttcttttgtgtgtatattatttgttctattattaaaaagaaatctcttagctctttagtgttattatactattattattggatagaaagaaagaaatatgaatttattattgtcttgcaggacaaggctagaataggtaaacagagcaaaaataaaagtaaaaattgacatctaggatttttcctactttgtttcacatgagtctctaatctctatatacatgttcagaaacttgggtaatttcacttcttgtgttgatgtggtctgttgtgattaattttaaaatatttgatgaatccacagcgatagaaactgcattcttgaacataacacataatgttgctctgggcctcttgactgtatttcaggaacaaataagttaaagttttgctacataactttctacgttatcttatatgttttgagaagaaatacaagttgtttttatgctgctttgtcatgctgataaaaaaaaatgctgctttgtcatgcatttaaagtactctgaattttggaacattgttttgggcttctttgcatctatttttatttatttgtttctatttcagttggatctttgctcggaaatggccaaatatcttgcaaggtcctcaactccatttgctctgtggtttcctgaatctttctgcatggatagttgttatttctccaattctggtgcttttcatttggggctcttggttgattgtaatattgggtcgagacctgattggtttggctgtaataatggctggcactgctcttctattggcattttattcaattatgctgtggtggagaactcagtggcaaagctcaagtatgtattttccggcctattttttatttaacaaaacatattttgtgtcgtgttcacagttattaagcttatatgttctattcaacatgaaacccaaatttctaaatgctgtatcttaggtagagactgtttctggtattattaatgttgtggattgttttctgtcgatgatcttccatcatttgagcaattgacagcctttggatgtgatgattatgtcttctgtttcatgaaaaagtgaacagaagagggaagaactgtaactgctgtcatgtatgactctcttccattgttaaaattatgatattctcattataaaaatggaacaaattgcacaggctttaccggattcagtgcaaacctggttcccaaaaaaaatggtcaaaaaggttgctggacatgttgattagtggtcataaagttgccaaaaaaattgagaacaactgggaactacagcagggtgaaagtattggatgccaaacaaagaagttcctcagttgagaaattgactaaaaataataacttgatcatgtttataggagatggtattgccttggttagtgaaaagaagtaaaatagaacaagattgattgaataatataagattagattgatatggcgtgttttacttctaacacaaaaatggccctaatgttgtaaaacttactaacaacactcatagcaaatcagaaggtaaacagttggattatcaataggtctaggtctagcattcaacatgcatgtttcctttatatgtctaaggcgtactggttgatgaatagtaatgttgaccttagattgagcaacatcaattctttagaagtaccagagttttccctaattttggtccaaaattgataaattataattatattttctaataaaatgaatgccatggtgatcatcatctgtaataacaatttcattagcatatacaaccaaaatattgtaactgagaagtacaacgacttcaacataaagacctgcttctttataaggcagaacagcctgttgcataacaacgctatcaagcttaaggaggctgtttgaggccataaaggcatctttgtaatcaacacactggttgtaaagattccccctctgcaacaaagcccggcagttgctctgtatgttgttccttcaattgtccttgttgaaaggctctgtatgtgtgtacaaattgttgacggttgtgtgcacatattggatccaaattttgctatgttgttaaaagagaaaaatttaaaattagatctaaatgtcctggcatttttgcttcttagtacaaacagaaataccgaattgactttgaagcagagctaaattttttaaaaatggaatttttgttccttttttggtaagaattacttggttcaatgagaatatcattgataaaattgtaacaaaatattgaaatctctaggttggaacaatatgatatagaccccatatgtagtatgctctagatatgactttgaaattactattgtgtcccaatcatttgtgaatgagattgggagaaaacaagcatcaggtgaggttaaaagttgataggagccatgtgaatcatgctttctgctgattatccttttcttactgtggttttgcggaagaaatgctcttttgtttatgctcctgctttggagaatcatctggaactagcaatttaataaaatcaaatagtgaaggccgtacagctgaaagctcaaataatttgacatatgttcctcaactgtgagctagtctcattggattgtgcttgagagttcttactctgtccagaatgcctagggcatttagagtttttgccgtctaagctgatatcgtattacatttcttcttgtccaacctatgtaaggcgtttgttcctatttctatgttttccaacagcagtgaaataagttgcttgtaaataggtattttgttatgagtacaacaaacaataggaaatgttctttgattaggtcttcagtcaaagctattgacagaaaattttgtccttgtcagctgcacatctttttttctgtttgttctctatgctgcttttcttccaatgcctaagtttagtatgaataggtgaatgatatggccaagaagcagtgttgtacaaatattagacatgaaaagtatatttacctggttttataaagatatagtatgtttgggcatcttatatgattgatttagtttcgttttcatgttggtcgatgttatagttgtaatacccaatatcttcatttttcttttgacaggggctgttgcaatcctgcttcttttggctgttgctcttctttgtgcatatgaactttgtgccgtatatgttacaactgggtcacgagcatctgaccgctattgtccttctggtttcttttttggagtctctgcaattgctttagcaatcaacatgctatttatttgcagaatggtgtttaatggtatgcttttgaatcacttagttcatttacaaattgctattcctgattattattaaaaggttaagatatttttttggttgttgtacaagataatcattttcaacgtagtccttttgtgaagaaacttttcaattagctcctaatccttttcaatgttgtctgtactgttttttttttttttttncttagttcatttacaaattgctattcctgattattattaaaaggttaagatatttttttggttgttgtacaagataatcattttcaacgtagtccttatgtgacgaaacttttcaattagctcctaatccttttcaatgttgtctgtactgtttattgtcataatattgtgatattgaagttgagttaccctaaaatatatggatcaaatttaataatgactgtgatgtagtgacaaaaatatagtattttagtccctaatacactgcactcatctttagtttggtacacttcattgtgttataactccagtagatagtagtattataatagtagtagatgatattcctttttgatgtacatggtgtcccttcgtacggatactgcttttggcttgattctatttgtttttttgtttttcgttatttgcattatcttattaccattattcattgtagggaatggcttggatgtggatgaatacgtgcgaagggcatacaaatttgcttattctgattgtattgaagtaggtccagtggcatgtttacctgaacctccagaccctaatgagttgtatcctcggcaatctagaaggtatgttctaattcttgttctcattgttgactatcctattggagacaaataattttaaggtatttttatagcattcattactagcttagacagacatttattttgctattgcttctcaaatatttatttggattagacatatagtactatttcattaagctttcttcctccaagttcttattgtttttgtttgtctttgtagggcttcccatcttgtactgctctatcttggctcactatgtgttctgttagtatactccatcttgtatggtctaacagcaaaggaggagaattggcttggagcaattacatcagttgctgttattattcttggtactttaattagctcttggtatttattatattatttttttaatgttaacagaaaattcttgtgcacttttcatctctggttatttgatttgctctttttctgtgcacttcttgttttgtagactggaatttgggcgcttgcctgtatggttttcaacttcttgatagtcgtgttgcagcactgtttattgctggaacatctcgtgtgtttcttatctgttttggagtgcaatactggttagtttcttaaatgaaaaaagacctttttctcagcgccactgcatgtattattggtttgttctttgttgacttttctctactttcaccactcaggtatttaggccactgtatcagctatgctgttatggcatctgtactgctaggagcggctgtttctcgccatttatcagccacaaacccattggctgctaggagggatgccttacaaagcactgtagttcgtctgagagaaggattccgtagaaaggagcacaacagttcatctagcttttctgaaggctgtggctcaagtatgaaacgaagtagtagtgttgaagccggtaatcttggtaatgtcattgaagctggcagggctatgactgcaggtgatgggagcaattggaataatgtcctgtctcaaactactagtttgccagacggaatcattagcgataaaagcatagatagtggaaggtcaagtttagcattacatagcagctcctgtcggtcagctgttcatgagccagaagttggaacatcatctgatgatagaaatttggatcacaataattctttggtggtttgttctagtagtggtcttgatagtcaagggaatgagtctagtgcatcaaactctgcaaatcaacaaacactggatttgaatttggctcttgcattccaggaaaggttgaatgaccctaggattgcaactattctgaaaagaaggacaagacaaggtgatcgagaattgagtagtttattacaggataaaggattggatccaaattttgcaatgatgttaaaagacaaaagtttagaattagatccaactatactggcattgttgcaaaggagtagcatggatgcagatagagatcataatgaaaatactgataacaccagtgttgacaatgccatgcctaatcaaatttcattatctgaagaattgaggctacaggggcttgaaaagtggcttcagttgtgcagacttgtattgcatcacattacgggtactccagaacgagcatgggttctgtttagttttattttcatacttgaaaccatcattgttgccatatttcgtccaaaaacgatcaaaattattaatgcaacacaccagcaggtgagtgctgagtccctccctagtatatttcttgtttgttttgggggactgaaagatacacacacacacctatctctagaagcttgttatccgtatttcatttgtttgatcttggggttgtaactgtttaaaccttacaatgctcattttgatattttctgaacctttattgcttgtagtttgagtttggtttggcagtgctcctgttatctcctgtgatatgttcaattatggctttccttcgatcacttacgacagaagaaatgtccatgacatcaaaaccaaggaaggtactagattggctgttttttgaattaagaatgcaaagttcatctactgaaatggatgaatttaatttttaactgtttatcttgttgagctgactaatgtttggctacttgactacttgttgtaaatttgtaatataggaagtgcttctgttgccgtataatgtttttggttttgatgcggcagttttagtcttttaaggtttatacattcttatagtgcacatgtattagttttagatgagagggctaactttactggtgttatcatgataccattctcttgcccatataagctccttggggtgggattattgggaaactctttggaaaagtgggattgtcctagtttgttgaactggggctgcctgtctgtgatggcctgagctgggcagcctgtgatccaaacatgcaatttgaaaacctgaaatccctaaatccccattgtctcagcctctttgaatcacttgacctccctcttctctcagaattaaccccctctctctcggatgtggccccgaaccactataactctactctcaaatcactttggtgtggcgagtgttgaagctttatttatttgtttgtttgtttgtttttgtttcttaaacccataatttgagcttatgctgggtctataaaaggtctcatgattctttgacttctaattacttttctgtgttcattctttcctttccataattgctgtaaaatatcaaatagacattgaattattaaataatataactgtcaaaaaatatataaattcttcctgaaatttgctggtgggatcgtacatcttatgttagacaatttatgagcattccaatttaatttagctaataattttttttttttatcagcaaaaataggatatatatatatatatatatatatatatatatatatatatatatatatatatatatatagaaacagtacaaggagtactggtgaggatacaaaatagctgaatcaacacagaactttgatggttttctagcaaagccatcgaagttctgacagattcgctcaaccaaaaaatacaaaatagctacaacaagtgaattaacccctccccaaagtacaaaaaactgcgatagattacaagaccattggtggaaagagatatcgaatccatcctctaagttcctcaaccaagaccagcaaaagaaaatagcatcttccatcaatttgtgaccattaaaggatgcattgtggaagagaatctggtttctatgggtccaggtacaccatgttagtgctgcccaccaggtgagccacctagataaagctttccctctaaggtgacaaaacgatgattgtgtaaagttctcctttggattacatgaaaacaccccaatgatgccaacccaggcccatgactcccaccatagaggtaagacacaggggcatgaaaaaaacaagtgtgaagcatcttcgtcaaatttgttgcagaaaggacagtgagtgtcgggtgtgactatgttccttctcctaaggttgagtcttgtaggtaatctgtccttcaaaaatcgccatacaaagcatgctactttcaatgggattttcaacttccaaagagtcttaaacacttcctcttgaggggatctattgccctccccagaaagcatgctataagcacttttcaccgaatatgtaccactgggatcatgtacccaactccatgaatctgtttgctgctggtggggtgacagtccctgaatatcatccagaaattttattgccacctgaatctcagtgtccctaaagggtctcctccattgtagttgccattcccatcgatcttgatgttgattacccatttgctggatatattttgtttgttgtttagatagctggtaaagtctaggatatgtatctttcaacgaaatcctgtcttccttccacgaatcctcccaaaatagaatgttactaccacacccaatattccatttgagaccaccaaaaaaccatccatcgatgtgattggatccataaaccacagctagatctctccaccaaattgacgctgatggtaacctggatgaggtctgaatattcctccaacccccgtatttggattcaaggatttgggcccataaggcttccggatgatgaaataagttccagccccatttccccaacaaggcctgattgaatgttcttaaatttttgatgcccagtcctcctttctccttaggtagacagattgattcccatttagctaataatagaagatatgtattaatataacatgatataattaacagatgattatgtttttaaaacatgtgattagatatccaatcttatacaacacatttattaagagatatcagtttttaataaatttcaatacttaaaggaaataatatctattttcgcagtgaaagaccatgttttcccctcagtcctaagtaggatctcgattttgacaaccttgcatcttgatttccacttggacttaagttacaatgttgttttcttagcctgtcagaggtgtgcagtcgtgtagctcatgactgcacacctatttatccaacaacttgctatcgtctgttaaattgggattgtataccttcatggaaattgtagaatcgaacaatcctactagtaaaattgtgattttgaccggggcggagctagcatttttatgtaaggggggccaatataaaaaaaaatatgacttataaaagaatatttaaaatttttcatgcatgatatttatagaacttttaagatataactaaatgtattttaggagcaaaataaataaataaataattgtgttaagcatgagagagatagtaattaccaagtgcgatcaacatataagggccaaagaccagtatcaaaagaagaagaaattaaaaaaaatcaattaaattaagtgaaaataatttttcatagtcaaagcatattattcaaaaaaaaaaaattcaaaagtaaataattgtgtcacatgaaaaatacgtagaaaatacttggataaatgaatcacacttgataaatacttacataagttaactaagtataaatgtatcattaacaaaaatagaaactataaattagaaatgaagagaaatttgactttttaggtaaagtgttttaataaaagaaatattgaagagaacttagaaaagtaaaataattttatatatgatatgagagttttttttaacagcaaagaaagattatattatagctataattatattataaataaatggattggaatttgtcacaagatgtggtcaaatcaccaaccacagaaaattacaccaagaaattacacaaacacgactcataaatataacatagcagcactgagaatccaacaatacataaaacagtaaaacacccccaggcacattgaacccattacaaaacaaaaccgtaacatactaataccagctaaaccaaactaaaagaaattatgacaaattccctgtatattgtgtccaataagaaatagccgattaaactgctgctattaacctcccctataacgtgttacgacatcccctaatattttttccatatacaacatctcctaatattatgagagtttgaaaatcttgggtgggccatggcccctgtaggccctccgcctctgattttgtcatccttccttggaggggtagctacagcctatgggtactgattgccttgggagtttttttttaactcactgattgtaatgttaactagaattagggatttcatttagccatgagttttctttttaatttattcaatttattatgtttggcctggctatatatgtctgttgttgcttattcttttaagagactcttgttttagtgcatgcatacaataacatgaataactaataacatattctctctttctcgctctctaattcactgtcttcagtatggttttattgcttggctactcagcacttgtgttggattattgctctcctttttaaggtaagccctagtattcctgaaagttgttcatacttttaaattttgacctcatttcaattgaatgtgaatgccttttttgtatcagcataactgcctatgcctttgtttgcattttattaattattcatcatataatatatgcagcaaatcatctgttctcctcggtatatctttgactgtgccactaatggtggcatgcctttctgttgccattcccatatggatttgtaatggttaccgattttgggttccccgcatgaattgtactggaagtgctggaaatgatcgaattcctcggacaaaggaggttagttcttatgcctatcctacttactatcacggtgtctataatttgatgttttctgatgtctcttagctttatctcctgatatgtgatttctcgtagtcttagctttatctcccgatagatcactttgtttttcattctaggatatgacatatgtacacaattattttaattcatgaattcattgcatagggtgtgttatgcatttgttactttttgctctgtcaagttaaatttcttgtcaatgcataagcttgtcttgttcccttttacagggtattgttcttcttatcagtatgtcagtatttgttgggtctgtactggctttgggagcaatagtttctgcgaagcctttagacgatttaagatacaagggatggaatggtgatccaaaaatcttgggttccccttacacatcatctgtttttcttggctgggcaatggcatctgcaattggtttagttgttacgagcgtgcttccaataatttcatggtttgcaacatatcggttttccctttcctctgctatatttattggactttttgcaggtattttctcattttgtatttacaaatacctaccccccccccaaaaaaaaaaaatgtttttgttattgctgatatctaattatctatatttctgaaactattgctgcagttattcttgtggcattttgtggggtgtcttatttagaagttatcaaaaccagggatgaccaagttccaacaaatggtgatttcttagctgctttacttcctttagtctgcattccggcagtgctggggctttgctgtggattgctcaagtggtaggtgacgcttacttgtatttgtcgatttatctatggtaaattgacaaatgacagctattattttgctttttgatatatgtctgatcttttttaaaatgtctatttgcaggaaggatgatgattggaaactttctcgtggtgtatatatttttgttataattggtcttttgcttctgcttggtgctatttcagctttgatagttgttgtcaagccttggactgtaagtgtgttgaattcattgtctctttaactcccccttccccaaggtcaaaaactctttggctgaacctcttccttcatattactgcagataggagtagcatttcttttggttcttctccttatggtattagcaattggtgccattcaccactgggcatcaaacaatttttatttgagccggacacagatggtctttgtttgcttccttgcttttctgttggctttggcagcttttcttgttggatggtttgaaggttctagtcaattccattatattggcattgatatgcatatcttaagtagaaagtggctgatctgttaagtgctaacatgatcttttttgctcttttttctctccaggtaaaccatttgttggagcatcagttggttatttttcatttctttttcttcttgctggacgggcattgacagtgagttactcattctaattttcaatcttataatatcagcatgttatcgtatcccaaatgcttttatgcttcaatcagttcatctttgttttgctcagagattttattcctttgtgatttttttcttctattccataggttctgctttcaaatcccattgttgtatattctcctcgagttttgccagtgtatgtgtatgatgctcatgcagattgtggaaagaatgtcaggtttaccccacactctaaattttgtttttaaatacgttggttaattttttgtttgattttacttgttatctgatttattactttatgtatccactgcttgtatctgttatttacagtgtggcctttctcatgctatatgggattgccctggcaaccgaaggctggggggttgttgcaagtttaaagatttatccaccctttgctggtgcagctgtatcagcaattaccctagttgtttcatttgggtttgctgtatctcgtccttgcctaactcttaaggtctgtgaagtcattgtgatcaacactgacttttaagctacttcaaaatttaaatgattggatttattatatacactgaaatgcctgatgaaactggcttattataatgtgctaacttctttcttcagaaaataccttctaattgaagttctaacctttgtaaaattgtacagacgatggaagatgctgtgcatttcctcggtaaggaaactgttattcaagcaattgctagatcagcaacaaaggtaagtagatttgccaacgaggttgcaggaccctattgggccaatatctatattttattcttgtcgtcctagctttgtttggactctggagtagtaggtagtaggcattctagccttctctacaactgctatgaatgtctgtctatgttggcaaaatttttcttcctttacagaaacaaagttcttactaaaatttggtttactgctctgcagttaatacttttgcaaatgtagtgagaaattttccctctgattataaagtactctgtaaatgtggctgtatttattttaaagtactttattctcaatcatcctgagttttggaaatcttttatgcttttgaattaatttgtttttatcttttacattatcattgagctcagtaattcatgcttttccttttttaacagatagtccatgttttatcggaatctttgccaaagtattctagtttagttttgaaaagtgcttcatagtgaattgattctatttgaggaaattgatatgttattctcatacattgaccatgtttcaagcatgctgtttcctattaaattgttgctttttgaaataatttctcattggaatccaatctttattgtgaactattgcctgaatgccttagtgtcagagacaatgtgccaaacgtttgacaaaaagttacaacagattaacggctaatttcgtcacaccagacttgataacaagtagcaactctaggtttcgaatttcaactgtttctataaatatgagaagtctattcagagtttgtttagtgaattgaattacataatatacagaaaaactttccaagcttctcttttttgtgtcattttctaactcaaactgcatctctatctctgaaaatgtttacatttgaatcagaaaacttgttaatgaaataaaatttcatcagccaatcagtctatgtttgtgtttcttgtccatgcattgctttgaaaatagtttatgataatctctttcagtaccctgaattaatataactaaccttaaaccaatggaaatgtgttaattgcttgaataattctctttaatcttgatactcacataaatattttctaacgaatatgttctcctttatctgtttgttgattattgaatgttattgtcggaaaagaactcctgcatttgtcaatgcaattcaactgtaaatgatatttacttgcactgcagaccagaaatgcattatctggaacctattcagcaccacagaggtcggctagttctgctgcacttttgattggagaccctaccattatgcgtgatagggcaggaaattttgtgcttcccagagctgatgtgatgaaattgagagaccgcttgagaaatgaagaattagttgcaggttcattctttagtagattaagatatcataggacattccaccatgagccaaccagcgatgtagatcatagaagagtcatgtgtgctcatgctcgaattctggcactagaagaggccattgatactgagtgggtgtacatgtgggacaagtttggtggttatttgcttttgttgcttggtttgacatctaaggcagaacaagcacaggtaatggatatctagttttgcatatagtggatgatatctagtttttatttttattcttgtgacaatgataatccatttctctggtaggatgaggttcgtctgagactctttcttgatagcattggattttctgatttaagtgctaagaaaataaagaagtggatgccagaagatcgcaggcaatttgaaatcattcaggagaggtactatcctgagtatctgatattaatatgtatagtatctttaccatgttttttctatctaaatattttgttgtgaattttctagttacataagagaaaaggagatggaagaggaagtcttcatgcagaggcgtgaagaggagggcagagggaaagaaaggaggaaggccctacttgaaaaagaggaacggaaatggaaggagatagaagcttctctgctctcctccattcctaatgctagcagcagagaggctgctgccatggcagcggcagtacgtgcagttggaggcgattctgttctagatgattcctttgctcgagagagggtttcaagcattgcacgtaggattcgtgcttcacagttgtctcggcgtgcacttcaggttcattaactgtctttgatatttattctgaattctgatagcaattgataggatctttttcagttttttttttttaatagtctgtttaatttgttggacggatttcaatgggaatagaaaaataattggatggaatgatttgtggaaacaattggcaggatcttttttcagtttttctaacagtctgtttaatttattggagggatttcaatgggaatagaaaaataattggatggaatgatcatcctctttatgtataatctgtgatgtagttaatagtggaatggtttccgttcccattttggttttcaagaattagcaggattgtggaggaaacagtattacaaaagtaaatatttttatttttaattatgttgtttgccatattttttttgtgaaataatgtaaaaaaatagtgctctgtagccttaaaaagtagtaaaatattttttgacattttaatttatgatttttatttaaaaaattaaatgttaaatctgatgttattttatttaaaatatcttttaaacaaaacaaatccatctgataaatataaaagcttataaatatagctttttaagtcaaatatatattgtttgaagtgtgtataaaagaacaagattacaagagtcttaattttataatatattattcatttgttcttcagatctatgtttctcagtagattaattttgttaattaaaccaaatttatttgataggtaccagcaagcaagaaagactaaaaggaagaaattaagtatgaaaatatttgtattgcagtaactggtctgaatcgagggaattcagatcctggtgtattctgtattgtgtacaatggtacaaaaatgaaaagacacctagacagttctcaagagtgtctaatctctcccagcccaagcctacatctacacacctttccctggcttgtattctctctctctctctctctctctctctctctcccccccttacatgcacttccctcatgctctggtgccaggttggcagttagctctctcgcttcctcttccccctctcctataacaaatttgatacattgcaccttttgcctctcttttcatacaccttcagtgatcttgggcctcggcgctatattactattcctttccaaagtattcagtaaacttctgattcattgcatacttgttccattcctgccagctcatttccgctaactggattttctttatgataatcatctatttaaaatttctgcatgcgctcacctttatctttgactgatggattactcactgaaaaaaggatgatggaaaattatttttaagaatttaactagaataatgcattgagactatatgttttttactgtctgattgttgtcagatcataaattgtcgtgtgtagtaaatttgttgatttttttttaataattaccttaaaattcatatttaaggtaatttttaattgaatgacagtatacaaatatttacactggcatgaaaattatacccattttttttattggtatttatataacaatccaatacgaaagtctaattttgtttatctccacttgtggtatcttaatttaaataattaggatgactcttctggagattacttaatttacattgaaattttgatatctttgcagacaggagtggcaggtgccatatgtgttcttgatgatgagccaacagccagtggcagacattgtggtgcaattgattccagtctatgtcaaagtcaaaaagttagcttctccattgcattgatgattcaacctgaatctggtcctgtttgtcttttgggcactgagtttcagaagaagatttgctgggaaattcttgtggctggatctgaacaaggtattgaggctggacaagttgggcttagattgattactaaaggtgataggcaaacaacggttgcaaaggagtggagtattagtgcaacaagtattgcagatggaaggtttggtctttctctttattttatgtatcatatgtttgttttttaaagttcaggttcagttacccagttctcttgttatatatgtgttaccttttcgttgcaggttatcttcacatgtgtgtcagtaatcttcttagtataataacattttgttattctaattttaatccaaatgcattttgggaattatatggtttcagtatttcttattaattgttttacaattcttctctccagatgaagtttcacaattttttcaattattaagaattcaaaagtcaaatttcaatctctgccagctttcttgagatgcaaaggatagctagttttacctttaaagactgttaggactgacttttgctattttggcatggtaaacttgcaactgaacaaaatttatactgcatgagtctattttaaaatacaggagatttttatagagcaaaatacttatattatttgctcaattgcttgagtttgtcattatatatttggatggttctgtctaggccatgttatttcaatgcacaataaattgttgtagtttcttacgtttctgtgtgggtaatatattgcaggtggcatattgtaacaatgtcgattgatgctgatttaggtgaagcaacatgttatttggatggtggatttgatggctaccagaatggattaccattgtgtgtgggtagcagcatttgggagcaggggacagaagtgtgggttggtgttagaccaccaacagatattgatgcatttggtaggtcagatagtgaaggggttgaatctaagatgcatattatggatgcttttctttggggaaggtgcttaactgatgatgaggtttcttctatttataactcaatggcttcggcagacttcagtgcacttgttttccctgaagataattggcagtgggctgattcaccttcgagggtatgctgcttcttccttctctgcctctcccttcttgtagagaattgaaattttaaaaacaatatatataaattatagaaacaaaataaattgtcctcctaatactgctaaatgctccaacatgtagaacatgttcttatcatgctttactaaacatcatcctgttgtctgctttattattaaaaaataaaaatagtataacaagtggtgttttagccatcatgtttactttgtctaatcttattaacacattttgagtctaggttgatggttgggacagtgatcctgctgatgtagatttatatgatagagatgacgtagattgggatggacagtattctagtgggaggaaaagaaggtcagaacgtgatggcatggtggtggatattgattccttttcgaggaagtatagaaaacctagaatagaaacacaagaagagattaatcaacggatgttatctgtagaattagccatcaaagaagctctctatgctagaggagagagacgttttactgatcaggaatttcctcccaatgatcactcattgtttgtggaccctgcaaacccccctgcaaagttacaggtacttctctttattattatcttttagtttactgtatttacccccccttacaaattttatattgtttcatgtacaggttgtttctgagtggttgaggccaggtgagataggcagacagaaccatcttgactgtcgtccgtgcttattttcaggagctccaaatccttcagatnnnnnnnnnntttacaataattactttaaaatttatatttattgtaatttttatttgttgatgatatgattttttttcctacattaacacattgatatgcccaattattaaatcatatttgaatgatcaataaaaaataaaatacaaatgacttttttaaatagcatgtgatcactaattaactaataatcttatagctcttctttcttgcaataaaatatatatcaaaaacttgctaatggatgtgctagtgaaataatcttttaaagaaaacaagattccgattgtcaaatcaccacgattcaaagtcatttattaaaaaaggtttatttcctaaattttcaacatatttttagtccctgaattaatattttttttaacttttagtccctataatgaaattaaaaggataaaaaaatgaaggttaagagggacattgatcagtaaaaaaacgttcaggactagaaacaaaaatctttaaaatttaggaactaaaaagataatgaacctattaaaaaattataacacacaattcaagcgtgttaaacaaatttaattaagtagtgagaaagaaaattatatttgcaaaggaatcaacagtgcatgcataaatgatattcatcatatgtctcaagacaaaataaccacactcacggatgtgctaacttgtttaatgtaatnnnnnnnnnnccccctgcaaagttacaggtacttctctttattattaccttttagtttactgtattacccccccacacaaacttaatattgtttcatgtttacaggttgtttctgagtggttgaggccaggtgagattggcagacagaaccatcttgactgtcgtccgtgcttattttcaggagctccaaatccttcagatgtttgtcaggtctcatgttttacacctcacttgcaagaattttgaaataaatgtttgttctcttattttttttgttagtatttagattttgcaatgtgttaatagttatgtatattgaacagggccgtttaggtgattgttggttcttgagtgctgttgctgttctggcagaggtttcacgtatatcagaggtaatcatcactcctgattacaacgaggagggaatttacactgttcgcttttgtgttcaggtaataagcatacagagtcagattttagtttctttttattttctctttttcatgctgtgactggatagataacattttccaaataaatggcatctaagttcttttcatattttggttcatgatatctagggtgaatggatccctgttgttgttgatgattggattccttgtgaattaccgggtaaacctgcatttgctactagtaagaagggctatgaactctgggtctccatattggagaaggcatatgccaagttgcatggctcttatgaagcactagaaggtgggcttgttcaagatgctctagtggatcttacagggggtgctggggaggaaattgacatgaggagtggtgaagcccagattgaccttgcaagtggtagattgtggtctcaactgttgcgcttcaagcaagaaggttttctcctaggtgcaggaagtccgtcaggttcagatgtgcacatctcttctagtggcattgtgcaaggacatgcatactcaatactgcaggtaatgggataatgttttatatttttatattcacgatcattgttagaagtaaaaccagtaataatccttcacctaaataacttggttaagtttttaagagagttggtccttgacatggtaacaaagccttttatgttgagttagtcaggagtttatccttgttagctttgttctattttttaaagttgaatttgagcatgaagtagagtggagttgtgtatgattcatgctttaagcccaaaaggttctcttatttgaggagtgtgtttggtatatagtcattcatggcaactcatgagccttcacccaacaactcaagccttatggagagttactctgacaatcctaatgatttttaatgatctctgctgtcatacaattttaggtaagggacatggatggtcataaacttgttcagatccgaaatccatgggccaatgaagtggagtggaatggtccctggtctgactcatcgcctgagtggacagataggataaagcacaagctgaagcatgttccacaggtagttctttatgcttttctgttgtggattagtcatatgcttgacttcttagcatctctgtatgattgatctgactatttgctcttacccaatgttattatcatttgctgacgtcaattaactattttatttgttacttttttcaacagtcaaaagatggcatattctggatgtcctggcaagattttcagattcattttcgatcaatatatatttgccgtatctacccatcagagatgcgtcattctgttcatggtcaatggcgtggttacagtgcgggggggtgtcaggattatgatacatggaatcaaaatccacagttcagactgactgcaactgggcaagatgcatcatttccaattcatgtattcattaccttaactcaggtactactgatatttgcatatttagtactgcaatttctgaaaagaacttttcccttgaatttctttaaaacttcatttcatgatatttatagggtgtgggattttcaagaacaacagctggttttagaaattaccaatccagccatgattcacagatgttctacattggaatgaggatactcaaaactcgtggcagacgtgctgctttcaatatatacctacatgaatcagttggtgggacagactatgttaattctcgagaaatatcctgtgaaatggttttggaacctgagccaaagggatatactatagttcctactactatacaccccggtgaagaagcaccgtttgtactttctgttttcaccaaggcatcgataactctggaagctttgtagtgcctacggatagtttttacatgtatcttgtcctcttgataagtttctctgcctgggttctcggtggatcatgtacttgcactgccggaggccgtcttagaacaattgggtaattttctcttccccctctcccaacaattttcttttcatatatatgtcatctaacatttatggtttgtattttctcttcacagcattgagacactattcctggcggaaacgacatggcatctgttcgagagatggatgaggtttagctgcacataaactcttggtctttgaatctgatgattcatcatcttgaacaatgcttctgccagcattgaagagggctctcggggtgtttattgtgtacataaaaaagtggtactataggggtatacttgtaaccatgtaagcaaagttgaaaaagaaatagctgcaaataagtaggaaattactaacacctggttcaaatggaggtaaggacagtgtggggaggtatagtaacaagcattgagtgactgattgtaaattcagttgccgttttgacaattgcaaaaaattgtacaaacattaacaattatcagttcctatcatttattggcatttgggaaaattttgtacaaatgtctttctaatctaatttgatttcaaaatacaaggagcattcactagttgtagttttttcttggttgaaatactacgaaacggcgagaaatgttcctatcttacagtatttagtcttgcagtccttatatgtctatagagttccaatcgtttatataacttgaaaggtcaaaaagcatttcagagttgttttatactttctaaatgttaatttctatagactccaattttaaaattacaaatttctaatagcaactgtagatactagatattttttatatcagcaaggtgttgtcaatttagcataatttttttaaaatgtagggagcaaactaaataaaagatttgtaaagctaaacaaaaatttgacgaaatcatatgtctgtggagggaatgataagggcaatgccaacataacctcgttttgtctgctatgacacgtttctctaagcttttctcttcgaatataaataaaataatgtaattttttttaaaaaaggttgcgaatagaaaataattgttatactaggcaattgtatgggcatggcagaggaaaagtacaaaaaggggaaagaaattcgaaaatgaagatttaattaaaagaaaaattctaataacattttttaatatatacttttaaacatttttttattattaattgaaatctattatgatccattaaataatgtgagttttatttgtcgtacttttaataaatttgagttaataataaagaatgtattgcaaaagatattatataaaatgattcttttcgttaaataaaatatatacatagcctaaaagtgaatgaaaaaatagatatttacgtagccaaacctttacgataccaagagagagagtataaggtgcaaaacagagatagtgttgaggtgaaaccgtgaaaatttgacatgtagtattaaatttacgcgtgtatacacttgtgtattgataagaacccctcttattttggaaaaacaaaaaaaacaaaaattggaaaaacaaaaaaacaaaaacgatgagatttggatgtacgatgttggcggattgcagaagacacgcgagtttccattttattttgataggcaactatttagtggctacaacaaattttgcggtgctaacacgggtcctgctaaagtgagaggttttatcaagtcaaaactaatgtgcttcacgttcataatatcgtttgattgttatttacttcttgtaatataggatatctgatgagttaatgatgaaatggtttgtgctattggtgtgcagagttgtgagtatatgtgtgctgtgttgccttatccatagtgtcactgtaagagggaaaataataaatcttgaaaaaaaataatgaaaagagatataaagaaataaatgtaatactacatgatttgatgaaaagaaaataaaaagggtatatataatacgttgttagcatttcttatgtttataataagaatttaacggatatgtatttttaatataaaatgtttactgttagttaattaaaaatcatattttgtatgatttttaaaataattattatgaaaattaacgaactttattatacataatataacttgtgagtttgaaagtgaataaggtcttatatattatttcttataataaatcaaatctaatgaattttggattatagacttgtatacgaaacaagtagggttgtgttacatgacaatgttccctccgagtgatttgagagaagaaaataacaattaacaagtgatcctgcaaataatttcaacaagttgagctaatatattattatcacctccagtgccaattctccttgatagcttatgtgagtgtaggaacgagagatggaagaaagagtgagtggatgtaaccatgtcttaatggttccatacccaagtcagggtcacataaacccaatgctccaattcagcaagcgcttgagcaccaaaggagtgagagttactttggtcacaaccattttcatttccaagtccatgcatcttgaatcttcttccttacgaggcagtgttcaacttgatttcatatcagatggttatgatcaaggtggttttaatcaagctggtaatgtaccaaactatctttctcgcattcaagaagtaggttccaatagcttgagggaactcatcaaaaaacacaactcttcagatcaccctatagattttgtggtatatgaccctatggtgatatgggtattggatgtagccaaataatttggtttattcggagctgcttatttcactcaaatgttgcagtcaattacatatattataatgtttaccatggacttcttaaggtccccatttcatcaccaccaatctctattccagggcttcctttgcttgatctaaaagacaaaaccagcctttgtttatgatcctagattctatcctgcttactttgacttggttattaatcaattttctaacatccacaaagcagatatcattcttgtcaattccttctacaaggtagaggagcaggtatatttcttgtcaaacttgcacagtatttcaactcctttccaagaatatgttgtaatttactattcatttgatatcaattcttatgtctatggtttcaaaaaaaaaaaaagaaaaaaaaaacttatgtctatgattgtgtaccaacatgtttaaaatttatcatgagccatgtattggggtattgcagagctagtcaaaacaataatttcatccctattcatgaaaatgactaaactattggtggtatgtatgttaattgaagcggttgactagtaacagtaactgattaggaaaggtaaccagaagggactcaagggagtagttgagcaagataagatcttatatcttatgggttacaagttcgagtttccacttgcctttctgtttttttgagccattagttggctcaaacaaaagcctgcaggttcagttatttacatatcatttggcagcatggtgtgcttcagctcacagaagatggaagaaatagcattgagcctaatggcaactaccttcaacttcttgaaagaaccttccaaaagcgttgggagaggaaattaatgcacgtggaaggggtttgatagttaactggtgcccacaattggaagtgctatcaaaccatgctgttggttgctttttcacacactgtggatggaattcaacacttgaagcattgtgcttaagggtgcgaatggttgcactgccacagtgaactgaccagcccacaaatgcaaaattgttgaggatgtatggaagaggttgagaattgcatcagggtagtaatggaaaaggacttaggaagagaaatgagaattaatgctaagaaatggaaggaattggctatagaagaagtgagtgagggtggcacctcagacaacaaaatcaatggatttataaataatctgaaaagatcctaaactaaatatccatattggtttcaattaatatttattatgattttccctaaaaaaagtacagttgagggagagtctttggaattgaattgtatgagaattttatttccttctgtctgtttagttgatattatacgtttatttgattgtatggtaaattattatacatacaagcaatcacagactaaactattggtatatcttctcattgattctgtattctaaatttgaactagatgtaaatatgagactgagttatacacgagggaaacatagtaacactttttttttttaatcaacagcgtaataacacgttcttttaaaattctgctaaaacttacatggctctcacttgataacaacattatgtaattgcaccagatagcaattcagtgcaatacatatcgagtaattagtcatctgtctatgaatgaagagtataaaagaattttataaagacatctaataacaaattgttatagatggtaattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaaaattataacacacaattcaagcgtgttaaacaaatttaattaagtagtgagaaagaaaattatatttgcaaaggaatcaacagtgcatgcataaatgatattcatcatatgtctcaagacaaaataaccacactcacggatgtgctaacttgtttaatgtaatcttggatgtacttaccaaaaatgtataaaaagttatccctaattttttttttttgcagataatataattttgattgaagaatcaagtgaaacaattaaccttaaacttgaactttggagataggatatggatagagtttaagaataagtaggaacaagacaaaagacaaagtatacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggtttccaagtttaaatatctaacactattaatacaaaatgataagaaaatgaatgaagatgtcatatacggaatacaagcaaaatggctacatgaaagcatcgagaattatccgtgatcacatttttttgtgtgaatattatctatgatcacatcttacctaccaaagtcaggcaagttttattatatgtcctagtgacctactatatgatattaaatgttgaaatttagaggaaagaaaaattgacagaaatgataatgttaagatgaaatatgtaatcatacaagaaagaacatgacataaaataataatatacaagaagatattaatgtatcaccaattgagagaaaaaaaatgacaaacaattatgatgattttgacacaataaaagagaccaataaaacgaaccagtgaagaaaataaattatatggtttttaggcgtgtagaaagggagacaaaggacattaagaaaagttgttaagatagatctcagtaaatatcaaatgaaaagttttgatttctacatactaaaggattagttttcatttaataataattttttttatttcttaacgtgtatttaagctttagtcaacaaattattaaatggtattgtgtttcacttatatttcaattttagtacagtaatgcaccccaatagccaacaaggcctaagtgtcgtatcatttaaagtatatttgtgtgctcagctgtcaaaaatttacagagcttgctcacacttcattttcgtctgactgctacaattgaactatttgttaatacgaatacaaaaatcaatgactggaaaattcgaatggcctagaggacatttgcgcaacatattttgtggcatggaactcaaataggatgtctctggaagtcaaatgatgggatcataccctctacctggtctcatcttcaggtgcattaccatcttccctccaactgcccaacttaacaatgtcctcaactagaattttcccatctatagcaacaaaatgatatccgtaaattattgttttcatgaactaatcttcataaagaatagataagtttgataaatagtcactggatatattattcagagaaacattacaggtattcaacatcagtccttgatgaaactgtttagaagttgataacttcgtagggtaaacattaatttggagaccaatttgtttaggcgcatactttaaaaagtaaatagtaacactatatttaaaaagaagcggcaaaatactggtttagtaacatctcaaaaccagtcattttaaaagtaatttttaaataattttgatagcccactgaataatactttaatggcataaccatcccgccaatattcatagatgaatacttttggttgatctgtctgtgatactgttttcagttacctattgctctacacgtgaatttccatgaaaatttcactggaatttattttatgtgaataaagaacaaaactatttctgaatgcactacattgcaaacaaaatcaagaatgaataagattaaaaaaaatattagcttcatgtgcgagagaaatgacagacctctatctttggaaagactgctgacaagttcttggataccctccttgcccaatgtatcctttaagtacattgcagcagacgctacctcctcaggagttactttcccatcataatctctgcaaaaaggcccaaaaaatatctctgaaatcttatgcacagaagtcattacatatatagattgtcccaatgaagtaaggcatgtataagtggcaaacaagaagaaattgtgcacaagactaatcaaatttatcgtgaaataataatcacattgacatcccaaacaatattcaacttttagaacaaatgtggaaatgtattcttcccatttagagttgattgataagcttgcaacttggaaaatgagttcagatttatacctcggtcattcaaatgccagcaacttataatcaatattattattaacatagaatgaaaatatattcacatctttctcttgtggtagtggaacttaaattgtaacacaacacaaatcctttgtagattatgaagcacaacaaagtagtgcccttggtgaaatttataattgttaaaagccttaagggaaattgaaaacagcctcacttggcggttatatatgaacaaaagaagcaggagaaagttaagcatggtatctttggtggtaagtcattgacttctatctatgcttattttactgactatatatgcaataacatcttattcttactataatatcaggttcagaccccagaaaggtcccttctcatacaattacaatatcttgattcaaatcaccattgaacagtaatcacagtctgtggcttaatctacccgtcactctccttgggtaagaattcaattacaaaagagaacattttatgacatcaaatcatttatagaaaatacgaagtaagaatcccaaccaataaccaaatgtgagcaatagcaactacagaaatgccaacacacgccctgacaccttttgagttttgaacatattttttttattattggttgaaatttattccaacaacaaaatttgtgggtctcacttttaatttaatgagcactactcatgattttatagttttcaataaattttaaccaataatagagtgtgttgaaaggagcgtaagtcaaatgattcctattcagcaaacttgaagcagtatattcaagcatgcagtggcaatcacagattcacagtttagctttcactaaactaaatttatgcaaatgcattatgaaaccacatacttcactttaatgagatctgataaggttagacaaagcatgaccaatgaaaattgaaatgtcaaagagccttagctcaaaatgcaccatgtccctttagggactgcttgatcatacaatccatctcagcccggccactttgcctaaactttatcgtacctccccccgccccaaataacaatgttgaagagctagtgcaaacctgtccagcagcctccaacggtcaccaattttcgcatcaacgtcatctatttccttctcaagattttgaagcatagcatcaacctgacagattttcaaataattacaaattcagaagtgcaaaattagtttctaggttttccctaagactagataaaatgaaatgggtcttactctcccaatgagtgctgatgacaccttatccccttcacctgactcagtagcgtgttcatgttcctctcgggcagctttatatgccttaaaggcatcttttttaccatttgaaccctcttcctctaccatgctgttatagagttctatctggacacatacaaaacagcgaatgataagaatggcaaatggattaaatatatgtgcacaatcacagagggtggggatcaatttatagtgtaacaattgtcatacaaagacaaatgcagcttatagggcaaggggcatgtaccccacacttagaattcatcctcactatcactacttgttaaaaatgctacatgttaacaatgtcacagatgaattgtttgattacattaatagagagaaacatttgaaagtggtagcaataataatattattattaataataatatcaaagcatatgaaattgtgtattaaacaattgtagacttatctttaattaggttatattattgtatttttttatataaataacattttaaaaaatatttcatgtgttcattataatctttgaccatgccccagctaccaaaactgcctaggtttgccagaacaacaaaataggatttgatacattatagttagttacaacacacaacaacttcctacaagaaaacaatgactacttgaaatatcaccaatggttccgtatatctttcaagccaatcatttgaaaattgaaacaaaaataaatctgtaataaaaaggttaatgtttccacttatttgcaaagcatattaaagataaattctaatatttttcaatgaagtctaaaatgctcttaggcaaatataaaattttatgagaatatgagcatgatacagactttcaatccaaaataagacttttctgaaagattcatcttatagaaagtaattcattatagacacacactactctttctttctgtctttgttgatggatgttagcactccatctttttttttggaccaaaagcaaattcctccgttttctttttcaaacaacttaatcttattggtatttggtcttctaatgattatatatatatatatatatatatatatatatataaaacaatctttctctttctttccccctctcttttgtatctctgaacctctttcccttaccttttccctctcccacacctctctctgaaaacctgacccccctccctttctgctttttaacctgtctatcctctgatgatgaaattggatgaatccggtgcagaggagaacaagggaaaaaataataacatatattgtagacatggtgattctcacagcagaagagagacattaacccgagaaaaaaaaggataactaatgaattttaaatttaaaaacaccaccttaataaaatgtgttaaagacctctacgtgtttttattgattaaaactcaaagacatattgttagcacacttgcatgcacaacaaatatttaatgcaatctatagaagatgtaaaagcaaatgatgaattttgaaaggtcacacatacctctttgttaaccagtctaagaaaatcttcacgctctgaacttacagactgccaccagagtaaaagacaaaaccacacattaaacagcttaatgttaaatagtaatagattatgcaaaataaaagaagcaattcaccaaattaaaggaattgaatattttagatatcaaattctcaccgatgcagaagctaaaacagctaatgcacgactaagttcacacagttgttctttgttttcaaatgctctgtctctagcaagttggtgagcctcttttgctgttgaaatattcatctctttcagggccttatcatcttgattagaactactctccatccttgcttgcaccacctcctctctctcttcctcctcctgcatttatttataatactatgttacgcattgtgttttttcataacatggaatcttagatcaatagaaagctacttaattttcatcaatagttatttaaaatcagaaaatgaactttatggtgaactctagcatatcaacacccaacatttcatttgttaaacttactgatcagactcccaatgaattctgtcaaacaaaatattgaaatgattctttttatgtcattgatcatttagtattttttagtagattcttctcatatgaaccagagcaaatatcaaacactatcaaacagaaaaaccttgtcaatgtcatcctaatacaacaaagataccttttaacaggataactatctagagcaatgcaattccatagtttaccttaataagttcttcttgcatttcaaggaactccaatttcctcctcctctctgagacagaatcctcagagggcaaagatgtaacctgtatagtatctacaacctcatcagggagagaagaaagtgtagcctgtacagcttcttctggtttcaatctcccagacacagtaaatgacctataaaggatatcaagtgagatttcaaaatgcatatccagcggattttttctttaacttactatttggccccatcaagggactgagggaggaagccatgttagaattaccttgaaagtatcaaaagagatgatggaacagagtgattcagagataagtccaaccaatctcgaagctgcacaggcaggttcacaaattttagaatagaaacaccaaagcaacatttgatattcaagaaaactgaggttttaatatcctcgtcaagatccagtactcaaatagaatacaaatcatgaattgtttccaacacaaaacctgttggcgcatttcttcaacagaaagcaacccaagcatgcctcgctctctacaatcttcccgaagttcatcttctgaaagagaatccacaccttctgcttgaatcaatttatcatcttccttaatcctaaaaaacgggggcatgttgcaagtaacacaattacgaggttcatcaagttatatggtaaattgaagtaaataatctgaaaaggcgaaaaagaaaactattttgtggagtttttgtctccaatgaggctaactatagtcataacaacagaaaatgaatgcagtagcatataatagcagtttgaagcaatatattaatgagaggttaagaaggaacaaggcctacatttcaaacctaaatgtgtaccaaatcttttaggcctacatttttgtctccaattttttctttttttaaataaaattcctctctaaatgatccaaccttaaataaatggaaagaaagtattcttgtaataatttaatcatgtataatgataccaattttcaaaagttaacatagcattaaactccaaaccaaacataggaccaattccaatccaatttgggcaccaaagttgcatcaatggatttatcaggaatttgatatttgattgagcccaatgacattatttgtttcatgaagtcaaacctatctatcaagatgaggctttggttgttgttgtagccacaagatataggagtaccgagtaccctggttgtgttcaatcttttgatatttatatttgaataatacaattcacagagattatttgttctcttattttgtaccctaatggcatagtatggggaggtaatcttttctaataacaaggtatctttttttaattagagattttttttttcattttcctaattgtattacaaacagtttagataaaaccccaacttgcaattaaaattagtaaagaaaaaagttacaaaaacatgcattataaaatgcatcctacctccgtaaatgttttcttagcatataacgcaagtatgcatcagtgccaaaagggctgattcccatgtacttgcacatattgactaatcgtggcctacgagcagtaaagacaaaatataagtcataataccacctcacaactgagaaaaacagcatattgaagtcaaacaggattaagaaacaaacctgcttgtattatctagagtaagttcatcattaaacaacttagcaaagcccaaaatttcctcattagagacagttgcacctcttctaatctgcagaaagtaaataaagcataaaaatgacaaactaaggaaaacattcagaaagaaagattgataaacaattctttgaactgaagttttaaccgtgtttaaaaattcatcaagatcttcagctgttttctttagttctccactgcgggagttctgaacttcttttgccatttctttgactgtatcctgaaggaaccttgcatactctattcttgccttgagtctccttttcaatgcttcctacacattgagcaactgagtcacccaaagaccctacaatgggcaatcaaatcacaaattcatggtaactgaaaagataaaaaaataatgcacactacaaatacagagacacaaaaatggtttctaatgaggatatttgttaccagtggctgctagagaacatagaacatatattggtgcaagctcatatacaattttcaaccaaagatgctgattattagggtattttggaagtttggtgttagaagagaagggaaggaagaacaaatttttatttcaaaaaaattttctctaattcaataaaaaaattaaaataaaagaaataaaatgatagatcagcatcaatttaatatgttaatcttttataaacattatacagctctcttcatttaaaaataaaatatttgtcctcccctcccttcccctccaaaacctaattcccaaacatatcctggtaaaaaatggacattatgttgatgttaatccttgggagctatactttacataggaccttcaacacaggctaggacaagccttgcagttgcttagttatagaatttctatttcccctggtattattagcatgaagaatctggctttttaaagtgagtgatttcagttgttgataagaaaattaacggttacgtgcacatgcataaaaaatcaaggatgtgttgaaatatacaccattgattttctcatcaacaattaaaaatacttaatttatccttactcacttttgagaagccaaatcctagatggaatgggacaagattttaaacagtttatgtacagtttattttaagctagcaaagataacagcaaacagccaaaaaaattcttggcaattacctgttctttcatcttgtcttgaaatgttgacggcaacatgttagggaataactttagaaacacaggcaggaggaactccataaagggaacaataatgaaaacagcaaaaggaactagcctaaagatatcggcagtagtccgcgtcagttgctgcctttcccttctggagagactcttcccacccgcaagcttcaacaacaacctggaactgatcctcacatcagcccacagcagcttagaacccaaccaataatgctgcaacgtcgacacaaattcccctttccagtgaaccagttttttcgcccagtcctccctgcagcagcagcagcaacaattagcaaaccaaaacaccaaataaccaaccattaacgaataaacatttcactgcttcaaatttctatctaataaattcaaaagcccgagctgcaatttctatactctaaacacaactataacctcaatttaaaatcaaatgcactctcaaccgtaaatgcaacaattagcaaacctaaacgccaaatcaccaacgaacaaacatttcactgtttcaaatttcaatctgaaacagcaaatagcaattgcagccacaacactacaatttcaaaagcctcactgtaattgctataatccaaacacaaccgtaacttcaatctaaaatctaaaaccacatacaaatatcaacagtaaatgcaatttcgcgtaatttatgaaaccgtaactgcggacctactcatagacgcgacagctctcaacgcaggaccgattcccaaaaacgcagtccacactctccgcaacacgctttgtaggtctttctgcgcctcttcttgcgcccgtttcgccatggctttggccttcgcagtggtcaagccttcgacggcttgatcgcactcctccggtgacgcttctttccgcttctgcgccaccgtctcatcgttctcatccggttcatgacgtttcgccgccgaggccgacgactgcgacaaccaccgcacacctatcggcgcgttcagtgtcgaaaaagcgtcacacggaaccgcgctcccgaatcctcgaacaacttgcaccaatccgaaacgattgaacaagtcgtccctgtacggcgtcgttccgtgcttacaaggaaacagaggtgacgtcgtagctatagcgcgttccagagagcgattactcggagacggagaagaagcaaaacagttattcaagtattgatggattaaacttctccttctcaaaattgctcgtgatgccattctcgaaggaactaaacttggaaaagtcacagtaagagatgagaaaaaaagaatgaagaatttgtggtactacacgtacgaattgcttagatcttatttttggttctattgttagtgagaattcggttagaggttgaagataagatggtgattgaacttacttatgcggaacgtagaaaacggaggaggcagaatacgaagaaggaatgaagaaacaaagtgtggtgagagttagggtgttaggaaagtagagcggagaggtttaaggagtttttgttgtgcagctttggggaggggtcatcgggttttcttaccactttgtccttcctacttacgtcttattcattttataccctttcaattcgtgctgcttgacttgttatttaggttggtgggtaaggcaaattattttgttgggtttaaagtattttataaggcaattgcttcttgcatcccatgttgtgcttcttgcatccataagaaacttaaaacatgcaaaaacatactaaaatatgcttctgcctttgtctaacactaacacacctctccctttgtctccctttctacacgcctaaaaaccatataatttattttcttcactggttctttttattggtttcggtggttgatggtaaagggtttatcttggacggcgatggcaatgacctcttgcacgaagaggcatgtgagacaggtatcgtgggagtagtggaggtcaacgtactcgtcggtgatggagagtggagtaggagatgttggcattggtctagtcggtgtagagggtgacggtgcatcaacagttggagacagattgggagggtgcgacgaggttgttggtggctagataaagtgttgtagttagggccaacaattgcagctaagcaacatacgaaaactccactttgaatagtcataaatttgccaatcgaaatagggtcttcaaagaatacacaagtaccgtggactctatcttgaatgtgtacacggttgaatgacaccaaacaccttagtgttccaccttttggtgtttttgtttggagaacataatttggaatagtttttggtgtccaaattatgtattttgaaagaatatgggtaacctgaaaaacttatacttttatggaatacctattttggaatatgattttcattttagaagggccattctgtaatatgtgaagggtgatttgaggatttaaaaacctttaggggtggaggaagcaaaaaaatgggtgcgggaagcaatggcctctttagaattgatatattgttttaatctggcccaaatatatgaaacttttaaatccatttgattcattttactatccccaccttaatgttttgcatgtttgaggttgggaagttgctactagctttaaccccatttgttattggcctctacaaacttgagaaaataccttcttatccctctatcttcctcttcacttcttttcaccccgcccaacccatcaccaccacaccaacgctgcgcgccaccaccttcacctagatccaaaatcgcagcacatcaccacagtcttttcgaccacctcaccacgtgaccacctcaccaactaactctgaacgcaccactaccaccgtcgcacatcgctcccaactttagatttgcatgcacgacctctcaccagcccagccaccgcgcgtcctcaccattgtgtccaaacaccattgcatcgccgcaactccttcccttggtttgtgcgcccccaccaactccagattgcatgaaaacatgcttctgttaaggaagaaaaaaatatatacacaacaaaaatgtgatttcgttttacactatacaacaaaatcatatttccgttgtatatattttttcacccctacttaatccaatgaaattgtgttttttttgcacccccattacataatgaaaaagtcgaaaacccaatttcgttgtacagttgtacaaatagaattgtgtttccacgaaaagggcatttttggaagaaaaaaggtgtcattcccttagtaggggccattagcaattgcagcggggccaatagcaaccaccctaaggttgaaatgtctcgtgtaaattgaaatnnnnnnnnnnnnnnnnnnnnnnnnnnnnnnnnnnnaaaaaaacagaatgtggacttcttagtgaacttgccccatgtaatatgggaagagaaattcaaggaagacacaagtgattctaatcctgtaaaattatctagatgcaatcctgcaggagttgaggaaggcaatcaaggcatggtgtaatgcttttccttggggtaaagcctctacagtaaagatgattaatcatgattgcatgatacattgtaagggttcctgtcttgtcaatacaaactacaaagtatatccctgcaacattaaaaaatgtaaatacatagaaaaagtatttgctagaaagattcatatttcgaacagaacaagcctcttaatcttatattccttgcagtattttctggacctgatgttttcattcatggataatgatgttgtattgctgttgcatccttttctttcttttaactttgttgtgcatttttgtgttcttttgggtattttaggggtgggttcaattattgatatacttgaagtcccgtgtatacataagcacaattgattaaaactcagaagtcaaaaaataatttagacctaagcatcatgacaacgaagagagaagaattaattattaatttatctgttactgcaagttcatatttatttattgtgtttctaatatatataactcctatatttaagccttggtaattgaagattttcgcattctgattttccccaccttaatctgcaaaaattaaaatgcatgctagtctaactcttcaatcattaattgtctgttccaattctcttttccccatgctatgattttgatggtagggacaggggaaaggtgtagctaatgatgggtcagaatggaaacttgaattcaaattttaagataacatggttgagttggttcaaatgtgtgcagctacacatgaatttagtgtccaagtcttcaatcagttgatcttaatatgaatttatacttatattgatgataccatctcacgtatagatgtctttagccatagcaagtgccccttttgcaaggcatgtactaatgataaggggaagcatctgaggattgagggcagatgcaacctgagatggcaaaacgaacgctttagctcaaattgagagatgtaaggtaatttacacaaacatcatggtaacaattgttagcatgacagaaattacaaaattgagagatacaactaatcatttctaagcaaaattcttcattcaatttgacaatcttaaagataaaagatataggaaattacaaaattctggcattggtaaataatgagtttagacacagatttgtatcctcgtgacttaagtacagcaatattagtatattactgtgatccgggtttcttaatgcaaaagacaagatacaaattactcaacatatcaccataacaagatagcctggttatggatgtataaggtccagcgaaaattatctttttcaaagaagagaaataaactttctattttttaacttacagattaataatgttcactgaacctttatcatccaaacagaattgagaaccacctccatactgtcaatcatccatcctgaatcaaaccataaaatttccaacttactgaaaacgtcagccaatctttagcttactgtcatcaacttatcatcaaagtgacaactattaatcagattatcaatactcttccttcaattgttttaataagaaagatatattttcatttttcttcaaaaagaaaaacttggccataattaagtgaaagactgatcaccatgcatgcaacacgttgttaatgagagaaaggaacactgaaactttattaaaaagataaagttacacttcaccattgaaactttattgtttcacgctgttgaaatataaatgtgggttgaaatcccacattgggtagaaatgaaaaaaataaataatatataaatgaaggaaaaacttatgtactttaactttaaattttaggttaaagtgggatgtgagcgaaatctatttatttgagactttttaatgtaaatctccccatgtttcgaaagtcttgtgagcctaagtttttgtttgtccctcctgttgttccaaaattggctttagtttttgttggcacaatgaagggcatattatatacttttaaagtcacacgaaagccaggggcattgatatatttagtgggccagggataccactgctgtatcttgttggggtatatcgtccaagactactttttatttttctatttataacaatcttcttttgttactacaatttatgctaagtacgtggattgcattctttaatgtagttgcttttgcttattaaagaaacagatataaagggtgacttaatcatacaattggtcttttaattataattagaatttcaattaaattctttaattattgaaaagttaaattagatcttttaattattaaaaaattataatttatcttttttgtcaattctgttagtttgattgacgaaaatagatattttcatatttattgttaatacaattgatgtaaaattataaatttttccatcgatttccaaaataattgatgtaaaaagacaagtttacattgtataaaaatgtttatttataaaacttttatcaatcaaactaacaaaattatataattataatgttttaaataatttaaaaatctgactgaactttttaatagttaaaagatccaattaaactttaaattataattaagagactaattgaataattaaaccattttaatttgataaacatacctttcattccttcaaagtaacaactagtaatcaaataatgtgaacaataatcttatcatcaattgtgtgaatctatcaatcttatcatcaaagtaacaactagtaagtaagcaaattaccaatggccctccttcaattattttaacaagatatatattttcctattcttaaaaaaaattctcaattattaaaaaactacattcaattgtatatcattttccaaagtaacaaaatgtaaaactgataacattttacattgataatcaatataatcaatgtaaaaatatatatttacaagtttattttaataaatgcataattattaaactctaatttttattcaatgtttacaaactttaattcaaaccaaacatacattaagaacatttttagtgctaaatcttgaacaagaatcttgagtttaaaatcttattttcactagatctcctaataaaggaggtgaggagatctccaacatgaataataggttattgtagaataactgggaagatttgtacattgttcaaaaaagaataaattttttcctctttttctaagatctcaaaataacatctactactaaagaaaaaaaaaggggaaaaatcttcaatcctacttgacactatatatagagtccacaaaaaaagtggtataaaatcccaatttgggatgtaaaactaaatatgaatggaatgcattttttaatattatgcttttggtttttttcttgctatctgtcttttttcaaccttacgtgcaatccagttgatattttttcctaatataaggtgccgaatgtacttgaagccaatgcgcataacacattattccaaactgataaactatcatcccatatatatatagaagaagcatcgatcttgcagtctaaagtatttgaagatggtgtgttataagcaggcagaatctcataccttgcttgttttcacatactcgtggttgtggtgggctacttgtattgctgctgcaaataacagtttaaagaccggagatacactgaatacaacaagccggctatgttcagaaaagaataaatactgcatgggtttttccccattaatacatccaaattctccagtctacactactcacttgagaatcactgacaccttaaacggtgatgatgacaacaaagtgtgggttgcaaatagaaatcaaggtgttgacaaggattctgcagttcttatgctgaaccactccggtgtactcaaaatagaatccaaagatgcaaaacccatcatcctttactcttcacctcagccactgaacaacaccgaagccacgctgtgggacacaggcaacttcgtgctgcaacaacttctcccaaatggaacaaacactgtgttgtggcaaagttttgattaccctactgatgttttactccctgggatgaagttaggggtcaatcacataactggtcataactggtcacttgtttcgtggttggctgaatacgacccaagactaggccattcagtctcgagtgggaacccataagaagagaattgatcatcaaggaacgaggaagattgtgctggaccagtggagaactgagaaacaacaatggattcatgcacaaaacaaactacttggttgtctcaaacgacgatgaaagctacttcacaattacaacttcgaatgaagagcatacgttttggacgctattagaaactgggcagctgataacttcgaatggagaaaatgctgcaagggctgatctgtgttatggttacaacacagatggagggtgccaaaagtgggaggagatacccacatgcaggaatcctggtgacacattcaaagtcaaggaacttttcttcaatgttaaacacataagcaatctagctaattggagttatggtcccagtgattgccggcctatttgctggaaaaattgcacttgtgatggatacacatattattatgaagatgcaagaactggttgttcgttcttgcatttgaattcaacggaaggtgatacttttgcaagtgggggaaagaagtttttgatattggtaaagaacacccatcacaaaggtaagtccatatgatttcatgacttcctacttcacattttttatgctctttccgtttttaattataattatttttttataaattttttttttataaatttttttttaatttttagatgtattaattatttttctcttatatatttttaattattcttttttcaaattcaaaatatatttcacttgtaaatttaatatgattaattaaattaattattttttaagaagcctaaattaattttaaaattcttataattagacacggagacattaatttttttaagaagaaaaatgtgtattttaattcttatgttttcatttaaatttgattttgtttcctatattttcaaactaatgaatctaatcctctaattctttaaaatatgtgagcttaatctttttcgtgtttaacttaacatttagtaaggggttttactgccattaagttataaacaaaattaatttaactcctcctataatatcgcaagaaggttattgatgtttaattagaattatgcttttgtgaacacatgttagtctgcaaagagataaagaaatattagaagaacgaaaagtgataattgatgtgacatgtgataatgtgataaaaaaaagagctgaaaaaagatgagttgttaaataaatatttatactgagtattcatgcatgtatcattgttgtaatattttactttaagtcacatatgtggtaaacgttatagatctggaatcacacttacatatcttcttacatgtaaacactatgcaggtaaaaaaaagtggatatggataactattgtaacagtagctgctctattatttgtgatatgtgctaatttcattctatttttcgccttgaagagaagaaaaaatctgcttgaaggttagctatatctttccagtaaacgttgttccaatattttatatattgagcataatcccttcattcactatttctatatatcattcaaaattttatgtaaattaatagagaagaaaagaaatagaatgaagatgaagacgctagattcagccattaaagatcttgaagatgagttcaagaagagacaagatctaaaagtatttaactttaccttaattttgtcggcaaccaacaatttttcaccagaaaacaagctaggacaaggaggatttggacccgtttataaggtgacgtgaaactattgactttgtgttgtaagctgtatcaagttatgacaaggaggatttggaccagtttataaggactaataattttcatgttgtttagggaatcctaccaactgggcgagaagctgccataaaaagactttcaaaaacatctggacaaggaattgtggaattcaaaaatgaactaacgctcatatgtgaacttcaacacatgaatcttgtacaactacttggatgttgcattcatgaagaagagaggattctagtttatgagtatatgccaaacaaaagcttggatctctatatattcggtatgaaatatgttggagtttatttaattataggtgatgctttaatttggaagacaaattaagataatatttttttaatcatcaagcaataattccaatgccatcgtgtagagaaacattaagttttcaacggaaattttcattaatgagaaatattagtaacacattctttaatatattttttaaaacacatatttattcattgattgaaatttattgaaaatcataaaatttggcaaatttaatataataactttttctcttaatttcatattttttaataaattttaactaagtaaaaaggatgtgttaaaagagtatgttcttctttcatgttatgggtgattcattgactcatgctttcctttcttgaacatataactgtgtaaatgtcatgctttgtttaactctttttccatcttgaacataattaattaactataactaaactataccaatgataaatattgctaacatattccaattaaaatataagtttgtataatctaacaaatgtttccgagatttagtaatgtacacatttatttttttagttggagtatgttaacaagttataattagatattatcttaaatacatcaattaaatatgtaatttgttaacatagtcacactaagtatgtatacattaacaaattctataatatatactcacaaagattgctttatttttaacacttgctttatttccattgagaagatagcactaaaagcaagtttctagactggaagaagcgtttcaacataatagaaggaatttctcaaggattactctatcttcataaatactcgagactaaaagtcattcatagagacttaaaagctagtaacatacttcttgatgagaatatgaatccaaaaatttctgattttggattggcaagaatgtttgcagatcatgattccgcaagtacgagtaggataattggaacatagtaagcttgcaaaactctatcggtttcaagtgtagttgaagaaaacataaataggtttgttttgccaagttataattaaactctttttttcagtggttacatgtctcctgaatatgccatggaaggaattttttctataaagtctgatgtctatagctttggagtgttggtccttgaaattatcagtggaagaagaaatactagcttccatgaggatcaccctataaatttggtaggacatgtaagtgaaattagtctcaacgacttcttttaatttgattttttaatactattttctttatctaatttgactaaaatgctaataggcgtgggagttatggaatcaaagtgtttctttacaattaatcgatccatcacttaatgatgattcgtttgatcctgatgaagtgaaaagatgcattcaaattggtctcttatgcgtagaacaagacgcaggtgatcgacccacgatgtctcatatactttcaatgctaacaaatgacagtgcagtaattgccatgcctcaaagaccagcattctatgtggaaagaaattgttttgacagtaaaacatcttccaaagagttatatacagcttctactgaagaaattactacttccttgtaaatatataagtttgtggcacgagatatctatcccttatttttgtttttataaaaaaattattttagaattatttcctgtaaatttttccataatttacttatatgttaggacaacaaaacaatatatatatatatatatatattatattaattattgactattagatgttaaactttccacctttaccaaaacgatgttaaattttccaattgtgttatgtgctggtgggggagcatgcactgaatgacaaatattttaaccaaattaaaaagatttgtacctttttgcaaggctaagcacttgagaaacattggtaacaaaagatcagttctaaattaagcattcctagagctttgaagcccttgatcagaaaagatctaacagctagcataaatgcattaccacctagctagcgttcttgttggcataggacagcctagatttgaatgcaccaaacaaagaatttacggtcttttggtaggtggagtgacttcggaaagaaattctattatgcttccctttaaaacaattatcacacttgtgcaaatgtggacacctcatgccagacatcagacaacacatccattttggttagttcaactatgcctttctcacatgtaagacaacctttgatgtcaaaacttaactttttcaactagctagttccattacatgaacaacatcaataaacatttttgcttgtgtcacgtaaaggttggaatatttcatacgtttagaaacaaccatagaacactttggtgagtttccaagtatcccgattgtcataagcttcatcacataccctagcccccaaaagatcctctttttgtgtttctaatttgtttcccttttttttctgccataggacatgagtttgtgtggtttttgcaagtggaattctatagtatttttatctaacaaatgttagtggttaatttattattttttgttaatagaattgcatagtggttggttgtcatggcagtttgcatgattctcttctcgatcttttttttttccttaaagacatgagattattttgatttagatcatagatattttttactaagacaatctgacttcaatcttgtgaaattattatgattaacaaattctttctctaaatatttaacacttatatacccaagacttgaatttgagtagatctttctcagtggtgaaagagtttatgtttaggttaaaaaaattataaaaatatttattatattaataatattttaaattttctataaataatattatttaaaatatttcattttaaaaaatattttgttatgcatctttgtttttttaaaatattagaaacataaaaaaattatatttacttatttaaattaaaagatgaaatatttataaaataataattattttatattatattataagattatgtcaatatattatttccggaaaatggtcatcctttttattttaacaaataaaatataattttattattgaaattttattattaggttatattatattattaaaatatattttttaaatagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatacctgatcatttgtaattaaatgataatctaaagactatttacattatatagactatatacttatttttaaaaaaattaaaaataattaatttcagtcttaaataatcaagtcattactatttaaaagagacccgtgaattgtgaaaacatcaaaaccttacggtattcttaatataagatattatttagaagaaatagataatcatttttataagacattttacagtttctttgaagcatttttttcttattaaatactctacgtatctttgtgtttttttattgatgtgttctattattttataatgtccttaaactttaatannnnnnnnnnnnnnnnnnnnnnnnnnnnnnnnnnngaaggagtttaaaagttttgataatcgatggagatatttctttgcaattagcgcacaaaaaaaaaaagtataccttgttttagaaattattggaataaaattcaaaacatgaggccacaatgaaattattaaaaatacaactattaaataccaaaaaaaattataaaaatatgtagccgttctttatataagattagataaaatgatttacaaatttatggcttaaccatataattttcatggtaattaatgtgtagaagccaaaacgcttgttttttgatatcatgatgaagatccaaaagatcataaatattttggtgtgtctaaaatatttttggaaatgagagacacaaatgtaaaagaactttctcccttcatagaatcttggattctcaccgcctcctatggaataatttaagtggaaaacttaactaaatattctttttcaggaaaacttaattccaacacacctaattctgcagtcattcatctgtgatggattcgggtatgcttctgttttctaattaatttatatacttttaatcatttgacaaaaaaaaaaaaaacccttttatttaataatggttatcatgtttgatacgttcctcattcctaatacaatttgctagtacaaagctcttcaatcactgttagcaaccaaagctgagtgagacattaggctttaaatgggccttgcaagtggcacgagaactctcctttgataaaattatggttgaaactgattgcctacagctgttccaagtttggacaaagaagcaaagacaaagctttctcctattttgagactatggaccaatgcagagacaagcttttgttcgatgactccatgtacagacattcttttctcatcaatgcatgatatttccaccctttacgcaaaaataaaaaatcattgcattctgcttgttacgttctaataatttgtacattgttgcgtgtttttaatgaagcaaattattgaattacgatacgattcaattattttatttttttttttgcatttgaaaaaggttattctatagataattaatttcattaccgtgatgtgtaacatttttccttttacaagaataaccagatgtttttttagatgttgtattaatagatagtcaacccaataataaaacatctgtaactaaaagttttaggcctatcagtaaaaaaagttttgttattaatttttataaatgaaaaataaactcagaaagactaaagttgatgagtcagaaaggaaaggaaacgggttatcaaacaaagaaaggaaaaaagaaacgaaagaaactcaaagaagtattgtcgccttttttaaaagaagattgaattatttaaatcatcatcaatgtactactaacaactactactagtagtaatcaaattatcactactctctcccttcaattattttaataagatagatctttaggaaaagttacaccaactagatattattatttttagtggttattttttttttaagttagtgtggcaattaatagcaatagcaatcgcaataaattaattactaatagtttattatttaagctacactatttatgactaatatattattatcggtaaaaattatttattaagacaattattaagaatagccagtaaaaaaacattatattttattcaaataaaatctaatttttatttctctttaattttttccttttcaaaacttttgactaacgcactaatactctttttagcaattaatcgttctctttcttgacatactttttctcgcttttaatcgttttctttctcaacaacctctctcaacctctcacactcatcacaatgactttttccaatcattcattttaatcatcctctttctcaacgacctctcttttttgtaatcactcaccaaggagtgaagattatctccatttctttcattactaagtgcatttgacaaataaatatcacttttataaaatgtgtattatctcctttttctaaaaacttatcaaaattaaggagaaaatagaagaaatggaagagacagaaaatgaagagaatccatttccctagcaaaaatgcttctcatataatgcttttagatatctctgtgtttattttttaatgttagaattttgtgatggttttatctttcaaataattgtgtttgtgatcataaataaaggaaaagtagaagatatgagattgatttgatgataaaatgtgaacgaaaggagagataagttggagattcaaattctttggctgataaaaattaataaactaatatttaatatttattgataaattaaataaataaataaataaataaaacgtagatatatcaaagaagaaaatgaataattgagaaacaaagaataattatcaaatagcaaatggatgtataaatggaaattgacggataaaaaaaaacaaaatatttaatgtatgttttatctatgatattgatataaaatatatatttttaaacaataaagaagaaaatatattaagaatatcccatatagcacaagttaaacgaatattggagcaaattttacagaaagctgaataattgaaaatagagtccagggaataaacaaacattcctatcactggcctatattacccggtgtcgattccatcatcccaccgctgcaactgaaaacccattgatgcgtgcatctactgcaaatacttcataacagaaagaaaaaaaaaaaaaaaaaccaccagtagatacttagcattgaaaattttatacctcccacctactaccaacataataagcatgtccttgcatagttgtctcctacccatatttaaacagcacttttaaccttggagatttattcctttgtgcaacaaatattaattttattaataattaatctttattaaaaacttaattaattatttttagtgaaatctttttttattagttttttatattacaaggttcgaattcaaaactttaattaaatatatcaaattcaattcagtatcactcaaatcaaaaacttgttagtaaaaatttagtgttaagtacatgaatttaaaatatcacactgaataaagttaataaataaatgaaagcttataaaatagtaaaagccgacgaaagaaatgttacgtgggattgagggagtccattccaatacgggaaacgaagtaaattaaaggtccatttattctctattcgtcccaaaataattattattatatgttattttatcatacgaagaaaaattaataaataaataaaagtagtaactttataatattaatattataatatcattaatttatttataaattttgttgtacattattgatcttataagggatataaatgagaaaaaaataattaatatcatattaaaaaactaaaataacaattattttttacatgataattataatgagacagactgaaagagagtattacacttcctaaaaatgtgctttctccattttttatctgtcttttaagattattatgtaaaaaataataattttttaattctaataaaatagtcacgtgatttcctttttacctttttttttcttatttcacaataaatgcatagcaaaataattaaagattagaaagtaagtatggatataattgataaaggataattaatttgatattgaactttctagataagagataaataaaatcaaattaaaattttccttaatccaacacttgaaaagaaacagagggagtagaatatgtatctcctttttttgttgtcctgactcttcataattcttatataatagcatactatttaaaatagtatgagaaggaaaaaaatagaaatactaattataattttaaaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttttacttttatacatttaaagggaaaaaaaatcaaacaaaccattaattattttaggtcttgaagacggatttctgaaaaactattcttttgttaaaactacttctgatgagtgaatcctatttttagaggttgatataatttacattaatttttctcgagtttaacttatgcttcttaatcaagtcttattcttaaaatcacacctgacaaatcataaaccaaaatgatatatattatattctcgaatttaactcatgtttcttaatcaagttttgttcttaagatcacacctcacaaatcataaataaataataatcttaagtcttgaagacatagaatgtacttcttgttaatttgttattattgaaactttattgtataaaattatttgcttcctctctttctccatctttatgtttctttttattttccacctaaatcttatattattattacttttactacagattgcttaaatgtgtttttaaagtacgataactttgaaaaggagttaactaagtcatgaaataattttcttacaatataaaatcataaaaagataatataaatttatatatatattatattatttaataaaaagttatatatatgaaaataaaatgaaaactattataattcttttttaaaaaatatataattaccaaatttcaagttctcataaagtagttaattgcccttacataattttgcattatccattagttaaaaggtaagttctatcgaacatttttaactaattagttaagcatatcaactttcactggacaaacttttcagcttttaaatgattaactgctaatttgacaaaacacattgccaaacgttcactgagtgccacagcagcggcatctaatttgattctataaaagttatacacaacattttttttttgtgttgggacacaaccagtggcggatccagaaaaataattaagggggtactagtaatagatttaggaaaaatttatttatgtctgcatatttagtaacggggttcaggggcagtgtccctgaaattttttttttttgtaaagaaaatttaaagaaacaaacaattataaactatactctaaagaaacaaacaaatagctggaccaaattactgttctggactgaacaaaacaatgaaataagcttattgtaacttttgatgagatttcaaaagatcatgatgacaacataagagttagtttagataaaagtattgagtttgagatctttgaatatgaattgttacaatatagactaaaatatttctacaaaatacatatgattaaactgtacttctcatttcaatgaagaacaaggactttaatttccttataaacaagtactaatgcataaattacaaataaaaataattaacaaacattacaaactatataacaagcattgaaataattaacaagtattacaaacaagtgttaaaggtatattaaaatttattggaaaaatttaagggggcactgccccccaattcataagctgcatccgcccatggacacaacatatatcgggcaaaaagacgcaaatagaagcacatatggtagtcaataatatccataagtatagtatagaaacacatttttattagaaaatttatgagaataaatattatatgttgtttatggtacatttttcaaagaaaaagagatttaagattggttgagtagttaagaaagaaaaaaagaagaaaaaaatttcaattttgatcacttttattaataaaaattaacaaattaataaaaaattaatatttattgataaaaaaaatatcgataggagttgttaccgacccgctagtgaacaggtaaaggtgtaaccatgcaaattcattttcaccaccctcaaatccaagctcaagttaatattattcaaattccaaaaattattaattgcaatggctattgacagtacaccaatatgaagctcaccaattggttttgaggatgcaaccctgaacttgcatgtcttccttgccacgttgtatgtacttgctatttatttcctgcacgcattgaaatgtatcatggtattgccaagtttagaagacaacaaattaagaaggctcatcaaaaactactaaagtctttttgcatgtatcaacttgtgatctcaactctaaaaacaatgtgcttaccactagactaaaaatactagactaaaaactataattaataattagaacataactttttatgctttaaagcattagcctaggtgtcactattcagtgtaactcaaactcacatcttgaaggcaagaagctgactttttggaatatagtgtaaaatgaagttccacatttaatagaattagaaaaatagagtacgatatatataagtgaggaaaaaatccataaaatgaataatacaaaatttggaagcctcatgtataatgaaagcaaaaaaatatgcatcaacacttctatcaaaaacttcatcttttgtaaatctttataataatactatatcacaatatttcttgaaatgcttgtccattttctttacttattttttcaagtatggatttttaagtattttctttgctctctaagtgttggttgtaatttgtatgtgaaaaaagttaaatatcataaatttttggagctaatcaaaagatcatggtcatggtaatttttatatgattgtgataattttgtatgtgtgtggttatttggtacacatatagtaattttgtatgtttgtgcgtcacctatcatttaaagattgtaagaatcatctaccaaatttaaatcctaattgataatattctttaattaagaaaagatagaaggagaatctccacaatattataaataaggaatggaacttctctttttgaaagtagtttaatctttagttttattcatatctttttacgaatttgtgagaaatttgagggcttttgaaagctgaatagtacggacaacaccgttaggatgaatcatgatcattgttcttactattgatatgtctatgtttattttttataggattgttagttttgttctaatcatgagtgactaagccccctaatcaaggattatgatgtaaatgtctaaatgtattcttatccttgttcttaatgaaatttttcatcattttatgttaattaattattttccttggcttaatgtttatttgaaaccggtcatactactcaattaattgtataataatgatcatctgcatataattggtagatttagataaataattttttgtaccaaattgcgtgatcaaactgttttggtaatatccgataaattagttaatctttaattaaatatacttagaattaattttatcatttgacttaattgatagatatatgatcattggagtattaatttaagacaaagaacatcttctgatctcgacttagttgatttttggaatcaacaattaactaggaaagatatttcattgtaatattgatttaaggcacgtcaacttttagcttttcatccttgtaactaatgcatctaaaaataaaaaaatggataaaataatttcaaaaaaaatcttataattagtaactaatggaataatagctaatttgaccaaacacattgctaaacgttcgttcaccgagggccacagcaaaaagcatctagtttgagtgcaaaaagacgcgaatagaaacacatttttataagaaaaattctgagaaaaaatgttatatgtcatttatggtacattgtacagagaggagttgttccagaccctctagtggacactaacataggacgaaccatgcaaattcattttcacgctcaaattaatattatttgaattcaaaaaattattaattgcaatggctattaacagtacaccaccatgaagctcacaaattggttttgaggatgcaaccctggacttgatgtcttccttgccacgtggtatgtaccttgttatttatttcctgcacacattgaaatgaatcatggtaatgccaagtttaaaagacagcaaagaaggttcatcaacaagtagaacagtaatatcagtctttttgcaactagcattgctcaaatcgaactaaatggcccgaggtacagacacaaaccacaagggatggttgattttatcatttcaaggtataacacttcaccgtttcgaattcctccatagacacttaaaattttataaggatatccgtctaggaatcttaccaagggagtttaaaagtatctttccaccatccttgttttgagcaatttgcaacgattttgtccaaccgtgaaatgacctgagaaaatgttggcctgacaataggtgttggatcccaacattcctcaatcaacctgcatacaccatgatactaagaccgttttttaaattaaactgaagcttgaagacataatttaacttcaaaatacactaactctttcaactccggaggataatgttttgttttgatcttgaatgctggtcttttcccttctaagcacatcagtctaactgcctcctccgaggacatgggatggaagggatgtgtaccctctatcatctgggtccataaagataataaataaaatttgttgaatttcaactaatatacaataacatatgaagattagagagataaatttagaaaatctaaatgattttggaaaagctagagttttttttttcatgaaaacagaagtgcatcagtaatcttagggaactacaatgttacataacagacagagaaatgtcaagacaatgttgtcaaattcctcatccttccccctagcccatgcccttctgagcatcaactcatgatctgagctctgtagatttagtgtttaccactaggctaaaaactatagctaatagtttggacataactttttccactatagagcattagcctagacatcactgttcaatataactcaaactcacacgttctgaaggcaagaagctgacccaaagcaataaaaacaagaatctgaaagaaaaacctaattggaaaactaattaatctgatataagaaatcataacatgatgggtgatgcaaaaatctggtacctcgtatataatgagaccaaaagaatatgcatccacacttctatcaaaaacttcatctttgtaaatctccggtgccacgtacaagcctgcaatgaatacagccaaatcattaattgaaccatgaaagatacttttagcaattctaatcttcaaatatttttattagactaacatataataatactataatgcttgtccattttctttacttagtttttcaagtaatgtgcattgaagggctgataagaactggttcagagggaagctaacagaaaagaatcttttattcacaatgaatattggatattacactctcagtgatttcgaggatcactacctccacactctccaaagatcccgacccatcttcctttctgctatttatacattcccaccctttgttagctataactaactaacagttagttacactaactgttttaactactattattattattatctaaaccccctatggtaggtcctctccagctgttgagtaatttgtatttgaatctttaaatcataatggcagattggcagttaatttgtatgtatacttcattcatcattgaaacggaaattcctattgcattcacaaatctaatatgttgaaccagttacaattaaactgaatcttaacacaagaaaatgggacactggaaaacaaaaaaccttcaaataaacttggaaggagacaaaatccaagaatattttttttaaaatacccaaaaacttacttgaaagatcaatgttaggctcaggctgtaccagctttgcttcatcaggtgacattagtgaaaatctcacagtgccaaatccagctatcttcaattgccctccattattcagcaaaatatttctggcaccttaccaaaatttcatatattaaaggaacagtacgagaaaaaatctaattcaaaatgcactcacagtcataaataaacatcaaattgtattaagtgatcttactttggctttaaatcacagtgaataaccggatctggtttgcattcatgaagatagttcatgcccctgctaacaaaaaaatatcaagatgtcttgtataaacaatctggcagaatctccaataaatttataatcatttggtacattgtaagcttagcaagctaagaaaatgaccaaggcgacttttagaaatcaatgaccaaccatataagatataatagaagtaagaaaaggacattaaagtttttcaaagatgatttcacagagatttcgtacagcatagttccttgaaatggttacttgcctggcaatatcaagagcaaaccgtagaacttttgatggagacaaacgccctttcttttgaagatagcttgccaggtcaccctgaaaaatcaacattgatatgagcaaagaaaagtgagttagatacaagaaacttattttgcaaagatacagaagaacatagagggtaagcctaccttagaatggtactcacgcacaatcatcataggtatattctgggtgacagctccaacaaactggaccacattcggatgtcgcaccctttctaataatgtgagttcatgtttgaaagcatttctgtgtgaattattgaaatggtcaaaatttagagccaatgttgagtaattaagtacagaaaaaaaaaaacagctatttagaccataatcaacttgaccagaaatcaaagtgaaaagtagtgatatatgcagtcactcggacaggaaaccagcatcaaacaacccggttgattggcaagaagcatatcatacagacactcacaagtcacaacaaacattttcaattgctaaggtgtatacatacatggtatcaggatttgaataactgtccttgtcaagtatcttcactgcaacctttgtgccattccatttagctacttggtatgttccctgcaaacagattgaccaaagaacaatgaagaactaaacaagcaagtttaaccctaatgtcgaatgtttatagatacattaactcaattcccacaagtatcaacaacttttattatacatgaagcatcagcacattaggtaccaacaattatcactttgctggtattacttgtaataaaccaaaagaacaaaatttaacaggaaaaatgaaagatttggggaaaaatattaaaataaaaataagatagttgccaaaggaagcacggtgcataggtcgcgaaatttggcaaagcaaatatttaatgcacagtagaaaacatcacatgccacattactagtcatgcaaattacattactaaagcaaaatgttacagcacagaatctcaattgaccaatttgaaagcaacaataatgctccctcagagtgagaatagttgtgtcagttgcaagaatcaacatgccttaatttccatgaacaaaacaaataccatgtccaggtggaatccaagttgtctaataagccaaaaaagccataactattgaataaccaatcaaatgtaactaagtgaaagaaagagaaacatacctttgaaataccatcactcttccgaacctgtagctctaacgggttgagttcatattccggaacttcacgaggattcgcaacagtcattggagtcttcctggttttctaaccacgtcaaagataactaatcagtaagtccctaaactgaatccaacatatttacacttacttattgatccataacaaacaaataacgatagaacaataccggcacttttgctccacgagccttcaacatgtaataaatttctgtatttccataatatttggcatcggccgccgcctgcacatccacacatccatcaccacttaacacagaaaatcaaataaattttgcactctcatccgatctcaaagatttgtatgttaaagtttattgatttgtttattgtttacaaattaaactcatcttgataataacaaagtttaattgccaatttgccatgcactttttatattagcaaccaatcaaaggtcagatgaattctttacagtaatcatcataggtatgagtttattgaattttatgtaaactaccttaaaacttaaaaataagttatatctgacataatttttttatcaaatgacaatataaagagtgattattttcacgatgatagtgtcatcgtggatataaacatttttcatcatgagtagaaacactctttaaactttcagcatacagagttgtaaaactaatttctcttttaaataatttttgtaaaaattaacaaaattattatttatgactataacttttttcaataataagataatatatggcgaggagagaggagagagtgaaattacggtgctgccccagcgatcgcgagcgtcgaggttggccttgcggctgagaaggagcctgacgacttcgacgtggccttcgcaggcggcgacgtggagggcggtgcggccgtcgaggtcgatgctgttgacgtcgatgccttcgttgagcaaatcctcaactcccttgacgtcgccgcggcaggccatgaagaggagctgcatggtggagtccaggttctccggcacggtgagctcggcgttgtcggggccggggctgcggcgaatcggatcgagcgaggactggcggccgaagctgaagcgctggttgatccgccgcggatccagcgaggcctgccgcgtgaactgccgcgagaggttcctccgcagcgaacccgacgagaactgccgcgagatgccgcgcttcagctgcgcggcaatgctttccatgccgccgcccagtggagaaggagaaggagaaggaagttgcaacgcaacaaaataaaacttctcacaaatgaaaacaacaaagagcgcgctctacatgttgatatggaaccaaccctgtgcaggttaggttaggttcggttcagttcggttcggttctgttattccaaagagaaaatgaaatgaatcacgcgagggaaacgcgattgcgagaaagaaggcacggatgtctctctctctctttccatcgcttctgaattgccgcaattagacgaggtggtgtgatgcgtccatgtgtaggggtagtttcggttgacttacggggactcctatcattggtttcagagttttttcttctttttttttttctttttctgaaaaaaataataataattagtgccaattatactctgacattataataccccgttatacctgtacgtaaatgcttggacccgaccaatgtagcaaaaactaaaacatttgtaatatttttttttttactctaatctattttataacaaattaatgtatatattaaaataaataaaactttttttttcattttataattgcaaaactagctctcattactaactgtagttaatatgttgttaacttccctacacttttctctatctatcttcaattattatatactagtcgaaagatcgaaatattctgtacttttctatattttttaagatttaaatacatcatgtttttaatttagttgttattataaaaaatatcttgttattttggtttaatatatatactatatatattgcttttttaatctctatcatatttttgttcgttttacattaattccttttaaaaaataagcacacactaaatattattagtaaagctttcaaacagttaattggatcaaatctctatcatattattgtccacttgtttatttttaagctcacactaaatattattagtaatctctatcatattattgtccacttgtttatttttaaacacaatttcaatcctaaactttgaagtcaagcgatgcatgtgtgatatttttcagtaagattttaagtttaaattttatctactacataaaacctttaactagagagttgactcaaatgttgtagatcatatttctaactcaatgacccacgcagtttgactcattcaaactatttttcagtatttttaaataattcgatcagttcgtatatagataatatataatataataataatacatgcaattacagtgtaaagatacttcactctattattcaatcacatgataattatatttgataaatttattattttttaatataattaccttaaaattcatactataaatgattttaatcagttaaaaatatacacacttttacactgaccatgtaaactaaactccataaataatatattttttggtaatttttaaatattaaaataatttatagaatttaattaaaatgactaataatatnnnnnnnnnncatgcaattacagtgtaaagaaactttactctattattcaatcacatgataattatatttgataaatttattaatttttaatataattaccttaaaattcatactataaatgtttttaatcagttaaaaatatacacacttttacactgactatatatgtaaactaaactccataaataatatactttttggtaatttttaaatattaaaataatttatagaatttaattaaaatgactaataatatattaatatggagatgttttacatttcatttaattatacatttttctgaatctgttgattttataaaattattttaaaaaatatatttaaagtaatttctaattaattgataaagcactaacatgaaaattaaactgtaatttaaattcaaaattaacttgctgcaaatataacaataagtctctaataaaactataactaaacaaactttcaaacttaaagtgaaagagttcatcacaaataatgctgattaggcatattagttacaaatgactcgtatataagccaaaaaaaacattcttatatttaggcatggcaacagggtgggtattgcgttctctatccccgcctttgactcaaaaaccactccccaatctcgccctcaatttccgtcagattttaaaatccatctccatctctgtcctcggtatttgattaaaattaaaaaaatatagcttttttattgaaaagattggatgaaaaggctaattacttaaaaaaaaaataacaaactcacattaaaaatatggaatcataatttagaaattgcaaaacataatcaatcaattcaattaaaaaattacaaaataatatatctttttttatttttttaacattatttgttacgaggcgggtgtgggtgctgggcggataccaataatctcatatccgcccccgcttttggctatttgggggaaactcgaacccgaatttgatagactcgattttttcccgttaaaatcaggacagattcgagtgggtatccacggattcgagtcccactgccatgcctaattatatgttgaacttaaataaaagtaaatttaaataattttatcttatttaatattatcattcttaaaatactctttaattaattctaattataatttcagtgactttttttattcatgataacaaagtccaaagaataacattttagaaataactttatttttatatgagattaggaaaattaaggatgtcaactaaaatttttaattagtataaaattagttatttttgtttatatacaaattcaaaggaagtaccttgttgccataatcaatttaaaaaaatcaattataaaacgtatcttttatagtttaattggaaatgtctcataattttttttaatttaagtaaaagttataaataaaaattaaggaaatttataaatagtttttatactaataatatatttttactttatagaataagtaaagtacagaatttagaaaaataaattatttaaatcaagacacgttttctttatcgatgtagtgtgttaaattcaaaattttaaaatcaaatttagattaagatggaaaaatcttaaatttaagtttgcaaaaaaataattatatgttgacagtgtaaaattttttatcatatagtttataatatagaaagggattatattattcaccttcttataataataataataataataatttttattaaaataagtaaaaaaatatataaagcaatttagacaaacaaactacaaaaaaagtttcttattttattaaaataaatgcttagtcaataaataaatttaatcaaatttatcatatactttgtaatataggaatggattatattattcaccttcttataataataataattatgatgatgatgcttttgctttaaatgtttttattatggtctaatttggtgttttgaaagaaaaaaattaaaaatgtgaatttgatacaatgctagctagtactaattaacgtattattttttattaactatatttttaatccctcaaattaggtcactttagttttggtgtcgtaaatttgaattttattttttttagtctttaaattttgaaaaattatttttttggtctctttcacagtaaaaagaacatgtcacaaaccataccttcaaactgtaaaaataatgcagaaaggtctaaaaagttaatttttcaaattgagagacagtaagagataaataaaaattgaaccaaaattaaaaataatataattttaaataactaaactaactaactgtttctctttggatagctccacatgaaactgtcctcttacaagttttcctaaggaataagcctgtactcaagatattttgatgcacaaggccatagcaatttacaagtacatggaattaattggctacccaaagatgaaactaatgaaatcgaaatgtctccatggggtcagcgacgacttcataattaagtacgaattgtgtcgcctctgattagattacatgtgcaaaaatacaattatgtcggcttggaccaacgtgtgtttaaaaataataattactacatgttgataattctggtatacttagtttgtttttttgtttttaattgcatcttggtgacctatgtctttggaattggaatacttgttaaggaattcaatttttaatgaaaaaaatgttttttttattccttcaccatttgctttttttttttctgtcaacaaaaaaaaacagccatttgcttcttcttttttattccattgttcacttatttttgttttctattcttttattacatcatttattttatatgtgactatctttcttttttttttctacctcttttcattacatctgctctagtacttaaggtatctcacaattaaaaatttaagaatactgatctcttaagttgcaaaaaggttaaattagtttatcactattctaatttatttttaggtttgattttgtcttttaatttttttaaatttattttgatcttttaatttttaaaattaattaaatttaatttggctatctaaattaggtcaatataataacaaatcataatttgtgataacttaaaatcaagatcaaatttgaatgatatgatcactcaaattattttagatagtagtatctaattaataactaaattgaaaaaaaaaatgagaggattaaatggaaccaatttttaaaattaaatgatcaaattgaattaaaaaataaataaaagaccaaatcaaaagttaaaaataaatcaaaggaaaaaaaaaaaagctaatttaaccttaaaaaaatcatttaagtaacttttttcccaatatatacacgaaccttaaaaccaatttttaactacgcatgcaatacctcaaaatgaggcctacatattaatcacttctcacctaaaaaatggaaagataaccacacgatagtccttgtaggccaccgcatactaaagcattaaagagattgaaggtttcctttcttttttgcaagagacaagaagatggacacctatgcaaatgtcattttgtgcgagtatcacatgatcgactcattttttgtgataaaataatatatttagtagtcactctatttataattttgtctttcttatgtctttttttttattaattttctatttgcctcgtctataaatgtttatgcgtgtctcttaagaatggnnnnnnnnnnnnnnnnnnnnnnnnnnnnnnnnnnnnnnnnnnnnnnnnnnnnnnnnnnnnataagttacaaacttttagtatttaaaaagactaaaggtatggattgaattgagattttataagatttcaaaatactttttgttataacaaagctttgcgtatctaataatcttttaaaataatataaacaagtattgtagtataccggtacttaatcacgataaaaataatttattgaaatatcaaaattggtgatatttaattgacacttttataatttaaaaagaagtcttctagtattaaaaaccatataaattttaatggattttgtatactttttttagtgatatataaatgtcacatttgtccaacaatcacattcaaattcctaagtctttttgtcattgccatattttattttctttaatcacaattttttttccttgaaggtggtataaaatattggtacaatatttgatcatttattttttcccaatagtaaaaaaaactttctactatttttgtctttaatcaacttgtttggatgaattaaatgaatgtatcaccaaaaaagataatgtaaaaaatatataaagatttttggatacttgaactttttggttgcttgatcaaaacaacactgacaatcttttactttgtaggaagtatattatgaatcgattcatttataaaaagagaaatattaactccaacaaaattaaagttgctacttttgacacgcacagtatttgaaatttggactagtttctctttccatttggagagcaacttggtaggttgcatttcaaaagtgagttgtcaattgcaacaccggtttctcttacagtgcagtggaccctttgcattatattttattaaataaatgaaaagttgtgtctttaaaatattgtgggattcattttgagaatctttagtgaattttttgattgagtaaattttgattggattgtttagagtaagaaaataaaaaatatgatgtgatattatagagaatggtgaaatattattttaaaaaatagaagctaaattttgatggatttgttggttaaaaatgttctaatggtagaaagttttttcttgcatttattttaatgtgcatgtcagtggataatgtcagaaccatattgacacacttttttaaatactttatgtaattaattgaaatttattaaaaattacaaaaaattaatgaatctcacattttatttaatttaatgattctcacttaaaatgtattgctaacatcctcttataaaaatattttcccgttgtgttctttttttttttaaatgcaatcacgttgttgtgaatcaccattgtggttgtgcatggcaatttaaaaacattgcaatgaatagtatattcaggataatcatttctcagcccttagtgtcatagtggttgttaaaagatgactttatactcacattggtttttgcaatctgagaatccaacttcaaggtaaactgtttgaagacacggttccatggtatagcaattccatggaaaattgcccaaagttcagcatacagagcaaaaaccaatattagaggcataggaaaacactacagtacctaaacactcctcccacacccacagcatctttcgtccttcagataagcgtcataattcagcttaaaatgacccgtggaaggatgaatataccgaatgaaaatgaaaatatacatacgatattggattatgctataaggtgatcatagaagaaaattgttaaatatatttaatatatatatatatatatatattaaatattaatatgtttactgttcaacattccacattatatctaatagcgtaatactgtttaacactcaatacgaaacccttctcttttaaccccttttaccttcaacaaaaatgaccagaaggatgaatatacccaatgaaaaggaaaatgtaacatctcactccaacaactttgaataggggactcgctcacgttgctacaaaatttccgacaaccccctgctttgaatctacggtgaccaggaagagcatgatgtagggttagagtttaatttttatttccacgttacatcatttattataaatataactggggatggggttgtaatttttactttaaagcacttaaaaggtattcaaaagaatttttacgaaatttattcgaacttacaaaaataacttgcgattcttataaagtagtatttttaacttattttgataacttaataattaaatttgggaacggatacacttattttagaaatatgtttttgacactcatattatacttaaaattaaaactaaattgtaaaataataatattttatttttataaaaaattatgaagttgttttactataaataaattctcaattcaacacttgaattaagaatttcaatctttataaataaaataagttaatcaaaatgctggaaatgattattaggagaatcatattcaatttttttgtaagtataattttttagttaataacaatcacgtaataaaaatcaattaatttctgatctaatagataatttgaggctcatgtttttttgcttaaaaaaacaaaacaagttaaacttcctcgtaaatcatttcccattataaaattgacataattgaagcttaataaacattatcaatttgaaataatagtagtaacaaacgatctttttctaacattacaaaaaaaaaaacgaaataaaaatcgccgcagtgcagtgaaagcagtagtagaagaagaaaacacgagttacgcacaaagacacacactcccggtgccgccaccaccaccattgctttcagtctccgaatggcaaccactctaactccaattcaaaccctcaaattccgttctcccaatcccaaacctctcttctctcccaaacctccttccatctccacacctcacaccttccgcgccgataaactcactctctccgtctccgccgccacctcctccgccaatggtcctccctctcccccctcccccgctcgctcaaagcacgtcctcctattccattccctttcactcctctgcgtccgattagttactgttctgttctgttcctattcattactaattgatgattattattgacaatgcagggttcgtcgacacacgatttccgtgttcgtcggcgatgagagcggaatgataaaccggattgccggcgtgttcgcgaggagaggatacaacatcgagtccctcgctgttggcctcaatgaggacagggcgctcttcaccatcgtcgtgtcagggaccgataaggtgctgcgccaagtcatggagcagcttcagaaactcgtcaatgtcttaaaggttcaccgtctttttcgtgacataccaattccgtataactatcgtttttattgtgtgtttttgtgagatgccatgtggagaaagtgtttgatagtgaaattagtgagagaatgaatctgaaggaaacttgttgcttatgctggctaggttgaggatctttcgagggaaccacaggtggaacgtgaactgatgctcataaaagtgcatgcggatccgaaacaccatgcggaggtacctgcttagtggtttgtggttgttgtatatgtatgcatctgttatgttgtgtgtgtgtcttattttgttgattgcttctatttgtttatttatttgtttctgctggaatattctcagttgaagtggttggtggacatcttcagagctaagattgtggatatctccgaacattcggtgacaattgaggttattgctggacacctttaaatatgttttaatttttaatttccatgttttagtgcatgctctgtattcatatgtactcaaatcaattggattgtatttgtaaagtggagaaaaatatcattgttgtttcattaagataattatttactattggaggtgaattgtgttatgagagtatggtacagtgccttgtaaacagctcatcttgggaatatactacatgtattcatatactcttcctttcattgcataaaataataatggtgtagttacgaaactaaggttggagtatgactatactgtggttgacttgttggactggctgtttttatgttattttgttcttgataggagtctttcatttttacataaaataggattttgctcatctttaaataatatcaggaataaatagtgtgatctttttatttctagtcaattattcgaaactgtttggaaggaacagtaatcctttacattagttaatgcgacaatagggtggtagtgtttcttcttttgatatcaattactcaataatgccaagattggtatacaaaacttctttcaggaacataacaactttgatactagcgtcagtgttacttatttggcaaagggatcagaagttgccaattaatgtacacccataaagattgaatgctggactcatcccagaagaaacctagcgaaacagaataatccgttacattagttaaaacacaattgctccacggaattacatatatttaatggtttcataacctctgttgcacatggtataaaataaagctactactcacgaaacagactttaattcggtgtatttcatatttacactaggttcattgaataatcaaaccagcagaccctttgcatttttctattatgattgagatttctggtcaatataataatcaggacactgcataataccaagcagcaggttgagagtcccttttgtgcatatagtctataatatattttattaaaactatgaagcttccaccatataatgctgagcattgtcatgtgactgatagatggaacagaatttgatgaattattagctttgaagaaattacttagctgaaatgataaatgagagagagaaaaacctttttcccttgtgttagagaaagtcggatgtgtgaattgtcaaacatgccattcctaattagagttctgaaaattgcttccttaatctgcaattttttgaacaacattcattatgatgataacctaaacaagactgaagacagcagcatttagtacttggctttttacagaaaaacagtaccatatgacaaacatgctagatgaactgaatgcatcttagactcacctcatctcgagtaggaacattttcaaaagctaaagcttttgctgaatcaaacaacctaacaagaagcaagaaatctaagaggacattaagtcaacaacattgatgatgagaagatgttttagaaataaaacatattattagtataaaatatatggcctttagctttagttttaatctaacaaaaaatgtaaaaccaccacacgtaactgaagaacattcccactcttaaatcaagaattgatgagaagacactaagaatttcccaaggaaaaaagttgttttattaattttatatttgtaataatttaactttttagttaaattgaacaatgtgcagtataaaagcttggaaaaattaggaatacgttgggtcagataattctcatgtatttcttatagttgtcatctatactcttgaggcaatcggtaacctggcatgactattttatcagcaaacattttgccagtcttcggcataacatgccaatgcatagtcaggttatattctttgccacgcaaattgctcccctggacatgaaaaaatatacaaaattgaggcctaaagaaatctgaagcaaatcatattagtcacaaagtcctccgagagttgtatacctggttgatgaagcggtatttatttgatgtatgaatccaaaactttgcatgttctttagagggaatgataccatcccatagggatatctgtaaaatggcatttcaagcacctaagcaacatacatacatacacaacatataccaaagatggaatagatgcagcattatatgcattaaggcacagctatctgagtgatatgaatagtataaaaaaactcagaactctggagcaactgcctcacccatgaaaattcaagatccactaacacacatactatggcttccttttattctttcctttgtaaaaacgagccggcaaacttacaatttaaatgttcatatttcaacagtaaatgcaaacaaactaatcaattcatacctgattcaaggaattcttaggagtttcatactcagcagctagaaaaacaaaaacctgcaaccatacaaaatgacacaaaactaagtcccaggacagcacggaaatttctagcttccaaacagtttaaaaagataattcttggtgataaaatcaggttgtaatcttgggtgaattgttctgctaatgttacaggtaactggagatccagggaagatggccgcggttcaaagaaatttcagcaagtttggaattaaagaaatagccagaactggaaaggttggaaagttcaattgaatacccaacaaatttccttaacttttgtatcttgtccattttgttgagcattatattgtaaggctgtgcaaaatttactaattcgttattattggatgatgtaactatacttagattgcattaagaagggaaaagatgggtgcatctgctccattttggcggtattcagctgcttcttatccagatcttgaaagaagaacacctgttaatgcccttgtgggagcgaaaaatatgaaacctgttgccaaacctgatacacctgtgggggtatgatcttatttcctcttcaactctactgtttcctttctaaacctatgtttgaacacttcaacttgaaaatttaaatgttgtagcttgaaattaaataattggcatatcctatcaaaagtgttaaatttagaaatcacaaacaagcttagtttcctgaagtaaaattatgctagacaaatattgcaaaatggttttaacacttatgtatatctcaaacactattgatattacagctaaaggtcttttctattgaacatcttttgtccatgtgctttggaatatattcttgttacatttatgttgtctttgactctttccttaacatcaattgttctaatttttaagtttatagaatttcaatgattggctaaagaagaacaaatcagtaactattgcaaagaatgaagctaatgctgatataaatgcactccatcactacatgtttgatattttccctcccttctgttctttgatttgtttgctcattattaatttcaaatatagtctgaccgtttcttttgacatgtttgcttgtgtgaagggagatgtttatcctatagaaccatcagatggttttacagtcaatcaagttcttgacgctcactggggtgtcctcaatgatgaagatgtaagtggtttgtagttgcttattgtccttaaatgtatccctttttcttgtttcgttctaatacattgtagatatatgtacattatcttcattagtttctatttgagtttttggttacatatttgaatatatttgttagaaagtatatggaaatatcctataatattttattgagaataacctctcttggtaatagtttcccaacttccttattacctcataggattagttaccatatttctttattttatcataatatgtttccttaattgattatgattatgattaatataaataaggcttagtacttttaggtttatgaacatgtcaacacatcaatacattataatacatctcagttactatcaaccagtgcttcattctcttttatctttcttcctcccttaatacctaaagccccataatcaaacatggtattagagagggtaccgttctccctcttctgtgccttcactactatgtttattgtatgttagcatgtaatattcatcaattttctgaatgacatgcttgtgactgtcttactgttggtgggataattccttcagactagtggaattcgatcacacactttatccatgcttgtgaacgatgctcctggagttctaaacattgttacaggagtttttgctagaagaggctataacattcaggtttcctttttattttattttataatatttgtgtacaaattgcaagcacataagtccaatgttttcggtttctctgttttctcatcttgaatctgctttgttattttcagagtttagctgtaggacatgcagaagttgaaggactttctcgacttacaactgtggttcctgggacagatgagtcaatttgcaagttggtgcagcaactgtataagctagtagagctacatgaggttcaaaatctctttgaaaaagaatgcatcatatcctatacacaaattatttgctttgagtaatatatatttttagtgttgctgtttgcattgtcctgcagcactttgagtgcctgtttaagttttttttggagaaatattctcatacttttgccagttccctgagagaagtttaaaataaaaatgcttctgaaaaaaaaaaaaaactattcccaaacacctactaagtgcagatctcccatcagtgtcctagtggatacagaatttgacatatcaggtttagccaaacatgtgaccctctacaatgtcacccaactaattttttttttttttttttttttttttnnnnnnnngaaaaggctaatgcttgattagcctgaaactgtaattccgtggtatgatcctattatattgtaaaatcagcagtgtgttctaaattgcagctacagtaaggatttaggtgtattaggttaaggaagtcgtcaaagttgttaggttatttctttaagctaccgatttcaacattgagtatgtaatccttgaaatcttcattgatcatagtgaccttcccccttgtttttgcccatggacgttagcctatagtttactgtacaaaccacattaaattcctttctttttttgtttgtgcaccttgacatgactactagcacaggacatttgtcttgaaagcctttgttgggacttaaatattagcagattttgtgtttcctaatattatgtgaataataaaaagagtattctgaaacttgagatcttgcactggtcttatttttagaatctttactagtttttggaatctttagtatagttccagaattcctatcgaaaaacattctatcaaattattacttgaagcataaatccttatcttcgtatcttctgtttctttcttatgtattttacctttgagaatgagattgatatagagtgcataaatatttgaccatttttaatgtttaaaaaatctggctattgcattcttttctgtatttaaactgatatttcttcaggttcgtgatatcacccacttgccatttgctgagcgagaattgatgctaataaagattgctgtaaatgctgctgcacggcgtgatgtccttgatattgctagcattttccgggctaaagctgtagatgtatctgatcacacaataactctggaggtgaattttatgcagacttttcaaccaagtgatatggcatcatatttaatgtcaacttatattgatactcataaacatggtggatactggatacctctactgtggagagaatgttgaatttagtgactatagtgtaattacaaattgcactaaaaccaattttgtttagctaaatgttacattgttactgtgctacaagttcataggattctgcatttttaccagtttaatatctgttggatcatgcatcaagttttgttctaacagccaacgaaaccaccacaaattgggcagggtactagagccccaactggtcctcagtttatcataaagattttttctcggtcatgaaaatagataacattaagctatttatccagcatcctaacattctaagaatcctgttatgcccattgtctgcagctttccacgtccatttttttcattgacatgataagctatcagcaatagaattgcttttcttctcatgttaacaaatataattgtagatttaaataagaattgtaccctaacctttgtaagtaactttatttattcttcttccacattaattaatattaaatacaaaagtggggcactgaaatgacatttttcctcaaaaagtgtaatgtagtagaagttaacaactgatgacactgtattggtgcaaacttctcagcttttcttccaagtcattatttcttccttccaactaggcctatggttattaaaacaacaggctactgcttttttcttaataaggttatgctgatgacaaaaaattggaaatttgattttcatatttatttatttgcttcaaattatttgctagttttgaaatgtctgccatgatgacgtctgatttacagatcctttattattttcgatttttaactaattgatatgcttttgaaccagcttactggagatttggacaagatggttgcattgcagagattgttagaaccatatggcatttgtgaggtatgttttataaatttttttcacttaccatagtagatattttgctgagacagtggacttgtttaaattccttattccataaacttccagagtcgaatttggtgcatttacttcctcaaatgtatctcctgattctgtccaagattgtttactcagttgctattattttgttctgaggttttcctttgttttatgggtcagaatattcatactggaggaaagaactcagttttgctggtcttggctaagatgtccttgttttcttttgaagctctgtagaggataagaataggatgagccccctacacaggcagttagctgagtcattcttacacgtcgatgttcattttttattatctacaaaacacaccagtagccattattttaaaaaccaaattagggagtataacagtcaaagaagagggttaagaattgcgtttcaaacagaatttggagtacatgtattttattaaaatataaaaataacaaaatacatcagaaaaaatgaaaaatataccacaatgaataaatataaatttataaatattaaaatttagttttttgaataatttttcactatatatgaaatttggaaaatccttctcaaagtataaacgagtttctctgtagaacaagcagaggcgtattcacctttaaattttactatattatgatcatgatgcactttaaattcaatcaaagagtgaatattctggcaaatgtttactttgaaccttttccttaacattttgcttccttttagcaaaaggaaaaacaagctggccaccgtgcatgctatacttggtttggttctcttagtgtgctgtgcttcatcctaaaggttcaagattcaaattccattaggaacaagtgggatgtgatactcttatcctctaatggactaaagaaaagactgttaaacacagtcatttaccaaacctgtgctggatcaacactcaacagtttagtgctgaaccggccagttgtcaccagttcaaggctagtgcagttctaacatgtaatcggacacaactggctggttcagtcttgttttaagactatggtttttgctcatgctcctattgcaccggcactctttactttgaattcagtctttctgatgtttcttattgtttcaggtggcacgaacagggcgaattgctctagtccgtgagtccggtgtggactccaagtacttgcgtggatactcttatcctttgtaatcactttcacctgagtggaagaaccatcaaagtcttaggattttagagcttgtactttctcttaaactttgcctacggattcttgctttctgaactataatgttaagtctttcagtgatttgcaaatgtaggcttgggatgacattgagattaaaaaaaaaagttttcctccttctctcaactttgcttcattttttggttgaattacagtctactgttttgtgtagggacaaattttttacatgtcaaaatatttatgtttcgtacttggatgttgtctgttcaaaattaaattccttatattaatgctatcgagtcctatgttgtatgcattaggacattaattttattgcttatgcaattgtgatgtttttaaacatatcagtaatattttctcgtattgatttcttatgtttttcgatgaagaataattgtcttatgataataccaagttattaacattgtgttatttatatctatcaatacaaataatggaaggttccaaaatagtcgatgtattattaccaagagtaataaaaattattaattgatagtgcaggattttatgaaactaattgaaaactcacttcgacattcattgattgagtcaacaattttttttcagagtttttaatgtgcttttattcataaggtcttttaatgtatattgagtcaaatattagattttgtgtgataatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacaaaattcataaaatgaaaaaatttataattaagcctaatataaatattaggtgttaagttaaccaatgaactaaaatatgatcaaaagtgaagagataaaatttgcaaaaataatgataataacagacaaaatgcaatcaagtcaaattaaaaatgtaattataataaaataatgattaaataataaagttaacagtacacatttttactaaaaagtataatttaaccctttaatgtttgttattttaatattattagtcttaaataatctttttggctaataattaagttttaattattattttagtcttttaagattttaaatttaattttagtatctactatcaagaaagtaacaacattaattcatacataataaaattaaaataaaatccattgacttatcacatcacaagacaattatgtaattttgttatattaacgtttttaaatcctggtgagtttatcatcatttaacactactacttaatagaaactaaaaaaattattcaaaaaattaaaatcaaaacaaaaatattttaaatgactaaaatcaaaacctctttttataaagactataaggttatttaagccttcttgttatttataattttttacatatttgaattaaaatgaagattaataccaacccatatgaatttcaactaacgaaagataaaagtttccaaacacaaattgccagggggatgaaatggttggagagacgtgcaattaacatttaacaacatgaaaataacactacattaccaaactaaaaccactgcagcagaaggcaatgtatgaacacacaacagagcttctagacgggaaaaagttcccccgccacacaaatcttgtcttaaaaaaagaaaatatttattataaacgttaataacattcgttgtaagtccatcattacggaacccatcagcaacagatcatcaccgagttttctttactcttctgcagcactagcagcactaagatccacactgaggtcaataacctgttcaacattaggagtacaagaatcagcatgttacccaattaccaagaaagttatccagggaatatcatcaatcgtttttcaagatttcccatgcccaaacaggttgctagtccacccataaggtttctgattactcaatggtattaatacaatagcaacaaatacaaaatcaactagaatgttcaatatttttcattcaccgccattcttcaatcaaattattaacgagtctacacttagtttatttataagaatcagaattcacgaaaagcaagcaaccgattttggaatatataaattttcatattaagaaaaatgattggttaaagaataataaaagatcattttattaataaattacatcactgaaactgctaaccatcaaatttccagtgaggcatccattgtataaggaatagaaagatgagaaataaatttaaaattcattgtataactctacaaaacgacaattagatatccaactcattctaaaatgatcaattaaaatttatcttagccattttagcttttgggagtggggaagaagagaatctaaggatatttttaatttgagaaaatgttctgttttcatttcttattttcacttttaattacaaaaatgtcacttttaatctaaggattcctacagtatgtagacttataaatatgtgatacaatattataaaatacagtactattgtagaacaatctcagtcactatttgtggctcacaaattaattcaagaagtggaaacaagtggtaaccaaggcataacacttacctttccagttatcaatgtatacatgttgagaacgtcatccacagtcgactcaaagtgagtagtagcatcataactctgtcaaaaagttttaaatgcggtattgtcaacctatcaacatatggcaaaaatattaataccaccgagtaaactcactgttgatataaagcagttgtccaaagtgggttcgttgaccggttcatatctgtcatagatatcaaaaaatatctcatcaacaggtcctagaaggtcaattccaggttttagttcaattgccggctgatctgtctctgcctcggttgatacaaatgcaataaattttccttttggagcaacattgtgagtatacgaacaacaaaataggtacctgaccaggagaacagaatagagcattcaatttaaagaggaatacacaatttacaattgattggacatcgcatgcacaaaatattagtaattttttcaagttttaaacatcaaatcatcttagaaattttagtataccttctgtattggggatgattacaaaattaacagtcctaaccagatcatgagtttcatggtattgtttactatgtttaataagaagagtttaaaatcatacatttataattagtatagctgaaaaaggacgaaaagaaaaccaaaggacaacatgacgggagattgatattgatatgtaaaacataacacatacctaatggtcatttatactaataggtctaggtcaatttagtagttaataatgcaatacaaatagtataaccctgggtccctggcccaataggactgttaagatcatgagactccgaacatagaatccaaatattctaaaactccgtaagctaaagcttgttaagctttataaataaattagaagcatacttgtatttttcacttgtcagcttgacagctcagtgattttatctgtatcattaaatttttgaaattctcttattagcaatttctaaaataaatgaaatagaagcaaacttatttcatgctggaaccatttgataattcagatgagactgaacaatttagcttcagtcaagaaaccactgcccacgctaattaatggtcccagtagcacgatatatattgtatcggtattgcaaaattttctacaaatttaactatatagatatatgtatatttaatatggtgcatgtaaacttacatgtctgacttccgacccaactgtttctgtggtaaaataatttgcaccgaatgggaatcatcagtgctggggattgggtggctcatgatggctattgcccttgcaaccctaccaaccttcctcacctgttgaaatgattacaattttgttttaaagaaggacgcaggttcccatcaagagtcatttaagcaattaatatcagttcacctttcgccaataatttttttatcaacagtagttaaacatccttcagaaacaaaactatttacatagcattactcctagactttagaaggaagcaattattcactttcaccatcatctgaactggttgcaaataatcaaactacaggttggtttctaataccttgccggccaaatatgatggatcacaaacaacttttttgcactttgcagtctccccttcagatgtgacaccaacaacctttccttcctcatcaaactctacctggcattcaagcaaaaaattaaaaatccacaagagtgtatatcagcatacagttcaaacttcaaaacaaatcaaaatcacatggcaattatagtacaaaaatagggatggaaataaacacaagttcaataatttaagaaggtatatatattgggttaggatatactgacagtggtgtatatcaaattcacaatcaattatacaccaatgaataaatttttcaaagttagccttaattcatgcaattaatacatttttcaaagaaactaaaacatcaactacttgatgaccaattgacagcatgattttattcaaattttcaaaaatacgacattcaagatctaaataataattatagttcgaagactggattaataaaaaaaatcctattgaagttgtaattatgcaagtgtgccaagtcttacactagtgtcaattgagagatataaacagagaaatgtgtgtatgtatgtataatagagtatataccttgcactcaggcttattcaacatatatgttccaccgtaaacagcactaagccgtgcaaatgcctgaagaaaaaaaaaataattaacgaaccttgagcaaaacaaactccaacagtatattccagaaaagagatgaagcagatgggtagacatgtggagagtgagatacctggggaagctctcctaaaccatacaaaggatatatgtacggtgaccctccttgaaagcgtgcaagagactctgcatataactacaagtaggaaacatacacatgaatattaaatagggaaacacaataaagctaatgggaaccaaatggaacagaagaaattttcaattaagaagaatccacgactgagcatgaattacaagtgcatgataacccagtaaacttaccttcattctcttcacagtgtccagtgctggctcagccaagtagcgatcatccctatgaagcgccaaagcatgaccaatgaagtctatagtgttatcatcaaggccgtattttctgtcacacgtcaacaaaaaaagcaaaagaatcttcaaaatactcctttttcttctcattagtcagtacagggatcaagagatatagggaaatgtatgatcatcatggaatgcaaaataaatttgacgtgtaactacattatatatttacatacaaaaaatgccaaataagagtaaataatcaaatgctaagaatttgaactaataaatacatattgactccctatacaatataagaactacagaacagaccataaaccatacacttacattttactaccaactttacatgactgactcatgtagcagttcagacaaatccattatatataaaacacaaatataaataaatcaaaatttcatgacattattgataaggacagggaaaagggcaaggtaattactcctaaaccaatttctacatgtttatgcagactatgaaggcaacacagatgctgagcctgagatgttaaatctgcataaataatggacacggcaagaaaacaagtgcacacatacgctatcaactctttagtagtcactcttgtcaagtccatcccctcgtgggtcttgggatcactctcattgtagttttgcacataaatgaaaaacttgcgtgcacggcgtttttcaaatagccccataagtggggacttcaatgcctccatgtcgtttgcaggcaccttatgaacctgtaccaaccccacaagcaaaaaaaaatttaaaacatctaaaccaaaagaaacctcccattaagatagacgagcaacactaacacaaacatacctttcctttattaaacacatagctcccatccacagctttgaaatagagatacttggtaacatcggtatgaatgagaacccgcaccaaattgccattagccataataaactagaagaaaacaaatcatgaaataataatgttgcacaaattgagaatcatatcatatgcatccagatttagtatagcaaaatataataaaataaaaaacaaataaataaattataagaccttagggttcatatcgatgttgtagtccctgctagcgcccaaatgtggaggaggcttgtcatctcccctgaatctcttccaaagctgaagaggaggacagagaaaatcatcatttcgcagttcaaacttcgataataacatattcttaatctaatattattatttttgcagaaaatgaaaataataaagaaattattaaaaaaaaacctgaataagattgagcgaagtggactctcctccgtaatagtcattcctatccatatgcagaacctgaatcgaacaagaaatagctattagcatgcgaggattggatcgattgagaagaaaagaaaaacgaaagtgatgaatggaaatagtaccttgaggccatcgacggagagaagcccgctgagaatgcactccttgagacccgtgcccaacacgatcacatcgtactcctcatccatgttcgatcgatctcgatctcgccgaaaacggggtttagggtttccgaaatgagaaagaacagcgatggatagacagaacaacacaacacaaaagtgtgatttgattggtacgagagagaagagacaagatgggaacaaccgcaggaacaagtaaagaaccggatctagggccttgacctgcacagcactccacactttaaaaaaataaaagaataatagtaataattaatcgctaatgtaatgaaatgatatcgcgcgacactttcctcatccctgttactgttattatcaccgtgcccctcaatttcgccatgataaatacagtatctattttagtgcctaagaaggcgttccatacggggagaaatttttgatatagttgaaaattagcacaactccaatgctaagagtttatatgggttttttattgagttttgatggatactttttctaagatatagtttcttatataagaaactctacttaaatttaagcactccaaaagagaaaaaaagttaaaaaatgatgtcaaatcaactaagaaattctcctaaaatactgagttggagatggtattatgattttagaaaatcatgaatcctcaaatatttatttataagagtttataacaaatcttaattttttcatccaaaataaacaaatcatgtgatttttttccatattcgatttaactttttgaacataataaattacaaagcaaaatataatactagttataaaaaaaacagcattagcaagttatgagaatacacgttagatgatatgtgcagaaataaaagatttctggttgagtctcaattttataataattactttcatgcataaattttaatagataagataagtttcatataaatcaatttgtcattcctcaataatcaaaatctcccaacacgtttgccagcaagtgtaattaagtttgtagatctttagtatggaaacaaatccttatttgaccagtgataatgattatatttgtattaataatgaaaaaattgaataaaacataatgagtgtcatacacaattacatataaaaaagatatagtcaccatgagtcaaaatgtatgtgttcataatatataacaaatataaataataataaaaaattactgagaagcatgagaaaggagaagccacttatacataacaatattattaaatattattaaaggttacaaaatgttgtacataaatgtttatattgtcttaaaaacaaagagaaaaaattatgagtaatagaagaaaagaaatcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaagaatattaccttcaagataaaaaaaaaaacattttaaaaatctcccaattttaatctaaacatgcacttataagatcaatatcctaagggctgcattttagaagtttaagttgaatatcaactttttattttgacacataaaacatcaaccccataattgtcttgatcgaaatttgttagatggtttgaactttaaattttgtttaggacaatagttatttgtattattaaatatgtaaagtgttgataaatctattaattaaaatatgaaaatttaaattttagttattaaaaatgaaaaaaaatgtgataaatttatcaatttgttaattcatgtactttaccgttaataaaagaacgtacatgacacataagaactaaaatgtctcaaaaattattaccaactcaactatggaatagataaaaccaaaatgttagtaagttttcacttgatcaatttgtcatattccaaatttcgtaatatatcttatgcttttaagtttttaatgagacttaaataaaaatgcaaaattattaagtcaatccttaaaaaatgagatccaacttctttttttttttcactatataatgttgtcacaatatttaaacactgaatcatggcaaatttttcaatcacaaaaggggcgaaaataaaaattaaattatatttttcctttaaattaaacgaaattgaagtatgaaaaattagtctaatagaaacttattgatattttggtctaatgaaaacttactgacattttgatccaatagaaacttattgatattttgattcaatctattcagcaattatgttgacaatcatttttgtgacatttttgtttttctatgtcacgcagactcttcattaacggtaacttacgaaggtcaacatatggatgaatttgtcatacttttttcactttgaaaattttaaattttaaatttttatcttttgaagatgaatttgtcagcactttatatatttaataacaaaaataactatttacttttagcttatttaacttaacttaatcatagctcattctagacttaaacctacaaaatctagttgaaatataatgatttatttgaaatatattacggggaatagagtcataattatctaaaatatatttacaagtttcctaatgctagtcatatcttatgaaaaaaaaaatgttagtgtttccatggaaagaaagcaaatgagtccccttataattactccactttgacctaaaaaatgtcaagaaaagtgaatcttcgttgttttcgagcatgaataattgttgttgaatactttaacaagaactcacattaaaaaggaaaaagaaccaaaaaaaaaaatgcttaagatactataaaaattctaatgctaaaaacgacaaccaaatatatggatggcatgataataaaaatcaattctaataattaaaatacaacttgtatggccattcgtagtagtaaatcacaatcaagagatgtaaaatccaccaaaattttatccagtaaaatacatgaaaatgcaagtcatgtgagacatctccatgtagaataactaatacatatcgaagcaacgatcaagataacatgttcttatccaacaacccaaatcataatgcaatttttttgtaacctcgtataacgcataatacaattgtatcataacactttaccactaatcctgagagttgttacgagaggtttcaattactattacacaacaaatgaacctttgttcacacgtagtgttttgtacaatgcatcctcaatgtctctcaatttatcctactttttccatcttataataaatgtcgtgtaaaaaaaagttttaaaataactattattttaattatttaatgtaatattaatcacttctttctattaatatttttaataaatgtcattttagtttttcaatataatattaatatttacactcaaatttaatttatttatgcatattttttaattggtctaggtaattagttagttagtttttagtttaataaaaagtgaatacattgaaaatttaaaaaaattaagaaaaaaaaaccataacgatagatatggtaacaaattttgatggtttaaactttaaagtgttgtttcacataaaaagaaattgatttaagtaataattattgatttgagtaagcaaaaaatgaactgaaaaatagagaagttgatatcaatatagaacatgcaaacaaaataataaaaagataaaaacacatcagttagaagaattgaatatggataataattaataaaaaacatgaaacttatggtgaagtttattttaatatatataagtttataattaattttgaatttgcatatagttcatagtcaagaattccttattctatttctactttttatcggtgttttgtgggttttagtccccttcacttccatgctacatggtaccaaatgatgaaaaagtaggaatatatgataaaaaaaatcttcccaaaagatgtacaaggaatcagttttattataaacatttttcagtcttttgaataaacaatttgtccataattttgatttttatgatttttaacctggactgaatttgtattgataaaaataaattaaaaaaatattatatatatatatatatatacacgttaccttaaaaatatgtccttccattaagtatatattttagtatattttaatttctatacactgtttgcaatatttgtttacattattaatcaattacaaattataataatataaattaaaaataattataataaaatttaacaaacttattttatataaaattgtatgattgaataatagtatgaaaatacattttatattactaattcatgcactatttattcatactttaatacaaaacttatgataaattacaagttatatttgaatacacgtttagacaacttccaacaatttaaaattacttaatttttaataagagttatcgtcaaatttttattttttatttttataatgtacaaagaccagagacctatattaaaaatacaaaaaacagactttttattatttatttaaaagaaaaacagcgtcttcttcgcattaaaattaacccgcgatatcgtgttagtgaagagggagagaggatccaaatccaagtacggttgggttggagagaaaatgcgtccctgctgaaaacaccaaaccctaaaacgcgtaaaaggttctaaaaatttgcgaaggaaagagctagcggagatggagattcactacagtaacagctatttcgagaggcgccccatcctcaagtccaaggctcccgctgttaaatgggtcaaagaatggtattcccaatttcttcacgctctcatattttgcatcttatgttttagggatttcaatatcgcggaaaattgtcttgtttgtaacgaggctcaatttatagtcatagttccattattttgttatgtttcaattactcatataagagtaataatacgaaaatattgttttacaaataattagaattcatgaacatgtttttattaaaaattaaagcagtacacatatatattggagttataaatttttcctcgtgaatttgtaccatttcaaacagagatttgctgttaattaataaattaaataactaaaaaagttaaggaataaaagacaaatcaatcagtaattcgcgtgcattagttttctttgttaagtgttagtttgttagtttttttgtcaggagcgatcaaatctgtgaccttttcctccttcccttctttcttaaccacccaaccaaccttatatctactctgttattgttaattactgtgcttatcgaattagctttgagaatctggttggtttttatgtttagatggaggagtatggaggggaaggagggggagagtcactttttcatttatactaaaagctttcttagtaattgagttttttttttttttaatgagtggaatgaaattgtaatcagggattatcatgggaccttgctaccattcttattatttttataaacgttttacaattttctcgatttaggaatgtgaatgaatggatataatgtgtttaaggttagtctttccatgttgctgttagatggagagatcaggttataatgttttagctggccatgtgcagtttccattcttttcatatttcatttggttaagtgttatgctaatcatcagatgctgccagggttccccaagatcttgtgacgacgggagggaagtgcatgatcttaaaatgggtaacaggttggtcttttttactacccagcaagcttacatctttgctcattcctgcccccatttggccattctttgtctgtttacatctgtgtattttattttatttttttaaaaattgattaatgctactgtttgttttagcttctataatgatacaaaacttggtagaaaataaggggaaacaagatttgagacagaatttaacatggtgtaacctaatgactaatatgcattgttgacatgagataatcagttgtttggctgttttttgctgaatttgggtgagaggtggtaacagtttgtacgtctggagagatagaagttatagtatcttttttaatacttaatactaattcaataaacaaaattgttgtaaaacatgcaaaaaattgatgtttaggtgctttgctaagaggaccactgtatcatatgatgatgttattatatcatgttttgtatcttacatttctctttgttttactttcctaagaggataccttgaagaccttgaaagaaaaggtgaaagagccttcagtgccagagccagaacctgagccaactactgaagtactttttctttgcagctatgatggctgtggaaagacattcatagatgctggtgcattgaggaaacattctcacatccatggagagaggcagtatgtttgtcactacgatggatgtggaaaggtagtggttttaatacttacagatgcacaccgatacacatgtattttatatatattatatactatatatttgccattgtattgccaagttgtgaaataatagttttcattactgcatgctgcaaaagcagatcaaattacactttgttttaccagtctcttatccagtgattagcctaatagcctatagctttaatgaaacattgtgttgatccctctcaagcataaactctgtttttctttcatgccatgaatatagatttttgcatgtgtttgcttttggatggaagattacatgtctatcatggggggcagggttaggtaaagtgatctaagagctgcattatatttgcagacttcaggtattggcatgttatgctgcatgattggagcatacttaattaaaacaaatcattaaacctttttaattggtttatatttttttaattacactttatttatttatttatttaatgctatgtatcaagttgcaatagcttgctgtggactgtggtttactcaaatagcaggtctatttagcagtgctgaaagtactttgtttacattgcagaaatttctggatagctcaaagttgaaaagacattttctcattcatacaggggagagggattttgtgtgtcctcatgaaggctgtggtaaggtgatgatttgatccaattaagggtttgttgttttctatgacggcttcctttccctagttggtgttgcatgttctgtgtgttgttctttatggtttacacatttggatttgtgacatagtcaaattagctggatgctttccatctatttcttcctatcacaaagaccaacatgaattcagtcttcaactgtccactctgaatctgttttggttggaatgtttttctcaatggaaatttggaattaccagagatattcaagcagcaaagcttgagttcttaattgtgagacatatgtgtacatagtctttaaattgttgatatagagggtaaccaatgaagttgtaaatttttcaaatttgaatcaatatagaccaaatgttgttttatagttgagtatattgtgattttcataaatctgtcatgaactctctctctatacacacacacacacacttttgattggataaattactttatgtatgatatcatcttcaattattatccactatttcattcttgggtaagttattattagtcttttgctttggagtttggataatgtctttatgagtgtatgtttgtaatcacatctgctgcaggccttctccctggatttcaacttaaggtctcacatgaaaacacattcccaagagaattatcatatctgcccatatccagattgtggaaagagatatgctcatgaatacaagctaaagaatcacattgcatctcatcatgaaaaggttaggtagtgtttcctatttgtgtagctggtacattttccttatttttttaccactcagtctattaatattatgtgatgcatgttattatgtaaagcatacctgttgttttagtccatccatttggtgtttgtgcggtagtttcatttggtttgttagtatatctcaatacaaatatgtattatttctctcatgtatatcatgaatatctgtataaagatgtctctaatttgaaactgatgaattactccagtggatgtgactcagaaactgtaaacatttcttgaacagtcttttgatttgcaatttcaaccttatcttacagaatgcatccgtggatgtgacaaagtacactactccaccttcagagaagcaaacaaaaacttctaaaccatctggaggggcatatggttctgcatcatctgaccgtccctatgcatgtccctatgatgggtgcgaaaaggcatacatccatgaatacaagcttagactccatttgaagagggagcacccggggcttatggctgatgaaaatgcagagcatgctcaggctaatgttgacaatgaaatggatgaagcaagtgaccatgatgcctatgttgcgaaacgatcaaatggtaaaattcagaagcagagtaagcctaaaccaaacctcaagttgcctccttccaaaattgcaaaacgcaaagtgtccactcccactttaaatgtaaataaaaattcttggcctgtgaaagatgaaccttttgatgaagaagatagcgaagaaacagaagaggatcgtgacaatgttgaagatggttggagatatgcaggaggaaacaatgaagatgatgatgaggaaacagaatatgaagactgaatcagttatggcatcctctatggaacttaccttttccaagaaatatattttctcttcaacaaaaaaatttcagttgtctcttttttatttggctgaggaaatgacatcttgtcgaactttgtgttggctgttacgagccttaggaagaatttatataaataaaatgcgatgtaaaatgctcttggttcaattgtcatccgttgtcaccacaagattctgactgaattttgttgactttggataaaccttggtatggtggtatattcatcctgtcacagctatacttcaaagtatttttatcattatgtttgtttttaaatgtttaaaaggtcacaacatcaatcttttaatagattttaattttaaattagttaagtaaaattgtcattcattcttattaaagaccaaaagagcgatacaaatggataaattttaagatgtactgagcatgccgttcacgattctccttgccgaccatggcaccaagctccatcaccctttcgagcttagggtctgagtagttgtgtatccctagcaatgatcttaattttagactgaccattcaaggtaaagagaatacttaaatgtttttagactaattcaatgtttaatggtggaattgatattaataaaattgtaataatataatctcagatttttaataggtcacacaccttgtgccaagtatgagttttaatgaaattagtgttgcttataggaaatcatatttttaatattaaaagtatacatagaagtctaaattataatatttacttttaagttttaataatatacaacaatattcattaataatgggttcatatttaaaataataagaaaataacataatttaagttgattttttatttgtgtaagaaaaaactaaaacaatattatattaaatgtttttcaaggacaattgaattgttggtttttatctaggttagttttttggtataggattaatttcattttttttcttttataattatcgaagtaatttatgtaaaaaataatgataaatctttttcaaaaataatgaaaatgtataaaatgaatattattcttttattttatgatttcgtacattttgttctttaacttttatttttaagtttgaaagtaaggcaaaatgtataatttaaattttagaaatcgataaacacattaaaggtgagatttaaattctttacgcattctttacttgacaccaccaannnnnnnnnnnnnnnnnnnnnnnnnnnnnnnnnnnnnnnnnnnnnnnnnnnnnnnnnnnnnnnnnnnnnnnnnnnnattactacatttgttaattgaagttttaatcgactattgtgcaaatttaattttgatttaggataaataattattattttaattttaaagtaaaaataatataaatattataatattaaaataaataatgtagtataagtgatgtcacagcaaagaaacaaacagatgaaaagaaagagaaaaagttagtactatatgtttatatctattagtatatgacaaaatattaagagttaaaattataaatttatttattaaatgtttttttattttatttatagaaaatttaagatttttttgttgatatatttacataactgtcgcattaacagtaacatttaataaataagaagatgtattatccaacaatggtacatcacatatactctatgggtttatttctctcctatgagattcttcattcaataaatgagagaatattcttgagtcctaccacagatcataataatgtaaataaagatctcaaaacagatttttacccaaatctacggagcaagtttagtttggtgttgtgttgcactgttactgttgttttgaaggtaggaagaaagaaagagcggtgagagtgacggaggaaacatggctacggcgtcggcgtcggcgtcgtgggaggaactgacgctgaaagtgaaatggagcggcaacgagtacaccgtccgcgtctgctgcgacgacaccgttggcgagctcaaacgtcgaatctgcgagctaaccaacgtcttaccccttcgccagaagctcttgtaccctaaaatcggttccaaactcaacgacgactctctcttcctctcccagcttcccctcaactcctctctcaagatgaccatgatcgggtacgccactacgctgtcgtttcgtttcacacacttttatttttagggttttctttcattacattgctcacgaataatgaatgaatgatttggcagtactacggaagaggacttgctcgtggatcccgttgagtcccctgagatccttgacgatttggagcttcccaaagatgaggctgttgacatcaaagatatggaagtcaacaagctgaaattgaatagacgcattcatcaattcaaggttcaagttgttgttctttttccgcattttcattttgtttctttctattgtaactaacaatacctatctacataatatcctacagattgagcttcaaaatccgtgtcgccaagggaagaaactgcttgttctggatattgattacactctcttcgatcaccgctccactgctgagaaccctcttcaactcatgagaccctgtaatttcatttcccccctcttcgttttcttcttttttcactcagtggatggagtttgcttaaaattacaaaaatgccatttttaatcactcaagttatcgaaccttggcaactttagtccttagttttgtaattttagaggctaaaaggattgttggtttggtaattttagtgattaaaatgacattcttcgaattttaggaactaaattgatcaatgcagatgatttcagggactaatttgattaatctatttttttactattattattgaacttaattgaaaggcattgatattataaatgtctttttacactgtcattcaatcacatgttgttatgtatggtaaatttgtttgccttttctaaaagttatctcaagaatgatttctaattggttgatagtacaagatttttcacactgacagttaaacttggtattgtttctttcctctctcttgtctgtaacagaccttcacgagtttcttactactgtttattcggagtatgacattatgatatggtctgcaaccaggtactgtcatcttactttatctgtattctgttctgtcaattttttattcttttgggacgataatttgtaatggaatgaatgctacattcacttcctgcagcatgaagtggattaaagtcaagatggaacaacttggggtgttggacaatcctaactacaaaatcaccgcacttcttgaccacatggcaatgatcacggttcagacttcttctcgtggggtctttgattgcaagcctcttggtttgatctgggctaagttccctgaggtataattatgaatattatgcaataaactaacatgccatttattttcttaatggaaagttaacagaattatgttggcatatttgctcaatcatacattaccatctacagcccaatgaatagtatacttcttatatggggagaaacgggacacccagaaaatactattgctgtacttagtcttcctgaaaaactaaaaagatgttgatgcttgtgagtatagtcataagtgagataaacctaggtgggttatggagttattgattctagttaaataaaattgcaaaatgaaactatttgacattctaaattgctgtaatctatacctggttttcatttatttctgtattgttttcaattttttgcatcagttaaccatgcccttgttctagttgtcttgatgttggtttcttattctatttcagttctacaatgcttcaaatactatcatgtttgatgaccttagaagaaattttgtgatgaacccacagaatggtttgacaattaaaccattcaggaaggctcatgccaaccgagatagtgatcaggagcttgtgaaacttacccagtacttactagccattgcagagcttgatgacttgagcaaccttgatcataataattgggagttattcacagaggacaatgttaaaagacgtaggcacagataaatgataattgaatgcaataactggaatctggtaagcaagatgcaacttctagacttgtaaaagtttgcagttttataagagacattgttcagccagaggatttcagttttttatatcaagtatttatgtttggacggggtgaatgacagaaaggaaaggatttcttgtagcagctgtttggagtatctaagatgattaatattgcttatgcaatttctatctagcaattcctgaacagaatttgatttgatgcatgaaaaaaattctatcctttcataatttgttgggaaagggtataaagcatggataaattgcaaaatgattagttgtgtggcacctatggctgcaactattctccaaagtgatcaatttattctaattatagacaatgtattacatggaagttcaatcttctcctcgtgtttttcggcctatcatgtaatgtaacttatcattgttcttggattttatgcttcatgatctatattgtctttttttagtgatcatcttctaagtagggtaattattgtgtgaataactccatttggattaagtggggaaataagagagagaaatgatagggagaacataggtgaggtccaatttggttcgtcttaaagtgactgaagaaaaaagtgtatggttctgcttctgttcgttttaataactcaatgatttgttatggattctctaagcaaaagtatcggattagttaaaaaaaaattaaaaattgttaagtcagaatattgaattagaaatgtttggtaaaattagtctttgaattagttgattaattaaatataaagtgacataaaataagacgttatatatttttataaaactcttactttttgtaaataaaatgtatgtttcagctaattatagttttatgtttcacttaatattgaacgtagtgatttttgtttgaagtaatttattaaaaattaaaatgaatagtataataattaaaataaacactaaccatcaaccaactcacctattttacatattgatattttaacttctgattttggaggtttaactcgacacaaccggtttagttcttgactacgtccttcacactttgcctttaattcgacactacccgcaagtaaaacggtgttcaatatataaacgtgaacatgaaccacaaacatgttgcccaaatagtgtgggctttattgtgggttggattcacaccgtgggcaacacgtttaatataacaacatattagctcatcaaatgaaaagttaagttgctttgacttggaggaccttctaagatgcgatttaatataacaacatattagaacatcaaatggaaagttaagttgctttgacttgtaggaacctacaaaatttaaaagcaataaataacctttaactagacttataagtgaaagagaaacttgtagaaatcaatgacttgaataatatcctaaatcaattttctcattgctaccaaacatgttgagaaaacataacttcattaaaatcacattacaaacattagcttaacattatccatacaaataagacacattcaaatggccccgagatatttgctatttgcactggaccaaattccacaatagtggagattaacaagagggggtatacagctacatattcactgaagaaacagtgtgggtgaaagcttgaaaatgttggttaccacctctggtaggtcaactgacagaaatagaataagatttcggtaatgaccaccaggtgcacattaaatggtaataataagtaaatagaaaacggaaagactaagagaaggctgaaatcagcaaagctggcaggcagagagagggcatatgatggaaatctctgcacaatcccatgcatgggaagggaaggaagcaattctatcgtgggtgtggcaacaccggttgaatgtagaagcagaacaaggctacagctactgcaaatctaaattctgagagcagggtcttgccctgaattggtgtccttgtgttttagagaaaggtttgcgaactgagattcgaggtctctactgtttgtgcgtctgtgacttccagatggttgctgttgtggctgtgtctgtggttgctgctgctgctgatacaatgcacgtaatcttccaatctctctttcaagtacttcctgctccactgaatttcacattgcatagattttagtgtacaaaacatgttcctgtgatttctaatgaaaccaatcatgcttaaaaaaagaactcatgggcctaaagagaactcaggcaaggatttcagttcatgttttctcggagtaatattttcttggtctcctgcatggtgtccccccacctttttgggagccagacaaatccccactcactcatctgaatatttagtagcacggctcaggccacgtgtttccaggggaatatgaatcctgcaatgcaggaaaagtctgctacccacatgccacacggtattaggtggccaactgagccccacctcatttcttgaactcaaatgttaattcctaatttccatcactatcctatattgctagattcttctaatatagaaaggtacacaagaatggatttttccccatggttttgaagtccttgagctacagttttgaatttttcccaaattacttgaatacaacccttaaaagatcaaacctgcctttctttaatctcattacagtaattctcttgcaaccatgctctagcacatagaaaatagaacctgaactttctacttccttgccacttatatgatataatcaaacttagattaaccttatgtgttccttttctattaatttatactatataatatatcataaatcacaaggaattcactagctgaggtatctaaagcatatatacgcaatccaagttaaaaaaaacttgtgttacttgaaaatggccaaacttatatcatagaaacttacaatatttgataagctgctcttgtgctatattttctaaacgttgcttgagtgctttattctccatactcagaataagattctgctggttaagaaactcgagctcagccgagacttcagacccttctgcctatgttgacatagaaagaaatagaatcagcacttacataaaatgtcactctgcaaacatgcacgatattgccttgtgcagaaacctacctgtaaagcttgtacattcctttccagctcagctatgtattgaagtttccggacccgtgaacgttgagcaaattgcctgcattacaagtgtttcagaatttttttcctttccatatatgaattgattggttccaaaaaaaaaaacttctgtaaattaaatagaaaacaaaaagagaaaaacacaccacattcatcatataataagaagcatggtttaactgctttctctacatgacaattagtataccagcaatagtgatgcagacatcactttgtaccacaaacaattgttatataacttatatcattttcccttctacgtatattattaagatgccatatggcacacaggtagtatagtctagatttgatattataataatgtccagcctatttggtaaggcttaaaagggtcaataatggggatgacatgacttaatgggtttgccacaagaaaccattcagaacttgatcccccaagttagatattagtggcataaaatcaagcaatcactgtaataaccataaaatcaagcagagaaaataactacgtactgtttagcacgttttgtatcagtttcagaggcagatgactttgcatgtgaactgtcctttttttcaggaaatgattttgcatcctgtaagcctgattctactaaatcgtgcttttcacttgctgctggtggaagaccatctgcatcatgtggtgtacattgcaatcctgaactctgaaaggcagcactgtctttgcctgagggaacaccaactggatttgtcatggcatttgaaaaagagtcccatgacctatttttctgttttacggagttcatttctgcataaacaggtacatgacgaacatctttgctgcggtcaaagtcttgagatgaccaagacggaatagacatcatattcttatatttatactcgtcctgattagcataattaatgttagatgcattaacagtgtctatgtacgcaaaagaatcacttgatgaacgccgatggccacctcttcggacaggtgtctctggctcgttaaggagatcatcaagccatgaaggctgctcctctataacaaggctctcagatgaagtacgttggtggtgtgtgtttccatctctaggtctgttaccatcctttaaaccaacagggggatttgggacataatcagcatatgcttgggaaacactaggaagtggacttttaggaggaagtagaggatgctttccaggatacataaaatttctgaaacctgatgagccctttgaatttgccatagaagcagaatgaacaatacctgtcgaatttaaaaattaccaaagaatgtgatcatgtgaataaatcaaaagataaagacaacatagaaaattttatatttaaacataaaatccatgattcaacaatgaagatctgatatgcatgtgttctcgattataaaatataaaccacaaatacatgttactcagtaaaaagatcctataatgcgaatagcatagtatccttgaaaatgttccaaaaattgaaatttggtttatatgcaaatttactcacagcaccaaaagagtaactgcgctagtatcagagaatccacatgtaatgtaaccaaggcagttttgggagagaaaaaaaaagcatctcagtaatctcaataaccataaatgactaaatctgcatacttcatcgagaaaaaagcctaagagctaaatatctcagatctccatgatactatatatttcattggataaaagttcacaacatattggcagctttacggatttatctctttcttttattagtccaaaatacaattctaaaaattgtccacccatctcacaaaaatctcaaattttcattttacatatacattattaatcatttcagatagttgatcaacattgtcaatcctttcctcacggtacaggagcatcacatcaagattgtccattacaatttcatcataagcaatgcacaactcgtatgaaatagtaccaagcacaatagcaatcccatcacacataaatgacataatattaaccaatgttttaagttaaaaccagctccataatgataaaaaaattaccagcttaattttcttcaataaaaaaatcaaacccaaacacatgcatctaacaagcctggcatcgcaacagtgaactaccaatgtaacagaatactcaataacatcattttttttttaaaaaaaaggcagaaacaaaacttcaaaacttggaagccacaagaaactagctaggggaaagaaaatccaatccacaaagaaaaatttaaccacaataagttaaaaaataagaaaaataaaacgtagcacccaattgccaaactttctattttatactttcattttctcaggacccagatgaggggaacaaaaaacaaagatagaaacttcacttttctacctttcccaaagaatctgcccaaaacacgcactcagaaaacaagaggagaaaaggatcaacacagaatttgaaaacccgaacacggtgcaatgtgcgacactgtggcatcaaaagcgcaatgatttcaagctgatcgaacgaattgggaatgaaaattgaaacagattcgtttttcggaagcaaacaaaaaattaagacaacaccaaaaggaaagaaagaagaagaaaaaaaaaaaaaacctttgcagattaaagattcgagatcccgaaatgcaatggtaaaggagcttgaaatcaaagcaaagactctctctctctctctctctctctctctctcttagggttcgtttcttcaaccacctctctctctttctcttctctctgtcttcttgttgaagctgggaaatggggcttaattgtaaaaccatgataagtaaatactgttcctaaaactttttctatttaacgtttcacccctttaagtttcggttattcccaaaaaaaacaaccttgggctagcaacttaaaaataatactcgttgttgtatctctgtccaacttgtctagagacatggcaaaatagaaccataaattcgttattatataaaaaaaatccataacatggaaagattccagtaataggattttggacattggactgaaaataaattcacttttccttagttgactcacactgggtcacccttgataccaaaattttaataatgttaatgattatgattagaactattgatttttaaaagctcatccaatcatctaaatggcatatataaatgttgtttattaggaaaactgacacaagattttaatataacgttatcatataaaaatttataaaaatattaattatacattttgtaacacactcttttgaatatattttattattacatgaaatttattaaaaataataaattttatgagtcacacatcttatttaattagattctctttcttaattaattatgttattttctataaacttaaatcaataatataatatgtgttaaaaatagtttattgctataattcttaaaataaattaagacttttatagccatgtagacggtcgatgtaaaattcaaaatttatgatgttcaaaaataattattataaaatttttaaaattattatatatgtttacttgtgaataaatgaaaatataaaatatggttataatgttaatgtatattttttttatcattttaaaatttagcagggaatatctatttttttaaaatatattttataaatttttaaatgattattatatttcaaatataatatcatgtgtgtaaggttttttagcattttgtaattcactgtgaaatcaaaatggtgaactatattttaaaatgaaaataagttattaagttcagatattaaatannnnnnnnnnnnnnnnnnnnnnnnnnnnnnnnnnnnnnnnnnnnnnnngatatgtgagaataattattgtatgtcattatcgaaagttttatataagtatatttatatgagttaacggaaaaatttaacaataaatttaatttattgtattttttacaaattcaaaaaaaattcaattttttatctttaaaatctaattgccaataactaacaaaatcaaatacgtaaaaataagtatttatcccatattataacattttccgaaaataaaaaggtatattcttttgttcgaatcaggtaggtgtgccgtatgcgtatgccaaaagtttcgatacaagtgtcatggctcaaatgtcttatttcttactattttaatagaaaaaaaatgtattttttttagattaatttagttctaaattttcatcgcataaatgttgaggtgagacctgacatcctatttgaatgaaaatgtacatttaaactttttagctaggaattttttcaattaatggctatgacagattcggtttaatttagaagaagaaaaaatcaaaacaaaaaatggaacaaagtaagtatggaaaaaattgatcgtatatactttattttatttttaacaatcatctaataaaaagtagaaatattttttgcaaagtaaatatagtagttgaagcaaaaagaattatcgtaggaaaaaataatttcacctctaaattaattttaaattttgtttaagtcttactattatattatttttatttcgtctcataattgtttaaaactcattgtttgattgctatgcatgcagcaagtgttatgttccatccattctagtttgtttttatcctttctaattgataaaaaataacattaataagtactcttaagatattaattaaaaaattattattattttattaaaatacnnnnnnnnnnnnnnnacattaaaaaaaaaaaaacctattttagttcatctctattactagttactagtaattaaaaagatgatatacttaaatcaatataactttttttcactaagatcattccagttttattaaattatatattaatttggaaacttgcttttaagataaaaaaattaaatataaatagtttattccaaacataatttcaattataatagattttataaaatgtatagttcaaaaataagtttaccaaaatttaacttaaaataaattttgatatttttagtaattatttaatataaatcaaatctatttataacacagataattaatatgaagtttaaaaaatatattttgtaggccctgattaaggtatttttagttttgagttttgaagtttttagaattaacaagtagttttttagctttagtttcaaaaaaatcttaaatcagtttttaaaatattattaattttaaaataaactcatttcaaaagtttcataaaatattaaaattatttttaaaacatttttgtatagtggttatgataatagtaatatcagcaacaactctgataatatagatacaatggtgattacgatgaaaataacaatgacaatattatagatacaatggtgataacgatgaaaataacaataacatagtggtggtagtggtggtaatgttgatagtgacgccaaggataaaggtgatattagtagtaatggtggtgaagacaatgataataatgttggtggtgtcaatggtgatggttgtgacattgacaatgatgggatgattgtgatgataatgatagatgtgatattattggtagtggtgacaatgataataatattgatgataccaccgacaatgataataatactgacaaactaaaattcaaactcaaatatttttttttgattttgaaaataaatgtataaatatttcaacaaaaataatttaaaaatcttttcagttatatgtctatcaaacacattttttataattacatttaaaaatcaaaagccaaaaacttgtaaccaccacaaaactaacccataaaatattatgactacatagtatatgtattaacaatctaaagactctttatactataattcattttacgttattatttattgtaaatttaagcttaaatatattttttgtttctttgtaaatttttttttcgttttattccttacataatatgtttttttaaaatatatttaaaaaccattatttatgtgatttttaaataattattataaaattaagaaatttattagttattatagatgacttttatggctacatgatagttaaaagatatttatactaccagtgtatatattatttatttttaaagtaattatactttattgaaataataatgtttataataaaatcacattttagaaaaaacattttaataaaaatcagttataccaaaatttaaaataaacaagaccgtattattttaaaataaatacattannnnnnnnnnnnnnnnnnnnnttactaatattattatcaagttatttttttatatgatttgcaagattttaaactacggagaagaagttagattttgcacagttgcctacaaaagttacgctggatttcacatgagtatttatttctcttaaccgaataaaagaaagtactcttaatatcacaaaggaaattaaaaaaataaaatgataacaaggcattaatatttgtgtcttatatttaatataatttgtttgcttatttcatattcaatgcaatatgctgtttctatcccagagcagcgaaacgaaacatacgttaattgttttcaattaatgtttttttttatagagttttcatttttcatttttttttcttctttgaaaatctgaagcgcctgtgtgatttataacaattttttttataatttatattcacaataaacgatacaagtttttgagaaatttagttgtttgtttttatatttaaaaagtatatattaaactctaattaacttgagttttaattgtggaatgagttagttttaaaatattttgttaatatttattattttccatttataatacttaaataaaaaacttacttaaaaaaaagtaaaatcttagtacttgaatgcgttggttttggtggtaaatgaggagacagaaattagagtgagttgtaaagtggggagagagatgaacgacagccaaatccaagtatgaattgggacaaacagttaggagttcccaacctcccatcagccatagcatgtccaaaaccctgaaatctatacatgtaccgcagaatttaatactactgtttttactaaaattaattaaaatacaatcacaatatacatatacacacatatatatatatatatatattaatttagtttctttatttactttatttttgtacccctttatcttcatgatcaaacgtagactataaaactttgtatttcttcgaccttcatagttgcactcgatatgagcatcctaacatccttcgaacgtaggccaatcgagtcttgggcaagcaccaaaaaagatattacttatcttgggaataaatacccatgattcgggtttgggaatctcgtgatagccattacaacagttatgagtaaccgtccatggaatatcactacttaatcaatatgattaagggtatataaacctaacaatgaaccctaagatgatagattgcactgacataattgaacgattctggactaggtctcttaccttctagacacgatctaactagaggaacaattttcattttaatttctctacatatactttgtttttattttagtccttatttctatctctccataaggattataaaatgataaagatacaaaatggccactccaacctacctatcaattattaaccaaacaaagccacatattaatatcagtaattcaacatcagtagtaacaaacttcagtttctaaaacccacgcagaaattatcaaaaattgaaaagcatgaaacttcctacctctgttgcaagacaactcgagagcaattagtcgagagctcagtcatcaacacattacaagcgccaagatttttaacaaattctgttacccaaagtccatgctcattcctcaaaacacccccacaggttgcttttaaccacagatttggtttcacaaccaggttccaaacagatttagcataaacataacctcttagagatgagcattttaatctttattttgctggacttaggattgcatgtttttaattcagttccaggcttcagcttttatattcagcaacagattttagctgatgtagcctcggttcttttgttgggtttttagttctttgggctcttagcccctttcatccaactaaaaaagaacaataaggataaaactcaaagaaaacaaattacaagcttctaaggttgttgaaataacttataaattaataaaaacaagttgacttattaagtctaagccagtcaaataaataataagttagtttatttgacatgtcagacatacttataatgtttttttttcatgccttaagcattttttttctttataatatacttatgtttttattttagttcttttaattttttttatattccatttaacttaattaatgtcttttgtttgcattagtccttatcattactcaattattatcaactgctgaggtgtagaagaccacttcatgacttcaacacattaggacgtaataaagtgttattagtttcttttagtctctctaaatatgttttattttattttaatctttgtctctttaactctttccttcctcattttaatttctctaaattattattattattgttattattattattattattattattatacaaagataaaatcattaacttggtaaaaaaagtaatatatggaagcaaaatcaatacaataatttatttaattatatatgatagaatatactgaacgacatacaattgttaaacataaccaccaaagcaattaaacaattaagtgaataaaaaatcctcattctaaaaggttctttattaaaccattttagttttcaatttaaaaattttcataatacaattattcattatgaggtcccaattttgctatcgcaatacacaaggtatactctaaaaacacacacatacagctcatttttttcttctttttgacagaacacacaacacgcttaatagcatggattttggaatctataatattaaatttaagacttcataaacaagtttggatgactaatgtcaaaatcagacacatatatagagatatattaaaatatatatttaaaataaactataatgaatttgtaaattataaatctaaaagaatataggacatcaaattggaaaataactatgtccaattttaaaaccctaatttatttgtcgtctattgcaaaatttaagaagcattcataatatagaatacaattcatttttttttataccaaatataagttaaatatatatttatgtaaaatatatattagagattattgtaatgtttgtaaaaatctaatgcatactagaagtattgaanacatacaaatacaacgactattctaccaaaagtaaaaaaaaaaaaaaatcctcattagaattgagaagatcccaattttcttgatagttgtcgatttgtctgcttacaaagatgtggttgactattcatataaatcaagcctcctgtcattttttttttatgcaatttcatccgtcatgctcatataaactgaataagccgaaatacacacacggacccataacaaaacacaggcggaacaaactttttcaagatcctgtttaatattttccatttttagaaaactggaccctcaattgagaaatttgaagattttttttaagagagtaaaaagtgaattaacgaaagaggagagagaaaaaaatttgggatgattgataatgcaacttctctgctgggacatgtttgtgattccccaaatgaagtattacgtgaatgtgtctcagaaaatgtaaaagtagtaaaaattgttggtgggaattgaactttgaatctcttggttattaaaaataggcattaccatctcctctaatttttaatatttaacatatgttacagtaattaatatttgaggtcccttattttttggcctgtgtgattagacaccttgaatagatccaaaaccgcccctgacaaaacgaccaacacacactcatgcacgcgacaccataaagttggtaaattaaaaatgatggtgtcaatagtatcagctataaacacatgatgctaaaagcaatgttggaacatcctatacatcaactattacaattatcgtgagatagctgcttcataagccacttctccggtgaaacgtttgtgtctgttattcagatcactcgcggctgagattcaaattgccaattttcacaacagccttgccttatgatcccagcaatttcttccatcttgcatatgctaaaataagcaagaaaagcaatacgcaagctgcagacgtgatccaaacgaagggccaaaataatccatcaatgtgatataaattgcaaggaatgttcataccaaatgtaccagcaatcaaagtttcaatagcaatagcaaatgatgcaatagtcaacgtcaactgcagctgaataagttcatttcggtggttatcaagttggatgttgacatagtcttcagtgtcgtcaatatactccctaacctgcaaatcagtcaaattctcacaatatttggcattccagacacaataaccaaaatcagctgacatttcaacaacacaaatgctccctaaagcccaacatcttggtccatgaaacatagactaacttcctcccccctcaacattaacaatatagacttcctaccattttgttataaacaagaaatgaaaatcaacagtaggttacaaccatttgtttttaaatcaacagggcaggcaataatatattttgtaaatccagaattgcaacaaacttggacaaatctaccattaccattatcctatagggtgagcttaaattaatttattggagcttgggaattcttaaggataagctcccaatagtgtcacattgaaactagcaaacaattgagattccctccatcctcaagacaagagaaaagtaaaataatgcaatattatatctctggtaagtatcacaagtcacaactaagtttatgtggttgagtcacgtatgcaaatgaaacatatgaaatttatcatctaaaagcacaagtgtgtgatataaattagatagatgatagaatccaagtagaaaacgacagtttcatccttcaaaatttgacagacacatgatttgaccagaatatgattgttagaatacttacagataatattttgttacgcgttccatccaactgcatgaaatatgcatcaagcaacatctccaagtcctccacattgttataatcctcataatggctggtcacaagactttcacttctgttagaaccaagtcggcgaacaaaacgtgaggtattaggaaagttatttgaggttgtggcacccaaatgagcctcctcaaattgttgattctgcaaccacttcctcgtcaaatatagttgtgccatatcttcgttgtcatctaaaagatgttcaatttcatctcgcacctgtgaaagagggtcatacacttcttaagtatgatatctcaaagatgaaggaatgcatcttcacatacaaggtaaaaccgcctgcaataaattttctatatataaaagagtgaacaaaaacctcaacttaagagcataataaatgattattgaacaatgtaacaaaagaaattaaacaattaaagagtttggcaagaaatagcctttcattctttattcaaagactgcagaaatggacgcagattgcattccaattacatgttatttctctgaaaaatcctcaatcatcacaatgcacaataactaaaagaatctgttggcacttttattagcttgcacatttcatgggcttttaactggtggcttgaccagtccaacaaactacattaattagaacgaaattggacttggtacatctcttttcccaaaggttaatcctattctcaatttccaatttccacagtcatctataagtaacgaaataactatccacatcaacttagtaatagcaacaatcagaggaagaaccacatggtacttatgcaaaaacataccttctgcactcgtgccagcaaccgcgtaagattactcttcaaactcctcacatgttcaagattcttggtgctaacattccgagccaattcatccaacacagggtaagcacctagctcaaggtccgccacattcgagtccagataagtacacacagcctccaaagcaatctccagaacttgaaactcaaacggaagctctgactgcaaaccatcagctgcctctggcgtaggcaaccattgcctgccattagagacctgcatttcgccttcctgttcctccatgctgccgagaagtttaggttgacttttggcaggaagctgttgcctaagttgctcaacaaagggaagaacctcctgccgaagaggatcaagcaataacacttcttcagcagtcacgatcgcctttataaactccaaattaaccaccattgctttctctctagctgcaattttttatataaaaagacaaattataattctattcttcattcttcattataatcataataccatccaagaaaagaaaagaaaacacagaaccacagtcaagttaccaaaacaaacacaatttaagacatgtgattcaattcattcagagaaaccttaattttgagaacacgatgaaaatgaaaaaggaaaattgttgaagattgaaatactgttattattcagttacctattattttgtgagttgttattctgtttagattagaggaaagttgttattctgttacaaattattctgtttaggttgttattaatacttgtttaaatacaccttttaagaggtagcagatatgaaggaaatgaatgaatagttctctggattgagttttaatatggtatcagaagaaatttaatccaaagaactcaaatcccattttttttccgaatctgattcctttttttagccaacctgtaacttcttttccctctttgcacagtctccaatccctaatttccctaatttctccaccatggaaaaccctgaatctcctgtccatcccacctccctaccaacttcttcccctgttccatagtccaacatcatcatacagcaagacaactcttcctttcctgtcaccgtcatccttgatgattcaaactaccccctttggtctcaattaatggacaagcacataggtgcccgtaacaagtctgggtacctcactggtgcgatggccaaacctccgaccaatgatcctaattatgctacctaggtcactgaaaacaaacgagtgaaaagctgactcatcgaatccatgagcccctctctcatgcagtggttcatccgccttgaatctgcaagcgaaatctgggatgctgttctccaaacgttctatgacggatctgatgaaacttgtctgtttgaactcaaccaacactccttctccaccaaacagaatggttgtcctctctccacctattataatgagcttctctccatctttcaggagattgatcaccgcatggcttcttctgcaaccaccgtcgatggcgtagcccagacgcactcttccatggctcggctgcgtgtctacatttttctgagtggtttagactcagattttgaccaggtacgtggcgaaatccttcgtagagattacaaattggatcttgagagcaaatatgcatttgtctgttgcaaacatcagcaccccatcacaatgggacgccctgcttctacaacggattcttctatgtttttatcttatactcctcgtgcttcctctacttctacaatggatattcttactcaaacataaaatgaagtcttctctgtttttcagaaatttcataatatggttcaaacccaatttcaaagttcaatccaaatccttcaatcagataatggacttgaatatattttttttttttttttctgaattcctggactctaaaggtatcaaacatcagacttcatgcaacacacctcagcaaaatgggttagctgagaggaaaaacaggcacttgtgagaagtaacgatggcatctttatttgacatgaatgtgccttccaattactagggggaggcagtcctttcagcagcttatttaataaatcgtactccctctagttctctaaattttcttactccacagcaaaaacttgaaactttcttttctatccctcatgtaatgaatcttgaacctagagtctttggttgtactgcctatgtccatgttcccaaaactctacgaaacaagcttgatccttgtgctaagaaatgcatctttgtcggatactctgaccttcaaaagggatatcgttgttttgatcctacaacccaaaaaatgcatgttgcccttgaagtatcctttagggaaactgaagttctttattcaaggggagtttcttcttctcagggggagatccagaacaatagagaagaagaattctggctatctacttctacagttcctactccaataccttccaccacaaatgatcagctcacaaacactaattctcctcaaaactcttcacctgaagtaacctgtgaacctccagaagcagatctcaacgatgcaagtcatcctttatcccatgagacaccatgcctaactgaatcacctattgtacataattctgaaatacattctgaacccagaactgagtcgattcctgtccctagtacagatcattcaatttgtgctgctcctaatagtattcaaatcagaaaatcagagagaccgaataaaggcaaacccaaaactgtttatgaaccagaccctaaagtgaaagtaaagtatcctattagtaattatgcgtcatctcataggctatctggatcatatgctctaacagttgatcaattatctactgtatatattcctaagagtgtgcagtttggaagatcctagaaggaagcaagcaatgaacattgagatggaagcacttcagcacaataaaacttggagattaacttctctaccgagtgggaagaagacaattggatgcaaatgggtatacaccgtgaagctaaaagcagatgggagtattgatagatacaaagcaaggcttgtagcaaagggatacacacaaaggtatgaagtagactatcaagacacgtttgctccagtggctaaacttaatacaatcagaatcctaatatccattgctgcaaatagagattggccattgaaacagtttgatgtaaagaacggttttttgaatggtgatttagaagagaaagtctacatggaggttccacctggagtgaagctaactccttcaacggagaatgtagtttgcaaactggaaaaggctctctatggccttaaacaatcacccagggcatggtttggaaggctctctttagcaatgaagaagtttggttaaaagcaaagcaactcgaatcataccatgttcataaagcataacaaagggaaggtaacaatactcattgtttatgtagatgatatggtgctaacaggggatgatatagaaggaatgaaattacttgagaagaaattagctgctgaatttgaaatgaaggatctgggtcctctaaatattttcttgggatagaaagtgcaagatctgaacagggtatatttctgtctcaaaggaaatacattttagattttctgtccgagactggattgatggcttgcaagcctgctgatacccgatggaagtgaatcattctttgggtatttatccggatcaggttgaggtagataaaagcagatatcaaaggttggtaggaaaattaatttatttatcacatactagacctgatatcacatattctgtaagcattgtaagtagattcatgcactctccgatgaagagagtatgaaggcagtgtatcatattttgagatatctcaaaggttctccatggaaaggtcttaaaataatatagcgtgcattgaaggatacacagactcagacttggctggtgattttcagatttcccatgttcggtcccaggagcaacttgctgatgtattaacaaaagctgtctcagaaaaagtgtttgaagaaatcattgcaagttggacatgatagatatccatgaacgagtgagagtgttgaagattgaaatactgttattattcagttaactattattctgtgagttgttattctgtttagattagaggaaagttgttattctgttacaaattattctgtttaggttgttattaatatttgtataaatacaccttttaagaggtagcagatatgaaggaaatgaatgaatagttctctggattgagttttaacaaaaataaaggggaaaattataataccgaggatgttggaggagtgggagaagacggggcccaagattctcaagtctctagcgggaatcgctgcgtggcggatgatggcgttcttctccaactcaacaagttctgaccggcccgatcggtcaaacctcatccacaagcgggcgccgccggtcttcttcttcgccttcgtcaaggcgcagctgccggcggcggcggcgataggacggttgttgttgtcgtcgggtgaggttgcgattccggccgcgtagggaggctgcggcggagacggaggaggaggcggggcggcgttcttcttgggtcggcggcgagaggtggagcggcggaagaagggaccctttcccattgtgattgagaataataattggtaaacaaaattattattgttgttaaatgattaaattgaataataataataataataataatagaagagtgaagattgttgttgttgttcttctccttcaccttcaccttctctgctttgatcctccataaaggagacgacactccttctctgccgcacactccctatttgtttttatgtttgggacggctttaattattgacccaccgaccaaagcaaatccaaagtcaatgggtgtggaaataaaaaagtttgttattacttattagtaactgcatctccatcactcgattatcgttatttgtatttttttatacattagaaaacaaccatttttatattaaatttcttaaaaaacttatcgtttaatatcactttttatttattatattttacagatattttattttgttatattaaattttaaatattttcttttattcttttatatttttgaaatatatcattttttatttttattttttactaattacattaaacaatttcaaatttaaaagttaacaaaataataatttttttaagggaaaattgaaaaagaatcaaaatgatatatttaaaaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcattagtttaaaagcatagaaattaagatattttttgactaaaaattatacaagaactaaaaacacaaattttcttagtttaaataggatagtttttttcttcgagaaaaataggattgttttttacatttacgggacacaaaaaaatttatttttgaacaactttttctaccttaagaaaatttctcaagttttctttaatattttcaaagttttcacttactttaatgggttgttaaactccttaatcaatcttagacaattaatctccgacgtttctattttcttcttttatctttctttaaagtcttgatcacatttttagttgaattgacatgtagtaatttcaaatatgcaatatgcttttagttcacaatctgattaagattttagtcaagaaaaggaattactcgatttgaccattatatgacatgcgtggtgatgtagaannnnnnnnnntattggatacatattaagaataaaagaaatcaagaaatttgaaataaatcatgcaaaatccttttgttgagtttgtgtgtaaagatttaatcatttattgacgcatttcacatttccctcttgttgaactacgttctatttttaaaattaagtaaatttaaacctatctattattcttccacctttttttgatacattctattttacttccacctaaaacacctactatctaggaatttacaaatgattaaacatttaataattaaaatttagtagaaacatgagaaaacttgaaaaaaaatttattgtaaaattaggattaaagaaggagaattgagttatttattttaagtaaaacttgttgaatttaggaaaaatcaaacaatttaattgatttaaatattttaaataaaaaatataataagggttttaaataaaatgaacagaccaactttgcttaattttaaaaagtgaaaaactttatttgacttgaaaaaccttaaagaaacaaaaccatagataatccaaactaaaggaaccaaatataaaaaattaactcaaatttatttaagagaaaaatgttagcaacacactcctcttataagataattccttggttaaaagaaacatgttgaaaaatttctcattcatgtaaaataacattgaattctgaacattagataggaatcgcgaccaagatttaaatcctaacttaacagcttcaaattcttcaaattgaatgaagatcatatctaggttacagtataggggacagaaatacaagaaccgcatgttatgcataatcaatgatgtcatgtatgcagcaagaatatcttaagttcccaactctttttccattactcatgttgatcccgtatattaaaaagccaccaaagtagcaactaaattaaaattaattgccacacgtgaaaggaaaatccatgatccaaaaaatacatttcatgcatcaactgaatctactactctgcttacccttggcattatatatgcgcatatgctaacacattataaatgttactctcaatgcaccagccaaccaagtacatcaaaagcagactcaattaggaaattagagcactcatgcagaatgtgaccacatcatctatattttccaagctccatcttaattcctcttgattgttctctgaccataatgtatctattattcccgcaatggtaaatataactgtgcaggaaggttggaatccatttctaatcagttgcgtgagacaaaaacttacatgtccttaatgtacagacaagtcgattatgaatagcaaaagcactcgatacatctagttcatactagctacaaatttaaattatactactttcatttagagcttaattttgatacattgtcagtctaaagatttttatatgacaattagggatagatattaattatacccagactctatgggtacccgctcaatgggaatggatcaaggtctgggtatttacagcaaaatttaatgggatggatgcaggaacgagtactattagtctagtacccagttcatcccacacccgcatatatatatatatatatatattaaaagagatctatgcactcactatcaaatacagaaatttacatacaaaaggtaattttaagtctataaattggctttaccatcattaccaattttttgagctgcaattcttagcagctatatcagtaggcgaatattctaagacttcctttggttaatcaggtggttagtgcatccggaagtgaatttggtgatccaagaattttgccaccaacatcaggaaaggattcataatcatcaagtgcactgacttttccatccctgctgatcttaactggatattgcatcaagtgtcccctcatccgattctcttcctcagacacatatatgtcccagtttcgtttggcaattttattgacatgtctgacacattccaggttatgaggttcagcaaaacaatgatcaagactaccaaggtgctcagcccacagtgacattctgtatccatacacctacaccaacacaatctttgagggaattgccaattactgagaaaagaaaagatgaaattacataaccaagatctattcacagatctgagtttatgctacgagtccactagtatgagagggtgtcatcaattatgcttacaatgatttattctgataaaatagtatacatgatttatccaaaagatataaactatttaatggtgggttggctctataacactttgggctgatacaaagattggaacctcaagattatactttcacacacacataaatatttagttaattaacttttttttggtagtgtctaattatttcgtgtgtttgcaatatgtgctatatatatatatatatatatatacatacatacttttatcttagattaatatgctcaattcctatctagtacaactattctagctcattaacaaacgtagctggagcttcaaacctggccacgtggatgagcattcttttctgtccatgtatattttggttgataggcacccatagctatttctgtgtcccttgaaccatctaaggatctctggttaatatttgctgatccaataattacgtattcgtcatcaactaccattcctttggcatggacataaatcataaaacgtctgaattttttaactgatacctgattatagaaagggaaaaaataacaataagatcataaactatcaccacataaatagaaaaagtctgcaaatggatctgcatgcaccaactgattacttctcaaatgtaaatatgtaatggccattatataatgctgacacttttataatttattcaaaactaagtaaatattcatttggtagataatccatgatcatttggcactaggcatatatttcattgagaaaactaatacaaacttatggaatatctgtgtgaaatgttgaaaatgataaaatcagaaggaaatattttcttctatttcttcctttttgaagttgtattttccatccaaggaatttgatccagaagaccaataaacattttataaatttaacttaatctaagcttgcaatcttgattatgtttaagttaatttttatactaataagtcacacagatatagatatgaaggtcgggactttaatctccaccaacttcattcttgctagacgagaaggagccaccttgctcattactcatcacacatgtatgaaacttgctttggcaacataaaaaccatttacaagtaagaatctcacattattatatggcaattttcttcactgctatgtttatatacacttaacctcccagacatgtgatttccaggacttattaaggattcatcaagattaggtgcttggaattcaaacttcaactatgttgtaatttctatttagtgccttgtccaatcataggtgggtaatgaatgggtaagacagaccacccattattcaatcatgcactatggggagattttaatacttacatgtagccagacatgagacaccatgaccactgtaatgcttacaattgattagtttgaattagctcaagagaaaaccctagggatactcatagctccattcactaatacacaatccaattacaaattagggatatactcaatccttgggattggttgaatgaaaatacagattatataatgtgaatgaacacactttttcaacaatatactttcaatattttcttttttctttttttaatcctataattaccaatacaaatctttttcattcatttcaaaatattattagtatacttttaatttttatttacatgttcgatccttttaattaataaatatatttttgataatgcaacaaacattaagccaaaaaattataaacagaagagacaggcaatggtgcgtccaaagcgatcccaatccattacatccaaatcatcctccaatctgaaccagcgtcgccacctccgttgtctagccaccgacggacttcgaccgcgccatcgccttcgcctactactccccctccgcgccgtctgcttcacctacgacgattgtcacgtcgttcgatccatcctccgcagcttcttcgtcaccaaggacgagcgcgaccgtgaagagctgcagcacaccctcggctgccggatgaagcaacaacgccaccaaacgcgcaggatctaagtttatttgttcagatctgagtttctttgtttttgatctaagcttttctcccacgcacattgccatttgaacttcaaccgctcatactttcgcaaccttcgtgactctgttttgtgttcattgttgttcttgtgttcatagctgttggtgggtatagggggttagggttgcgagcggaattggtgaaggtggctgtggtgcgtgcccgcgacggtgggtaaggatggttgttggtgtttaggaaaggaaaaaggtcagagattaggatttttttatttttaaaataaaataaagatagtaattattaaaaattgttactgtattaaattaattattttaaaatttaaaatactaattggattaaatgttttaaatgaaaaactgaaaaagtataaaatgatatattttaaaaacataaaagataaaaatgaaaatttttaaatttaatagatcattaagtctatttttgagttgtacccttttagtaaatttcttacgctgtaataactaataaattataagttgttgcaggattttttctgcattatgatcctaagccttagtacacaaggtaaagcaggcacaacctattgtcgaagttgttatcaatttgtagaattcaaatgttgctataactattctgatgaatgatgaaggcattattgtgacaagaattaaattcttgtgttttcataatgagcacgtcaagaattctaagtgctgttcaataagtatttcaaactgcatgcaatgcctaatttggatatggaaacacaaagggtagttaagtttagcataccaaagcgcgattttcagatggatttggtgttggtgaaatagttgtggattgtggttctctctttccaaggcagtaaaaattgagataatcttgtggatgatactgatgagagagacctgctttttcaagggcatcagctacaatctggtacatcatagacattgtctgtccctatagtcatccaaatttcaaatacatgggttgtgataagtacacttcaatcatatttgttatgccaaagaataaacgaaaaacgcagagataaaaagaaaagaatacatatattattgtggttcagctaatgtgacctacatcacagacaattgagtctcaaacattgaaacaatgaacatccctatttttactctaacatgcaagtcgataaatccatttacattctaaggaagtacataaaaaactggcctcataattcaggacaactcgttaacaaaattccaggcctcaacgatattcataaatttgtgtcacttatgttatgtacatctattaaatattgcgaatatcaaaccccagattcatccttccccttatggtttgtgagttcattttcttcaaccaattgaaggtgaaagaaaaaaataagtctatgccaatatataaattgaacgaaaaaatgatttaggatggcagtagaacagtttgaaggaatttttttgttgttttttttttttggtacatagtagaattttaatgacaataagtctgttgcattggacaagtttgcagtgattgtggattatcattaaccacattgcactcgtttccctcaaaaaaaatccattaccaggtaataatatataagtttgtggaagaaacacgttctaccaaactgacttcctaatttagacagactcacatgaaaagtactgaaaatgttcatctgcaaattttaacaagggaatatacagaatagaaattggtctgacctgccagaacaatatttcttgaacagcagcacttgttggaacaccctctggccacattggtataactatatatacacaaaaacgttcatttgcaccaatcttaccggcaattttcaaagccaactccatgggaaccaagtggtttgcacctgttaagataagaaataaaaaccttacacttgcagtgtatttgtaaaaactacagcaatgtgtatctcacaaattgacttaatattcaaatgctactgaaacttaggatcaggagagtgatatagttcccttaaatgttagcaagaaatatgaatttgtataatgtatgcaggcatttgaaaacaatattacaaaaagagaaaaaataaagcaataataagcccttcaaacaccttttggtgcacaccatatttacctaataaattctaagataagaaatctaacatggaaatgaatgcaaggttgcagacttatgtctttatctcctccttttttctcgcacatgaaccatagactttattgacttttactgaaaaaaacaagtgtatccttctttcaattttcaacttcctctcttaacatccaaaactccctctaatgccaagtctttatcttggatagtgacacttaacaggattaatatacaaatgatttgttgtatattcatgtgcctcccactaacctgtcatggttgttccttcatagatacacaattatatgttctgggtctgagacatatatataggtacattacctaaacgccagaattttgattttgtaacaacgcaaaaactagcaaatgccttataaagttgaagatatagaaaaattaagtttatctacctgcattgtttttatatgaaggccaatgataggaggagcccaaaaaatactgattctcaatatatacaaagtgctcagcggatcttattgctctcacataagcagtatggatgctttgatctactttcaaattttttccacaaaaaagattctgaaacaaattaatattaaaagttaaggactaatttatctcaatatgacttgaaaccacaccccaatgtgaaggtaatgaaaataacaagaactcataatataaaggggcatcacgtataactttgttctcacctgagccttagctttgtcaacatccttaggaaatcccttcacggatcctgaatctatggacctaaatatctgtattaaatgtaaattctagttcataatctttacttgattttatcaggggcacgtgtacatcacagattctatcaacatatttccatacctgcacattccaactctctggatcattttcatcggttacatgaacagatttatcgccgttggaacaaggagaaggtttgacaatccatgaaatccggtctagccttagcaaagcatcatcatgccaatttgtcacctttttgagcctgaagtcgcgccattttttggccttcctccatctttgttcaaaattggtcaatatatcatatgctgctggaccttcaattttgcaatgtaagtcatgccatggctgccttggtgcacacgaatttgaatgtaactgtttcatatagcacacaatttcagcaaattcccttatgttatttttttctcctttatttggtgctgatgtgtgcatttgttttccttctcactttcacccataaaaaccgtgaatatcaaaccatagcatatactatgtgtatataaacattgacataattgattttataatgacatatgaacactctcataaggcaaaatcaccatataaggcaacattgaggaccaacagataaactagcaaatgaagtttatcaaaattaacagacaaagaagaagatttgggaaaactcaagcaaaatcagaaataaaaatttggttttgtttagagcacagcatcattctttaatctatttaccaagcccaccccagttgcaaggctctcgcttcttgttgtcattattgttgacaaaaatcagaacacagaaaaagccagaagttggtattagtatctttattccactgtatgcacataaagatatgttttataaaattccctagtagtataataaaagagaaggcatgctatattcttgtgaattcttcaatgtttacaataaacacttacttgaaatgtaggattatgaaaatcattatgaaagactgtatctagatcacgaaaaagccgatgctcaggtgtatcatatctaccatcacatagatccaaaccaccaatgaaagctgttattttccgattattcccagaacctagactgtctacaagaacacatttctggtgatgcgtaaagagggttcccacaacctggaccagatgattcaatcaaattagtattgttttaagttatagctaaagtacacaacgtgacctcattatatctatgactactactaaatgcaagtcttccagggaagaaataatgacattgatggtgacatgaaatagctagtatctttatccaacacaattctaaactcaaatgcaagaactccgtgcctgttgcttgaaaatactgagcttattgcttgcatagcgtggagatagcacacaatgaacagtagaatgtttgaaaaacttcttagtttcttcatcatgagtctgcatgacaccatcctgcaatcaagaaaatcaaatattataatgtacattaatattaaatcttagtgaacaggagtaagtacaaagtttttatgcaaccatatctacattacaataatccatgaaggaaatatctgctaaaacttatattttaggaatcttgaaagcctagcatctcattactgaatgttaatggtgcatatacaagatagtctaagcaaatccacccccataaagaagatacatcaccactatcttttacttcagaacccacccaattttatgctaaataggacttttactttgtattactttatggtatgaaagtaatataatgaatttatttggaaagcagtgcaataattcaggacaaataaaaaactaacttccctagaatttgatgagggaatcaattgacatcatgtttatttttctgattagggtaatgagaattactgttttcaaaagaaacttgtcatgtgaagttctgtcatcccaaatcagcataaccactcggagcccttcttgtgacttgtacttcaacagctctccaagtgaaagctctcccccagaaggcaatggttttgttgcctctctcacaagcctcactgggtggtaaactgaccatcctataatgtatatcaggtgatgagcttccaaaattgcatggcatatgtcctcccaacatttattatgctgaaacacttttccaccctcaagtcgaatttcaggtagcataccatcaggtaaatgtgcatcttgatatagagtcacactccctcctttcctgagagggaaatatgttttaggaactcctaatgcttttccatccccactactaatactttctgaacggttcactccaatttgcctatactgaacagaaatatgcaattcaggataaggttttaagcagtttccatactgaccaatgataggaaaccaatcattaacagtatttcctgcaattatcttctgaacaggtatctccaccactccaatgagttcagccccaagaatatcattgtccttcacaaggaactcaagtttttgagcagggtgagcaacaggcacaataaattgctcatcccacaaagggttctcacagttagcaatcactctagtctgagcaatggtagccccagcaatgcatacagaaacataagggtcactagttatcatcttgtcttttccagagtgtgtctttagtccttttataaatggagggtggcacatgttgcccatagtgatgcattttctaactgtttccgtggataaatctaaatttggaagagacttggcttctattatcaacagatccaagtcaccatgtaagaaaaccggtccattaaggccttcatgctccctgtttggaaagctttgggaaataccaccatgacaatccatttcaacctgagaactcaaaaaagatgcatgttttctaaattagaacactttgttttcaggtgctaaaatccaaattctagatgcaaaaagcattatggaaaatggtttcaaaaatatataacatgcatgttgatcaccttatgatcctttcagttatttcacatcatcatcttttggttgtaaggaaaccatgcctcttcaacaaattctcagaggtcagcatctttgacaaagagaggagcagaagccaatgataagaaataaaagtaaaaaaagggaaaagaaaagaaaagaaaggaaatttgtgtgtatatggattcatgtaacaatgttgcagttcagagcatggtccaacaccacgtccagaagaagcaggagagaggtttttaggcctaaaatggtggcaaatctcgtggaattagaagtttggaacccatctctctcttggtttttcatttcctgaattggcatattccaaacgaaatccatgcatgggaggacaaaattataaacaaatatataaagaaagagattggtgaggtggaagctgatggagagaccgagagattggagacattttgcatggaaccaaggaacttcgtgctctcttctagttacccctctctctccgatacacgtggaaatgtttaataaaaggaaaaaagattaatctatttttaacatcatgaacatttttcacatttatgttttttctccttaaactttataaggacacttaacatttttcaacttttcttccattatatttttagtaatttttatctattttattattattttaagtaatttatcacatttattaacttagtttctttctttccatctctctcttactcttccattcatatctcttttattttgaccatcataattttcagtctttttcctatgttttgattttaaatccttaattttttttttgtctttgctctcaagtaacaacaattttaaatgatgacttaacaacgacgttgataatttattaacttgtcatgttatgacaaatagtcatacaagtttattttaaaaaaattgtgtttgtatgtcctcatatattcaaaattgtggacaaattttatatcaataactaaattaactattttttttataaagagtatgaattacttgaaagagtattgtatgacaaaagaaataataatatggtgagaagatgtgaattaattgaaaatatatattaacattgttcctatcacttctcttgttaataattatcagatatggttcacccatattttgttcaattactatcaaaacctatacacaaaacattacaattgggctagtcatgttacttgccaattgttagggattttcttactttaccatttgaatctcaaatgcaccattcaaattttgtctaatttcaacattgtccttttgtacttcttcttccttcctttcgttttccatttcttcttacaccattcagtttcctcttcttattttgctgacctcctccttccattggctcttggaggtttgttagttacattgttgtggtggtttgttacatgttgcattcacttcgtcgtggtggtggtgggtgttgcggtggcaacatcggaggtaagttttttacatttgcgaaatattgatctatacgggtcatacagattgtcaatacatttgcgaaatattgatctatacgggtcatacagattgtcaatctgtataggttcaaaacaaaaaaaaattatagttaatgaatttgtattatattaacacttaaattttcaaatataattatgattcatttggataaacaatttaattaaagacttattgaatgagtactcatgaaaataatttaaattaattgtttcatataagttgtaagatcttttcaaaagctattgtagagaatttattgaaataaatttaacatagcttaacatattataatctattttcataaaaactttcagatatttacacaagtgtttgtcaaaaaataagttcaaataaattcttttaaacagactttaaataagagatttgaaatgtacaactatgtgatcttatcaaagatacaactataatttcatattaatcttttagttttgttggtacatgatatcaattattagttccattaattaaagattatagatctaggaaaaaaatctcaagaatgaaaaagactaaatactaaagacaattatcttgccaacatgcttaataaataattttcctttgctatttttgatgcaattttagagcgagagaataatatttaattaatgatagaaaaagttttcaaattgaaaaaatatctattaaatattttaagaaattaacctaaaactcgtcaaatatcaaactgtattttactctgcttgattaattatttaaagttaatttaaactttttttactacatttcttaaaatatactacatttaataaatactagtatagttttattttcaatttaagagtattttcttgaagttgtgggttgatttgaagtattagactaatagtagggcaaatttttagattatgattagaatgagaggattacgtcaggctttaggcacacaggttagtggtgatgaggaagaagccctcaacactgaaggctgacaacatcgacacgtaactgttgttgagaatattaggcatgtggatcatgctgccaaagagcctcacaatccagttacggaagatttaggtgttgattcatagggtttttcaggcgggccctaagatacatcagtgttgacatcatatgttgatcatgtagcagctaaagtgtggacatgagaggtagttatttctttaattataacatttaatttttttgtcattttaatttacctaattaattataattatttgcaagaacatattgacttgaagttggcctctcatgggaggaaggttgagaaattaggaagacctgcacctaaattgaagatttagtggttggttcgagcttaagttctctaattacatgttcattggagacaagagacagaagacttttgtctgcttttgcgaagagatgacacaaggaaactaatagttttcatatgcccatagaagagatgagtattagccttgatgatgtggcatcgttgttacatctgcccattataagtgccttccatatctatgatgcaatagatgtagagtaggttgtagaattgttagttgagttgctaggagtgactacacaagaagcataagatgagacgcatcaatgtagatgagacagagcagactgtggagttgttagttgagttgcttggagttgttacttctacccattatatgtgccttccataccaaatgacatgcattgcttaattttattgcatccggttgtatccaaaatatatcacatacatcttcatccttcattctatgccaatgaatatatatatcgagttcatgtaacttcattaattgttacattttagtattactgtctcttatagaagaatgatatgcatatcttgcattgtagaattgcttcattgctgtacaattgttggcattgtggtccttcaaagttaaaagaatattttttgttttgaccatagactttgtcatatcaccaacaataatcttttcatcctcaattaatcgaccaacatatagatgtccactcaatgacttagtcaatgcatgattatgagtaacacatattaagttgatcatccacccttcacctcccaggattggtttcgctcacagcttgacaaccacattttttagtgctagtcatcgtctgtactaaatctatcatgtatgctctatatttttcactcctctcacaatcaattaaaacaaatgaggtctttcctctctttccagttgatgtgtcggacctcattatcacaaccacaaaaccaatatcatacgcaacaatacgagcccattgcaatatgtcatcatgggtagggaacacctacaacaaggacaatacatgtttcgtcttgttaggacatttatttacttactttaactaaatagaaaatcatatcaatacttgagacattagaacaatcaatattgttaaccacaacaggttcctctcccctatcttcattcatattaatttcttcatacataatgttctcatatattcactcatctttgttcatcttaacaaaacattaaaaagaaaaaaatttcaatgacaaattaagaaatactaatgaaattcgatactatagcccatacggattgacatataataattgatacttgtatatacatataataataatttatctcttaataaaatatatccattgttattacttttaattaattctaattattttaaaaaaaatccatatattttaaaaacttcaatgtagaaatttattttaaaatcttttacacttgagaaaaaatatcaatgaaacaatgaaagatactaatgtaacatgtatgtagatatatcaataaatatatattttaagatatagtatgacacaattttattatttttttggtacatcaaattttttagtttgtacatacaatttgtttttttttgttactagaaaaaatataaaaannnnnnnnnnnnnnnnnnnnnnnnnnnnnnnnnnnnnnnnnnnnnnnnnnnnnnnnnnnnnnnnntatactaatatagtaatatattatattgaaatttataaaagagtgcgtacacacacatatatataatgatttatatctaaatttccatatttcattattattttaaatatattataaataactattttgatacttttatatatttaaaaatcaatataaaaatttattttgaaattttctagacttgaaaacactatttatataaacatttaatgttattagtgtaataatatttatacacatatataaataaataaaatttttcttatacaatatgacctatttttgtaatttaactatttctttttaaattcattacaattttttttaaaaaatttataatgcttatacatattggtaatccgtatagtctttacatattgacaacttgtatggactttatggattgtcaatttgtatggacaatacggattaatatttcacggattagtatttcacatatgtaaaaaacgtatgtctgtcgttgtcattgcaacacccaccatgacaatgacgatgaagtcaatggaacaagtaacaaaccaccacaagccaacacaaggaggatgtcagcaaagtaagaagaaattaaatggtgtaaaaagaaatggaaaacgaaaggaaggaagaagtaaaataaaaaatattgaaattaaacaaaatttgaataatatatttgagattcaactggtgcatgaagaaaattccgaatcgccaaaattaaaattaaactcttattccaccccgacccattaaagaggaaagaaaaagattaagaaaaactattgtgcataaacagtaagaaaagcatcatcaaactaatgaattaaggtgcaacaatttcacttgttatcgcaaatatgacaaagtaataaactcacacttcatgatttcagctagctaactagccaatgccaaatcactataacaaaataaaaattgaacatatagatagaattagaatagcaatggataagattacatcatatatatattgatcattcgatctctccctccttgtgtgtctcaatgacaacgtctgacctaggttgagcaacacaggtgagaacccagccactttctatttggtcatcatcaaggaagctaccatctgactgatccacgttaccttccacaattttgccaacacaggaaacgcaagaaccagacctgcacgagtagggaaggtcaatgccttcgtcctctgccttgtcaacaatgtaaacatcatctgggcattcaaactccactggtccttctggggttatgagcttcaccttgtacgaggccatgcaagtgacacgaccacctcgtccacttttcagaccaaaaagagattcaccaacgttggggaatgtctttaggcttgtggtggtcataggttgcctcctcatgaaggaggtgctcaccatggttccggatagagctgctgtggtggccattgaatgcacaatgaaatgaaaaacactggaatatgctatgcacttggtttgtgttttgtgacaacttattaagggtgtgggcttgtggaaatagtgtgcttgcaacacataacaaggtgaagttgcatccaaccctatctgccacgtggcagcattgtatgcatgggtttattatctcctttatcaccacgcaaatagtggttggcacaaccctcgtatcattaatgttcaaatggaacaagttttttgtatggttctgacttaaacaagtttatagccattggatgcaagaggtctatctacttgaatggttttcaaaactccacttcagtaacaggtagggaattacgtacatatgagagccacaaagttcagaaagcaactcatagttgtcacagcagcaacaagatcgaaccattgttaattttataataataaactaaacggtaaagacactacaaacattatttatcatttaaaagttaaggaagcagataagaatgatattcagatgttcatacaaaattcatttccgagacttcatcccctctttacatatattgaatagttgaaacccatgttggggaattagacatcagtccttcaagggacccctattttataaggggatgaaacagtaaccacaagagttgaatattgtactacttatctaaaattatgaagataatcaattacagccggggaaagaatctcagggcttccccaatatagaaaaataatacatcctcattctcaaaaaccctgtggattctacctgtaaacattgttaggttccctacacatgaccagaggcttcctccaaaaatttattgtcttcagcaacaaacctatggaagtgctcaggtctgactcagaaaaccttaatcgcacttgatatttctgtagatcctcctcacgaacaaatttgaacctagaaaacccacagctcctgcacatttaaagataaattataacccaagtggggcttaatcagcactagatacgatatccaatcacataagcagggtgaaaatctaaatcaaattgaagaagacttaccacatagaattcctagtccaagagaaaacattaaagtgtatccaaaataaaagctggtctggaagaagcctgacatcttcgtcttcacatagaagtagtatattgagtacaaatacacataaacagctgttgaggcagctgaaaagaaagaagtccattgccagtggtagttctcagcatttaacaaaaagtatgtccccacaattgtcacacaaacggtaacgatgataagaatcagaaagactagcagcataaagccatacacatagtacacctgtatgccacaaagaaagaaaaaatatataagccaatgtgaaggttcacccagcttccactaaaatttacacatttttttacttaaaaagaccagtttctagtattattttccttgataatgctctgctcttttgacatgcgaataacttttataaccaaaccaataagtaaaaaagaaactttatcacagaaacaagtcatagtagtgccgtgattcaccttgtaattccagaaggaagtgaatacaaaatacatttcaatgaatatgctgccaaagggtagcagtcctcccatcagagaaaccacagagggtgtaaggtaccacttcttttcaggaatgggacgaggaatagtctttacgcgacagggattattcagagcaccactccagtttcttccaacaactgtgccaagaagtgctagagggaaggagatgaaagcccaaatgacaaaaacaaccaccattgtgccaaatggaattgctgctagagacccatagaatatagcgattgtgttcaatataaatccaattccaaagcacatgaatgggaacagagaagctgtaaggatcatggatttaatccagtgtttacctaacaaacagataaaaattagttacataatcattgaaaaccaaaaagagaagaccgagacaaagccacccaaacacacttggagcgaatatacagaaaattaaagaagattcttacccccatttcgggagtacatccccccactcacataaccagaaatgaaagatgtgagagcataacacacaatgaaagtagtgacaatggctcctcgcctgagacaagcaacgaaggaaacttacatgataatcaacgaaagagaaaggagcaaacaacagaaagtattccaactagtatgaagtagaaatagccaactgtgcaagcactgccacatgcttattacatctagtaacattagtacacgactaggttccaatgaattcattattcaaacttatgcttcagtcagttgaaggttatgcacatacccaacatacaacatcccaacaatagccaacaagacgacaagaagaaccagcaacgcaagctgagcacctgtgccaacaacagctgaaagaataactaagttgcgaggaggccgaaaaacatcaccatgcacaagtttccagccagattcttcactaacatctctctcctgtaagcatggaagaaatgaccaaatatttgacaattagaaccacaatgctttctctaggaagaaaggattcatattccacaaataattaagataaaagtcacgaaaccatcaccagactttccaaatcatcatcttcccgagcatactttgcatagtcatttctcagagttcgcatcaatatcattgacaccaaaccagtaaggaagatgaccatcatgaaagagttaaaaatggagaaccaatgaatctagggaaaaagaaaacaaaggagcaaaattctcagtgacagagctatggtaggaccaacatggatgaatgcatagcaattcacaaaaccataaacaacaccatttcaattttaaaagcaaagctgtacctgatgctcaaagaaaggatgatccaggtagacatcaaagcgacgcccgaaagtgatattggtagaatcccatttgacagaatatgtcatgtccaaatgttttcctacttccaaaggctttgggatatcctgagtgagattaacatgaataatctgcaaggaaacagaccttaatatgaaacttaaaggatccataacatgtcataagatagcataagatatttaagtaacttctaacctgatcatggttgtatttaacaataatgtttttgtgtgtataaatgacatgcttgccattatcactgttcttatcaggatgtaactcaccaacatatccttaaaatgaaaaaagaagtgtcttagataaatgactaacatgttaagtacaaaatcatattaaataaagagaaaggagaagaggcagttctggacataccccacaaaggtagatcatctgaacttgtgtttagtgcatcacatagcagaccaaaagaaataagaacagatgctagtaagtaattcagttaaaaaagaaagagaattcaataattattaaattatttaattaaaaacatacaaggaagatcatcctttggaaaaaatcctcacaacattatgacaatcaagacagaataatatcgatgattaattaacactaagttattgaaaatacttaagaaattacttcacacagagttcttaatttaatactttcagttgtaatagtgactatattatagaaattaacactcactaaagtattctagaatgcttatgaaaaactataagggcttacttggtagacaagataaaatataagaataggataggctaagaccataataagcttatatactattcaatgtttgatgtgcaccaaataatctattatatgatatttatgctaccctttgctatgtttgaggtgaattaggaaatgatataaaatataaatgtaaatgacaatattacccctttgcaagatactaatatataatttatatatatggcatatatttaaaaatactatatatatatatatatcataatatttataatataatttttacaataatttttatatagaataagcataagatattttggaaatttccatatactttaggtgttttctggttgcttctgctatacattttgatgttgtgtttattttattcttcatgttaccgtactgaccaaagaaataattttctgcaagcttccaacatttcttgaaagtacaatcattctacaagttgtcaattgtcatagtaataagtgaaacacacaaagcaaaacatacccatgaagaattcaaaccagtaattattctctattgcatccttgaactgtttcacctttgcttcatcgagatctatctggcaaaagacagtcttatccacatttcctgaaaaacaatagcatccattaaagccagtttgccaaccgactgctcttctatgaaatacatagtacgacagaaaccttcatactttggaacttaatttcaagttggctatcgatgagctcattgccacccaggacctcaccaagaccaccccatttgtgtgcagcacttgcactactagatggatgacaaaatgggaggctgtaatagttgtatgtttcttgtggattgttataaggaccaactttgttcacccaaaggttaactggttcatcatgttgatactgcaacaaaataaaatacatccttttaaaaacagaagctgttcaccatttgatactacaaatgaaatatacatatttaatctgtttcaccagctcagtggggaaaaattccaggataacaaatatagtataggggtggggataagcgtcacaactgactattatagaaagaaaaagagaagaacaacatatactaagttattgacatgattaacaatttgatttcagttcactgaatgataatcaattatataatctatgatagtcttctgggagaaatattaagacaccacacattggcaaagcttaaaactctatattttaaaccttctggcaaacatgtaatgggtgtccacatcaattggatatcaaatttatgttagaaaattaaaatccagaatctttgtctaggaagccagttgtattcagagaaccagataacaatgttattagagtaaaaaacatgcaactcataagatgatgtgctgatcttaaatattacttaagtactctaaatcaaactgatccaccattaaaaacttcttatgttagggtagaatttgatttacaaccttgcccagagaatcctacatattacatacattcaattagttacagatcaattttttttcatcagaaccgttccagttctaaaaagaatccatcagacagcagatatgactagcaactgttaaatttgttttaaaaactttgaatcttaaaaatggggtacacaaatagggctataattctccacatcaatcttcacaatactgaaaatagtacagatagataacaaaaacctatatagcttccatgttgacatcacaattataaccaaagacttctaaacaacaccgaaatttcttttctgttctgtccaatttcagacaaccctcttttcacacatctcttaatgggtccttctatggattcaatgacaatggatgcacacaacaacaacaaactaggtaccaaagcctaatcacaatgtaagctcttcccacttcccacgtcactagtcacaatacagcctctcggcatttcaaatcccctccaaaactagctcagcattaattattataaccttaaaaaaaaaaaacagatgatccaagatcatgaactagtaaaaggggacaaagaagtcaaattgaatctaattagcagagaaaaggccaaacaatgaacagcaaacacccacattgcaaagacacctaggtgagcacaagccaaaaacccagttgagatctaacactaggaaaacacaaccattacattacaatcttaaaaccggaagaaaaaaaaaatccgaagctaagagattgaaattgagtgcaagtaagagctaaaaacgcacgcggtaggcagatccaaatcccaatgcagcaaagagagtgtagatcgaatcgaaagaagggaaagggttttgtggaatgaggaattaccttgtgatctgactctgaagcgaaggcgggagaaaggaagagagagaaaaggagcgggaagaggagggatcgggattcgaagaacatggcagtgatggaactagaagagagaaagagaaagaagagacaacagaacaacgcaacaacagaggaagcacgaacggactataatggtaatttacgttgtcgacgacgaaagagaaaataaggttacgttacgactacactgaaatgaaatgaataatgacgatgagtgcaaatttttttcatttcattacggtttttggggtaatacggtgaaaccgtgttctgtgactttgacggtgaagttacatcttgggctatttggtttccaatctatagtccagtacgtgagttacattatggcccatgtattcagtattcacaccccctcccccaccaccaccctttttttcgtctttccactcctcacttttttttctattgtgaatttttcattccaccccattcttcacatttccctcactctctaagcaccctatcaagtctcaaccccacctccttatcttcttccagcatattctcactttctcttctacaaacacttctcttccttgttcctcattctcttcttcatgtgaggtttcgctaccttgtcacttcttcaacaacgttccctttcttaaattttttttacgtgtaattgatttgataaaaactagtttcgttaaatatcttgacaaacggagactaatttcaatcaaggatatttttgtaagaaaaaagtttggggtgtaaagattaaaaataagaggtgtcaatgacattcacccaaattgtatgtttgggggaaggaaagtgatctctacatttacaggaggggaaagttttttcattttatgtttgttggctattaaaaaaatttagataatttttttaggaatcaaaagagttatgtatattttaattatttaccatattatataatttcataaaaaataacatgatatttctatcataataataaaaattaaacttgaaaaaaaataagattctcgtcttccctaatgtaattttttttttagttacttgttaaaaatatttttgagaaacatcattttctatgaatgtaatttttcaaaataataaaaacatgagaaagtaagtttttcaacctattgttcttagagcctattgttcttagaggatgtttgataaggaagaagttttttcatacccaagaaatatgattcatataaatgtataaaatgcctgaaaattaatattaatataaaatatgtaactaaaattttttctccacttgaaaaaattnnnnnnnnnnnnnnnnnnnnnnnnnnnnnnnnnnnnnnnnnnnnnnnnnnnnnnnnnnnnnnnnnnnnnngtgacaattttttattaattgtatatcaaacataaaaaacataatttatactttaagattatgaaaatttttaagaaattcactaccaaacggcctaggaaaacaacatctctagaaatactacaagggcattattcaaatgttataaagtttgtatcaatgaaaaatctaaaattaattgacttaaagtcttgtatcatgtctagatggaaaaaaaaaagacactaataatagttattgcatcgagtataatttaattgttaaatatttattttatatatatatatatatatatatatatatattacttgagttaaaatgtaaacaatgatttattccacacacaaaaatgataactacgatttaattaaaatatttgaataaattaaaattttaaaaagtgtgaaatagatgcctggtaaattttctctaacctgatagtgataaaaatctgataaatatgaggtggagtttaatttttctttccctcgtattataaactcgaacctgagcttgtcgcaactttagtggaaatggagaaaatcaaactcatctcaggaccgtctcattgtcatgcccacgtaataatttcattctatttcattacaattccatttgattttttttttttttatcaatgttggaaaatctttataatttgctcaatcttaatgatttggttctgaaaatttacatttccttcattcacttgtaattactaattgcataagaaaatttataattactaattatatagatgtacacacaacctcggttaatagccacttaatgccgcaaaagtcgtttcgacccataaataattttttttacagtttgttattaattaaaaaaatgtgcttaccatgagattcaacaactaaaagaaaaatagattctttgttgggatccggaaattataattatattaagtatttttaatttctaaggaaatgattattttttaaatttaatttaaatatattataaagaatttaaatannnnnnnnnntaaaaacagaatttaagtataatagattgatagtatgaatagaaagggaaagagaggggagagagaagaaaaagagggaaggagaagtatagagaggagagatcagtgagagaagagagaagatagaagagaaaaaggcacgtgaggagtgaaaataggagataggtaaagaaaatgagcataaataattcaaattattatattttgcatgagatttaagatgttataattttatgtactcaaaatattttaacaaattattagaatttgaaatatttttaaggatctcattagtatgcacgtcaatcaattataaaatcttatatctttaaaaaaaagtttaagttttattttaattactttaaaaatcacaattatcataaaattttaattgaatgataatataatttttttacacttataccataatgtataacaattaaactcacattttaaatatactatccaaataatatatcttaacaccacaaattctaaattttcacataaattgaattactcacttcaattaatcttatctaaacacagctgattaaaaaaaaattatctaaacacaccaagtagttatagtaaaatttgattagagaatcaataattaagatcgtaattaaatatgttatttttatcacaattcttaatttatgatttttttatcaaacaattataaatgcctttatcataactttatctttatgttctgtatattttccagaacacaactgtatagcacgaagatgctacgtgttcactgtctgatcactctaactctgcaagtccaaggatatcaatggaggatgataccttgaagcagaagatcacagagatacaccaatgggagtggggtgtgtgctctgtgtaattgaaagagaaaaagctagagtgtgtgtgtacctttcaccaggaattaatgtgtatttataggtagattacctcataacgggcattggaactgctccctggattctcggcctcgtcctgcacgttctcaacgtccatcatggaccaggtcagcctccacgttccatagataagttattggcacgatcgttcataacaattgggccctggcccaaaccataacagttgccccccagcgcggttgccaagtatacttggtagccgggatgtacaaggtgatttgcaaacttcggggttacactcaaaccgactacaattgatcagactacgattggccgacttcccttgtacggaatctcatctatccacagtgtcccggacaacatatccgaccatgttcatccggatacaattctccacgcgttcggatacatactcctataactgctttattcagtctattttcgaaatcgcgtgaatatccgggtatacgaatacttccgactagacctttggggacatatgtattccgattctgctaaatgtaaatataatcaaatgtgtcgccagccaaacttccgaatagatgtggccggatttgccttggacgagtaatgtacccggaatggtttatggcgtatttgaaacggctgctggacttcctgattcaaatcggttactttttccgtccttaatggcaataaatgccttcattcgtctggtaatgattactgttgtcgtgaatttacttttctgcccttataattggacgtgcttttaccatgctacccctgcgtgtcgtttcattgtggtgactgaaccgtttcctttcgtctggcggttactgcaagttaccctcatatttcaaatttttatcttcaaaatagtttattcatgcctactctttcccttacttgtcacttctgcctattccctgatattacatcctctcttctctttcatcaacttttcgagtgttctcttgcatcttcttcaagttcccccttcattcttcttccattcagactccagttccccaataccacaggtaccttctttctcctttctttctatatcatttagtgttcctgcattatcttgattctgccaatatcaggattttttagggttgcatcgcattttctttccggctttttcttgatttctgggtttttcttcttcgcgttttgtgctcatatcgttcccttccccttcgagtctttcctgattttccttaattttccctaagaatgtctcctgaagaagaggcggagataaggaaaaaatttggccctagagccgcttggttgttgtttggccttccacttcctgcgagggaaagtgaaaacgacccccttcgccgtcacaccggaggttcctcctcctccggaaaacaaaaaatcaccacccctcttagcggttcggtcccttcatttctctcgtctcttccggttcctgtagaccctaagccaaaacccttaggcccagtatcaggcccaatttcttccaggactttatcttctttggactcttctcttcttgggcccaatattgatattggtaacccacaagatctttctttagtagtccctggtcgtcatcctaaccctccggttagcctctctccttcttccgatgaggaatcatcctcgtcctcggttgaagtaatggaggttgagtacgatgcatgtatggattgtgtgtccgaggccattcattatgttcaaataggttccgacgacgtcgctgattcaatctttaggtcatgtcgtcataaccccattttgcgtcctgcttccaaggatttgcaaccgggaccgcatactcgttctgtcgtcgacggggtttcggcctcggtttcttgtgattttaatgcgttacctccaggtacgttttgctaacttttgtttccccacttcattttcgtaggtataatgggtgttacttcggaaactatggacgagtctgcttctgtagagtcccattcagatgtgcccccagcattagcgtctaagttcccttgggtcacttatgaaatccttcgcatttcttccgtcctcgacctacccagcatagtgtcgaccccagtagggaagcaggatgggttcgcccttcaggctcccctacccggtgagccaatttgtgctcaacgggagggtaacaatcccaacttcttcttcttttttcaagatgtcataactcaaataggtattacctttcccttttcctcctttgagattgaagttttaaatcacctccgggtagccccttcccaactccatccaaatagttgggggtttatccgtacttttgaattattttgttcggacttaggaattccctgcacagttcccctcttcttctactactattctcctcatacccctagaacgggtaaggagccttctgatcggaaaggatggatttccttccgtagtcagagtaaacgaaaactcttcgatcctttttcagactccttccggggcttcaaagacaagtactttaaggttgccgcagaacctcatcggcaacccttctttttgtccggccccgagtcatctgatgtggaatgagtttttcctttgtattggtcggatgatcattacaaacaggatcattccaattattgttttgtcgaggaggagctttccgactcggacgcctcttctgttttcgtgatatctgagtttataggcactcatggtcagcctaagacttccgactacattggcagtggtcgtcgaaacggtctgctttgataactgcattttcttagtttacaattgtacttacttgtattaattgtaatgttttctgattgtagccggaatgggatcgcgacctcctcctaaggccaaaactgatgtcgcccacctctccaaaccaaccgaggtcaggggcaagggcaagaggccggccactgacaaacttggtgccccgtctaaaaaacgtggtcccccttcttacagggcgttttttgacgagggtacccaaggaacggcgttagacgcaccgcctgctccacagcctccctcctcaacaactctaaccccggtttcggtggtcgaaaccgtggatcttactgtggcgggaggctgcccacgtactacccctacctctgactccgagcatcttgaaacgcgggtacgctcggacaatttatggaaaaagggggttactgaagagttgatccgtttgaccaagccccccgcatacatgcttaaaccgggtgccccggtgggggaagaactgaccgaaatagttcggatcgaggagtatgccttccgcagtgcttctctggctcgggcgcttacccttgttcgggaaaggtatgtgttctccccatgaccttttatctctacttgtacaatgtatatatttctaagtattcgtgtcgcaggtacggggttgcagtggaggaaaaagatagagctttggaggaaaaggatagagccttgggggaaaagaataaggcctgtgaagaacttgtttcccttgaggctcaacttgcttcccttcaaacgcagtcggcggcggagcttaagcttttgagggaggaattacccaagtcccaagctgttgccgcctccctgcgggtagatttggcgaggtctcaaggttcccttgaagctgccgatcagaaggtggccctcctgacttcatccctcgattctgtcaaggccgacaaagaagcctgcgtccaggattacgagggtcgactagctgctatgaaagcgacctttcgtgatgctgccgaggaaggcttcagcaatgcccttgaacagatcacatttttgaaccccagggtagctatgactactgccgggatgcatttcttggcgtatgtcgaagatgggcaacttttcccccctcctgcatctgaagacccttcgacggctacaacagaagttttgtcgacgggagaacctactcttggtgcttccgttgatgccactgcttccgttgatgccacccaacctggtgccaaccccgtttctgataccactgcgccgcaatctgctactgactcccagcctccaccaaactgaagggccgggatgccggtttttacttgtgttttttattttctttgttgggcccggtgcccagaacaattactttccattttctttattgggcccggtgcccgaaacaattactaggttcgtttatatattgctcaagctctttacttgattcataaaatatcttgtgcgcgcatctttttggttccaacgaccattcattatatttgcatctattgcttattgttcacgttatctgaccataaataacttcactaatgaatctgttatccggcctgatcagggccgtttagcgtattatttatagtcgtaccataccacaaaatcgtatagaatgactcaatacttatggtaatcaataatacttgcatttatattcgttgttacgataacaatatgtgtgtccgagtaggatcagactaacacttaggaattacaacgatataacttattcaacaaagtgaaaatgatgtgctcagaaggtaggcttccgagttcgtatccattaacaatgtcttcatcgtgaaagaggaccatatgggctcggatatatctattccaagtccataccctcgataccgagattgcattgttctactgcctcgtgtacccttgatgaatagggaccatacggattcggatgcaacattttttggatccgtacccctattaaaaagaaggtcgacaatttcaactgtaatatttcttcaatttgtcggcattccatgttcgcttgaccggtttgccttgtaatgtttccaacatatacgcccatttgtctaattttttagtgacccgatacgggccctcccagttagctgctaattttccgtcctgggcatttttgtttccgacgtcgacacgtcgcagtaataggtcggtctccttgaactgtcgcggaaccacctttttattgtaggcgcatgccatctgttgtttcatctttaattcccgggcatgcgctgttatccggacttcttcaatgagtgccgactccaaagccaaaacttcattgtttgtttcctctcggtctcgcagcgtttgactccgtcgccatgactgttgtccgatttcgactgggatcatagcttcatttccgtaagtcattcggaatggggtttccccggttgacgattggacagaagttcggatcccccataggacataatataactgttccacccaggtcgacctggcctcatacattcgcttccgtagagcctccagaattgttttgtttgcggcctcagcttggccgttggattgagggtgctctaccgacgcgaaccggtgtcgaatgtgaagactagccatcatctcttgaaatcctctgtccgtgaactgagtcctgttgtcagttattacttctccaggaattccaaaccgagaaattatatttctctcaaagaatttttgtactcgggccgaagtgattgtggtcgagggggccacctcaatctacttggtataatagtctacggtgactatcagccacttcatctgtccttctgccggtttgaatggacccaaaagatgcatgccccatttgtaaaatggccacggcgccgagatggattgcaattcttcaggcggggataatacccttgaagcgtgcatttggcagttttcacatgacctcacatgttcggtggcatccgcgctcattgtcggctagaaataaccagcccggagtgccttcctcgttagtgccctgccccccatgtgttgtccgttaattccttcatgtatttcagataggatatattctactcgatctggggccacacataccaacaaagggctatgcaatccttttctgtatagctccccgtcaataatcgtgaacatagccgacgttcgtatcaaacgtcgagcttcgagctcgtcgtctggtaatgtccccttctccaaatagcttactattgggcgtcgccaatcatgatcggtggtaatcatcattatgcacgtcggctgcaacgtctgttgctgaattacggttcggttgttcccgggttttttagtgcttgccagttttgacaagatatcagcccgtgcattttcttctcgggggatatgatttaccgtaatctcgtcgaactcagacatcagttcttttactcggctcaagtactttgccagcaagggccctttcacttgatatcgtccttcgatctgagatgcaactaactgtgaatccgtgtacactttcacattcctggcttcctgttcctttgcctgtaagagcccggcgatcaaggcttcgtactcggcttggttgtttgacgttggaaagcctaattgcagtgagatttccgttgctactccttccggattctcaattataattccggctccgctccctttcttgttggaggatccgtccacgtatagagtccaccactctccgatcgtcggggtgtggggggtgagttctcggatgaaatctgccaacgcttgggatttaatcgcgtggcgagcctcaaatttccaatcaaactcggacaactggacggcccagtgggtcaatcttcctgccaagtccggcttatgtaggatctgtcgaattggctgatctgtccgtatgactatggtatggctctgaaaatatggacgcagttttttggcggcgacgatcaaggtgaagaccaacttctccaacttttgataccgcaactcggagtcgcgcaatgctcggcttacgaaatataccggcttctgcgtggactctacctctcttactagaactgcacttacagcttcttcgcctaccgacaagtacatgaccaatgtttctcctgcttccggccttgacaatactgggggcgacgccaaagatctcttcatgtcagtaaaggcggtctcacattccgagttccattctatgacggcctgtttcttcaacatcttgaagaacggcaacgccttctctgctgattttggcataaaacgtatgagggcggctattcgacccgttaattgttgaacttcctttttgctggtcgggaattgcatatccagcacggcgcggcacttatccggattagcttctatccctctgtgtgttaacatgaaacccaagaattttccggccccgactccaaaggtacattttaacggattgagccgtatgttgaactttcgtaatcgatcaaaggtttcttcaagatcctcgacgtgcttgctaacattcgtggttttgacgatcatgtcgtctatatagacctcgatatttcgtccgagttgcgactcgaatactctattcatcatcctttgatgtgtggcccctgcattcttgaggccgaatggcatgacgttatagcaatagttggctttgtcgcctatgaacgccgttttctcctggtcgtctgggtgcattgggatctgattgtacccggagaatgcatccatgaaagacaatatcctgtacccggatgaattgtccaccagttggtctatattttgtaatatcactaaatttaattaaggtaatttgggtgataatttcgtaattaaacgaatttacgaaagggcagtttggtctttgtcagaggggcgggtgcagttagtaattgctgaacgcaccccctgtttcttgttaaaagccagcagatacgttttctgcttgttggcttcttctttttttcttcttccttggttcttctcttctctcaagccctcttctcaccacttccatgagattagtggctgaaatcacaaataagctagaaagaaagctctttttccttgttcttgttgctttgagctttgggtgttggtgatttgaagagaagagtgggtttcaaatctgcccattttcgtttggcgccgctaaactgcgagtgggagccttagagtgctggtctaccctccaatttggtctattgaatcctaaggtttgaaatctcctcctatttcccctttattcttgagttagggttagggtttggagtgagattaataaatgctgagttttaggagggtgagacagttttgatgtgtgatttggagtgggtagaagttgtttttaagttgaaatggtgttccatgcttaaatcaagcatgcaagttcatgacagccaagaacaccacttgggcagttctggtgttttgctcataacaggagttatcggtgtccaaatggtatgaaaccggttccatttgaaagctaagagagttagcttcactctggaattttcgtgctatttttggagtctcctagaaattgtggtgcagagttataacaggctgttatgctctatttttagcatatttttctgctgcagagaaccattttgcagaaagcataactttttctaggatgatccaaatcgagtgttttcagtggctatagaaatatgggtatgtgaaattcatgcctgtaaaatatcagctcatttggacaagtaacctggtgtgggttgtcctcgaaagatggctggttgagttggtctgttgctgtcagcactattttagtgtgtgacagttctggtttttggtttgctgcagaggctgtggttcatggtttttgatgaaaccagttttgtttaaaagataagagatatatcttgatgcctctaaattctcgtgattttaggagcctcccacaaggatttgtgatttttccaagtgggtgtaaaacctgcagaattttatgcagcagtttatgcttttccgcatgttttgctagagatttatgcgttgtacggatagaatggtatttgatatgtgattgtatgtcttttaggacgtgagtccgataccgttggtggtggtagccacgagaccgttggtgattttaggagcctcccacgaggatttgtgatttttccaagtgggtgtaaaatctgcagaattttatgcagcagtttatgcttttccgcatgttttgctagagatttatgcgttatacggatagaatggtatttgatatgtgattgtatgctttttaggacgtgagcttgatatctctggtggtggtagccacgagaccgggaaagccggtgtgttgcttagagcaggtaagctcttggacattgattgtgtgtcctttgcttggttccaacatgctccagatggagaatggttatattgtgatatgctgtatgtgtgtggcacatgtatgagatgtggaatgaaaccctttgatgagggagtactatatatgtatgtatcgaatgtggtttgaacccttggatgagggatgattatatatgttgaatgcgaatgaaaccctttggtgagggaatgttgtgtaatgcatatgtatgcttgaatacgtggattgaaccctttgatgaggggattatatgcattgattgtacttgtatgacaggtgagttgaaccctttgatgagggggataatatgtgtggcctgtaatggtttgtcatgcttgaaatgtaaactgaacccttgatggggaagtattatatatattgtgtatagttaaaccctttgatgaggggatgtgatatgtaatggaatgttgattgaacccttgatgagggcatgttatgtatgaatgtgtagtgaaccctttgatgggggaatgacttacaatgtatgatgaacccattgaaaggggatgatatgtgaatcctagaattggatgaatagtatcctattgtcgtaggatagatgattgagaaagacctggtaagagatgagcctgtgatatggaggtagcctcctacgaggagatgttcccatatacacagaagaagcctccccaggcaatggtagggtgatagaggatgagatggccttgggttacatagaggtagcctctttgatgagagatgttcctatgtacctagaggtagcctcaccaaaaggagatgtgtctgatatatatagatgagcctcgtgagatagagatgtgcctgtatattcagaggaagcctccgctagggatttatgcaggagatgtgcctggtatatagaggtagcctccctgtgaggagatgttcctatatactacgatgtagccttcgcatgacagttattgatgtgacgatattatgtcacgagtacagtctgattgtagtcaggcagtggtttataacctgattgtggtcaggtagtgcttgataacctgattgtggtcaggtaatgcttgagacacttggttgtggccaggtggatgatgatttgatattgtgtttgcttgatgatatggttatgatgatgatgttattatgtgttggaaagtgaaccaggggaaggaaataccttcaagggccctgagtttactgagattttatatctcaccccgtgtatggggctatgttttgcaggtgaatcatcgagcggagcggatagatcccaaggcaagaagcctatgcagggatagctggatctgaaaaccataggctagataacatgagttgtagctcatatattttgtatatgcctttggttttattttgtaccccatagagggaagttatgtacagttttgtataagacactacagttgatgtatattcaccatgacttatgtacagtgtatatgatgacggcatttgttgatgccctgtttatgtttattgtatgcttccaaactgcttaactctgatgtttatctgataatgatagtgcttaaggctaggtaatgacctcggttgtagctggggcgttacatatttgacatgggatatgcgtctttggggcacattttgttcaagtcggtgtaatccgtgcacaccctccatttcccattcggcttacgaaccattacgacattcgacagccaagtggtatattggtagggatggcaaagtgggccagcccacccaaaaacgggccgggctggcccaacccactaaaaaagtgggccgggccgggctggcccacttttgcaaagtgggctgaaaatactagcccgccccactttaaagtgggttagtgggccagcgggccagcccacttaaaaaataaaaaaaaatattttttttaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaagcacgaaatacatgtttaacaatggttttcaattagctcctaagtcttaacaaattcttagaaatttgcttcacaatgatgcagactatcaaaacataattgtacatgtagtataactcattattaggttccaaataaaaatgtattagggttaaggattcaaaatcattaacttctttttagtcactctccctctaagtcactcatttaattacctattaaatattttattattttttattggtgggctgctggcccggtgggctggcccacccctggcccacatttttgtgggccgggttggcccgccccgtttaatgaatgtgggctcaaagtctcaacccagcccacattttttcgtgggttaaacgggccggcccgccgggccaggccctttttgccatccctatatattggacttcgcgtatgaaaccggcctgcaacagctcgtcaatatgagcctgcaaggcttgagctctctctggtcccaacttccgtttcttctgttccaccggtttcgatcccgggtacattgccaatttgtgactgcagaactcgggatcgacaccgggtatctctgacgccttccatgcgaatatatcatgatttttctttaaacaatggatcaattgctccctcagttcgggttccaatgcttcaccaatgctggtcacctgatcggcctgatctccgatcagaatctgcgggttccggtctccactcatccggggcttctcgcatatccagttccacgacatttaccgaacgtacccggttggagctgtcatcgttggcttctctttcactttttcgaaccgtatcgtagtaacattgtcgagattctttctgatcgccgcatatggttaccacctgtctgttgctgccaacgaacttgagtttctggtgttttgtggacattaagatgtcccacttatgaatggttggtctccccaatatcatgttatattgggatggaaagtctgccacgacgaattccacttcttcagacttgtaagcttctctcgtccccatggttaaacgcagacggatagaccccatcacattcgtgttgccgccattgaaaccgatcagcattgttttgcacggccttaattcctttacatccaatttcatcttccgaaatgcattcaacaggattatgtcggcggaacttccgttgtctacgtacattcttcttacccggcaatttcccaccgttgctgatatcaccagcccgtcttcatgtccgggtaccaccccctccatgtcttgtttggtaaaatacaagagtggaggttctggctttccaatccgggctttgaatttgggttgtgcctggaccgatagcacttctttcaggtattttttttctttgagtggcagtatccccgccaccgcccatgcctcctgagattacgttacattcgaactcgggctccgggaactcatcgttatcttcccggggtttctttccttcgtctttatgttgattctcgtctcccttccgtttgttcttccttccttgtgtccgaatgacgtactgtttgagtcttccttcccggataaacttctcaactgcatcccgcagatcccaacattgatctgtggtgtgcccgggtccgttgtggaattcacataatcatgatttatccaatccggccttgttgaaaactggacggggttgttcaaccttcttcatctctgtaagcgcgacctccttccagatttgtgaacgggatacgttcaacgtagtgtatttctcgtacttgttttcgtatctccctggtcggagtttcgggtcattattccgagctcgattctccgggtatcccctatttttcggaggtgagctcctcctttcatgacgctcctttcctcgtccagagttgttgacgacctccatctgttccaattccaagtatttctttgcacgggcacgaaattccatcaaagacttcatcgggtccttataaatggatttggcaaatcttgacgaaccgtcgagtccagccgatatcaagtatacgtggactcgctcttctaacccctcaacttgcagggcggcctctttaaatctatccagatagctctgcagcgtttctttgggtaactgtctgactttacccagggtgaactcggatttcggctgctttttgctggtcgcaaaattcaataaaaatttctggccaaagtcttcaaaattctttatcgacctaggcggtaaagtgtggaaccacgtctgcgccgggcccgtcaaagttgtgacgaatatcctcgatattatgggctcgtcaatgccccggacacacatttgcaaatcaaattcattgatatgcacttgcggtcctgtgttccatcatattttgataggaaagacccatcaaagtcgtccaaatatctagcctttacaatgtcgtccacgaatggactattgttttgctgtccccggctatatttccgacgatacactggtcctgcttttttcgcgaaaattctattctcccggcttatcgtgtccgccgttttgcggaaccttctcattgtttgccctgaaaatgggattgtcgtcgtgtttcgttcgtatgttcggattttcgtcagggctatggtttgtgtcgacttcgtcttgtgcctcatttcgtgcccggctttgactctgatgcggctcatctgtcctcctttggtctcccgggtcgacatctcgtctctgatttatgtgtgtcctcaaatcttgtggctcctctatccgtctttgactctccgggtccgtacttcttctttgattcaggtgcatcctcagatcctgcgtctcgccctcaggatttgaaatttgtacccggtcagttatcattcgcagctgctgctccaattgtgccattcgttgcgtttcggcacgtctccactcctcattacgttcttccatttggcgagtaatgtttcaaatgtcttcttgtctctgtaaattttgtcgtttctccatgttctcaattcgggttaggattgaattgaggacattgctgacgagttgtcctccgagctccccctcctgacccatccttcgcactgctggagtcctctgttggtctgtctgggcgggagaggaagcttcgtcgaaaacagcttccgtcacatgtacttcttccctccgtgccacgttctgattctccggtaggcaaatctccctgttcggcgtctctgaatgtggtacagagtggctatttcttgtgtttaccattgtggaaaggtgtgggactcgaattttatcgtttccccacagacggcgccaatgttctgtatatttcccagaacacaactgtatagcacgaagatgctacgtgttcactgtctgatcactctaactctgcaagtccaaggatatcaatggaggatgataccttgaagcagaagatcatagagatacaccaatgggagtggagtgtgtgttctgtgtaattgaaagagagaaagctagagtgtgtgtacctttcaccaggaattaatgtgtatttataggcagattacctcataacgggcattggaactgctccctgaattctcggcctcgtcctgcatgttctcaacgtccatcatggaccaggtcagcctccacgttccatagataagttattggcacgatcgttcataacaattgagccctggtccaaaccgtaacactttagtttattatatttatctaaaaaatcttcgaatttagattattattcaattgattttcccattatatcctgagtttgaaacaacttcatcactattaatatatatatatatatatatatatatatttgcaccgttttttaataatttagctttataattttgtctcagttaaaaaaatctcacatcttcaataaagttatattttattatccgttttcctctattaagatacgtgattatatcactattatctaataataacgataatatttctatctcttaacttttttatttatattcacactttggaagatttatattgaaaagtatctctctaattaatgcgcgtttttcttcccgcgactgatcatttaacagcttggctatttatctatatatatatatcgattagagtttgattgatcagtgatttgtgctagtgcctagttagtagttattggctgatcaagtgtggtgttagaactttgaaaaagaaacagaaaggaaggtgtgtgtgaatatggagaagtacgaggtagtgaatggggacataggggttgggagatacgcggtcatacggcttatgcgtcacaaagaaaccaaagatctcattgccgtcaaatacatctgacggaaatacatctgacgggaagacaaggtaagttgctacttatgtaaacacctgtattttgttttccgaatgatttgatggaggaaagggaaatcataaaccctaggagacgaatttttattttttattattattattattataataataatattgatatatctcttttgtttgtaactaatatttattagagacaaacgaccgtactgccatggaaggaaaaaaaattaccgaaatgccacacgaccaaaacatattatcagactgtcacgtatcatatttcgttagacctctcagcgaactacacatcacataattcgctactctttgtagctagcaaggtatgctgatatgacataaataactactgcactttccaataaataattgcctccactttcctataaggctataatatatttcatccatttatttttgcatatctttttaaactaaattgaatggtaaccgacatatttttattcaaaataattttaaaataaattgtattattttacaaaactaatttagttaatagaattaattttcaattaaataaaaaaatatttgaaaaaaatcaaaccaactacgtttcaaattgtttcacttattttttttttcaaataattgttgatttaaaattgaaatatcttgaatcaattttaaatttataataagaattagaatcattttaaatagattttttaattttttttatttttaaatattttttatttagttaaaaattagttttattaactaaattagttttgtacaacaatacaatttttttaaaattattttgaataaaaaccgatattttgaatcaattttaaattgattataagaaatagatcaatttttaattgattttttttactatttttttattttcaaatattttttatttagttgaaaattatttctattaactaaattagttttttaaaccaatataatttttttaaaaatcattttgaataaaactggtattttgaatcagttttaaattgattataaaaattaaatcaattttaaatagattttctaaatgtatttttattttcaaatatttttttatttagttgaaaattaattttattaactaaattagttttataaacaatatagtttttttaaaatgattttgaataaaaatttgtctcttaccatccaatttagttgaaaaattttgcaaaaataaagagataagatacgttatgaaaaaatggaagccgttatttattggaaagtggaagtagggaagcagttatttattggaaagtggaaataattatttattatatattatacgtaattcgctactccttctagcgaattatgtgctgtgtgtaattagctaggaggtctagcaaaatatgacgcgtgacaatctggtaatatgttttggtcacatagcatttcggtaattttttttttcttccgtggcgtcgttgtctctatttattaggacttgactgatatttttaatgaaaatttttctttttaattatgtttttttcatctataatatttgaatttgagattttgtttaaggaattatttatttatttctcaaatatgggttaaaaaaatttcttctcacgtttattagttggtaataaataattattatttagtatatttagtgttcttaaaatcggtccgtctcgactatttggaccgattgggtcaagaattagtggcctaatcggatcggtttctttattgaataagttgtgtaattgactcgggatgacccgatcaaatccgaccaagaagatcaccaaatctcagttggactgatttaattatgccggttttataactttttttatttttaaaaattttattttttaaaaaatttggattattatcaattgttattttggattttggaatatagatagacttttcttaatcaaataatattatataattttaaatttttaatatataccgagataaaatgagtcaaatcaggttaattaaggacccaccgattagaccattggtctattacctcgatcgggtcaatgatcggatctgatttcacaactatgggtatattattcatttttaaaatatttaaaattatatttttcatcttatattttaaaaaaaaaatctcaaaattaaagaaataatctgtgaaataaaacgtgacttagatctcttgcttttaaaaaatacaaacacccattcactttaataaacattgttttcaaagcaaatttaacacttttttgcagattattgagaaggtggcaagggaaatcgtaaaccttagatctcttcgtcatccgaatattgttcggttcaagtaggtatgatctgtttttactctccctctcttctttcaaaatatttgcttggcttctattattataaaatatgaggtttaggttaattttcataaaagttaataaatttatcttatataataatagattgtgattgatcagcgataaaataaaactgttttatatataatgtcagactataatatattttttcataaaataatagcattgggtaagattacaaataatataagtgaaaagtataacagtgaataagttaaattttaaatgaaatcaataatacaaaagattagaaatattcaatgaataatattaattggtcattaatgtctttaaccactcgttatgtgtttatacagtacattagtattatgttgagataatttgttctatatggaatttgaactttgaaggtggccttgactcccacacatcttacaatagttatggagtatgtagcgggtggacagctgtatgaccaagtttgcaaaagatgtgacaaatttcacgtaaaatggttatggagtatgttccagattcattttggagtaagatttgacaaatttcatttctacaatgctatttttttaaaaaaaaaaattagaagatttaatatactttagagaattttaaggtgcattttttctaactattttattctgattaaaatgacaaaacataactcctatgatatcataaagttgaaatcttttgatgtcattgaatttcatgattgaaaatttcatgttcaatttgacatgaaagaaggtgacatattctataatgtgttaagtgattttacatatattattgaaaatgtgtatgaatattaatgaattaaaagatgaaactttttatggagattacttgttaaactctttaaatcttcgtctagctatatagtgaatataagattgcaaaggagatatgagatcatttgagcactcaattttaaaaacaagagagactttctaagagtcttctagtatagaagttctttgactttaagtttaatatgaattcaaacatcacttctcaaataagtgaacttgagaacatgaggaacaagctaaaagaggacaattttgattggtctattaatctttttgttggtcttatgttgagtaagctacttgttgaatgaaattcttttaagactgacatgcacagactaaaagaacagataagactggatgaacatatgggattggtcttatgttgagtacctactgaatggattatcagacaaatctcatatgttcatccggtttcatctgttcttttagtctgtgcatgtcagtcttaaaagaatttcatttagcagatagcttactcaacacaataccaacaaagagattaatagataaattagaattgtcctcttttagcttgttcctcatgttctcaagttcaattaattgaaaagtgatgtttgaaattcatattaaacttaaagtcaaagaacttcttccctagaagaatcttagaaagcatattttgcttttgaaattgagtgttcaagtgatcccatatctcttttgcaatcttatactcattataagtgatatccagacgaggatttaaagagtttaacaagtaatttatacaaaaatctttatctttaatccattgatattcatccacattttcaacagtagatgcaaaattactcaacacagtgtagaacatgtcacgttccttcatgccaaatggaacatgaaattttcaaccataaaattcagtgacatcaaaagatttcagctttatgatatcatagtagctatgtttttccattttaatcagagtaaaatagttagaaagagtgcaccttaaaatcctccaaaatatatcaaatcttctaacgttttttttaaacaacattatagaggtgaaatttgtcaaatttgaccttaaaaatgaattcgaaatacccaaaaaaccttaggaacgactttttttgttcgccagaaagtcgccggtcgctagaaaacaaaccagtcatcggaaaactgtagaaacttccaatgactatatctcattcgtccgaccttcgttttacgcaagtgaccagtcaaaatgatcgtctcggagagtagaacaaagtccgcaaggttttaactcatgaaatcggttgaaatttttgggatctggattcaaaggttgcggcaagaaagttttcaaactcagatcccggttaatcctttcgtcaaaacacgaaagtgataccacctttgagttgctcttgatgagatcttcgaaataacaccttatttgctcaaatccgacacacgaagctaatacttcaagattgttagaggtaaggagtttgagagaataatttagtgttggatgcttgaagtattacactaagagacatcaaatgtataatgttcaatagtgttaccttcagcaaaggaagaaccttaatgatatagtaaactattggactctaacccatatggacccatataaacatacattaacttatcatgtttgtatgtgaacatattatttatttattgtttaaatatatatatatatatatattaaatatattcaactaaaagtatattactgtatttcatattatcaatgcattttcataatgagtttcaatatttatttattaatggtataaccatatacagtgattaacaaaactgtattagaaataatagtggggtgaaaatgctaaacattcttggattaattaatataaaataactagagtatccaaaaaattgatattaatgggtatgttcggttagaataaaaaggttttgcacagttgattaattagataatttcaacgaataataaagaattagtttgaaagcttgtctggtagcatttctcttctataaaagtataatataataaataaattccaatgttcacaagtcatggttactgttcgtaatatgcaatttctttctcattcttcttgtgtatacatatttcaggctcgatatttcttccagcagttgatttcaggagttaattatagccacagcatggtagatgaaatacacattagtacattactatgagaacgaattgtaatttgttttcagtgtgttggtagtgatatgtttttttattttgtatgaaatatgtcatcgagatttgaagttggagaataccttattggatggaagccctgctaataatcttaaaatttgtgatttcggatattctaaggttcaattgacaaaatcatatataccaaccttgaatgcttaaacatataaccaattaaatttaaatatacattatttgataattttttcttctgacaagacaacctttacttttctagtcatacctacttcattcgaggcctcattcaatgattggaactccagcctatattgcaccagaggttcgtaatactacagtttctaactttagatcatgaaaaagactagaagattcatgttgtattaattatagactgatacaattattcaacagtcacttagcacacgcagtgacatttcctttttaaagtgaaatagaaataacatattttagtgactactatgaagcacttaaaatgccttagagttactgattctgacttgatgagtttctctgtattatatggtagttttgttcattttttggctgatgtgttactgttttgtacctgttcagttggcagatgtatggtcctgcggagtaatactttatataatgctggtaggagaattgccatttgaggacaaagaggataccaaaatctccacaaaaccataaaggtaatttgctttatttttttaatttaatttttatatactatcagtataaaagtttttagaccgtcaagtgtcaatcaatcagaaattatcttaagtatgacttaagataatcattatagaagtgaacaaacttatgtgaaatctctaatctctttacaccatttagtacatatgctattttactttttatttttgaactagctctgttgatagattcatgaatcatcatgtcttatatgtactctttctgactccctatgtgtgtgtgtatatatatatatatattatccagagagttatggctgttcaatacaagttccctgacaaagtttgcatatctcaagacagtaaaaatctgatatcccgcatttttgtggcaaatccagcaatggtatgtatatgaacatagtcatttaattattttttggagggaacattataaaataaaaacacttataactgtagcatgatattacttggtgtatgttattgtaactatgccttataattatgttgccgagaatcatcatgaaggaaataaagtcactacatccatggtttttaaagaacttgcctaaggaattgagagaaggggctcaagatgtttactacagtgaagaaaatacaaaatatcctcttaaaagtatagaagagatcatgaacattgtcaacgaggccaaaactacacctgcaacttccagtccaaatctataagagagattgattggggaagggaagaaatgataatgccgaggtagatgaaatcatttatgagaagcgagtcaaggaagcaccaaccatattcatttttttggataataaattagatttgttgttcacttatccccactaacttaaggtaaatgttttgcctgtatctatgtatcaaattttagttttatgacataaagttgaactgtacatttttgttgatatggtacaaagtttgtagttgagttgtgacagcattattgtgatttataagaggtcttcgttttctccctctgaatatgatgttatgttcagtcttcaaagcaatgagctatgctaggaatagatgacacattaacacatcacttgcctctatcttgcgcagtgatttagggtcagattgctatatctacatttatttggccttttcttggtttttgatttctttgagaagaaaactatataggggtctaattactagttgtggatgcaagtattatgattgttctgttaccattttagaaagaaatctttcatgaaagaaaatagaatgaagtaaagtcaaacgaaagaatttcattttttttcttttattttatcacaaaatcttcaaataataaaataacaatttaaatatatttcctggtgcattttctcattttcttcaatttcttccatcattaaatatccaaacatagcctttaatgcttgtttgacatctaaaatgcaccattataattataatttcagaacaatttcatgaaattacaaaataactaaattgaattactttcaatttttaatcaacaccttaaaaattgttgcatgtctcagaagtacaggtggataaaggttcgagcaataacctgacttgatttttttttttttgagaaatctgactcgacttaaagcatgaaggatagatgaggtagggtaaaaaatcataaaactcgtttagtttcagtcaatattcaaacctttccaatgaatattttaaaacctttatttttcaatgcaactacaccctattcagactaaacattaaaattcccaaaaatcaacctgatcctaacctgcctactttaatttaattggtttggaacaaaatgatccgtctgaccttgcttttgtcccccgaattaattctcaggttcatgcatatttctccatgttagatagcattgctagtccaactatagtactatacctacgtgttcatcattcttaccatatatcaatgtaatttagtcacacattaattctctttttcatggaagctgtaaattgtaattacatacttggtcaagattaatctcaattcacggcaagaaataaactgggaaacataaaaaaacacaagggaggtggtggtacgctatgttaggacatttgaaacgtcaacttcctttggcacatacaatgtattttcgcgaaaagtaatcactaatgctcctatttttacaacgcaaatgaagcactttttcacaaattttcaatggagctgccacggacgagactttgatagtgacccttattgataaagacaagcgtattatttacaaatgaatattggagtcgacattaaggggattatgcttggatctctttgtgataactgattacagaatatgtcatatctattctttcatgcttatatttgtttttgttatctttaatccaaggtaataatccatactcctattttttataacttttttatttatttatcattaacttcatctattataaatccaattagtttaagttaaaaatattattgatgttgatctttaactgattcttttgagtcatttatgcaatttttaaatattatattttttaatgaatttttaaatattataattaaaccttcggttattagctttctaaattcgaatttctgcaagaagaaaaaataaaataaaaaaatgactctgcccttgagagttcgagagttctttttgcttcatgcaagtaataattgggaaaagattaactataatcgcgcaacaaaatctttgcctgctaattgttgatatatatatatatatgagatgggatcattttacaccgtttaataattttttattggataagtattttacaaaatccaccgttagattgaaagcttatatcatgtagatcacatatatcaaatttcacaaaaatctgaaataatttgaaacctaatcaaaatagtctaatttttacataatttagaagtacatataccgttaatatataccgttaatttttatatatatatcaattaggtttcaaatgatttcggatttttgtgaaatttgatacatgtgatctacatgatataagcttttaatttaacggtggattttgtaaaatacttattcattaaaaagttattaaacggtgtaaaactataaagttttacaccggtataaaatgatcccatctttatatnnnnnnnnnncattaaaactacaatatttttctttttttttatcatagcattcatcatatatgttactttatttttctacctttccttttttcttccaatttttctctatctactcccagttcattccatattaggatggataactcattccttttcattaaggttaaatttaacaaaatattttagtcagtttttagtttttttactagctgaaaaactcgataaacaaacttattttaataacttcttaatagattctaacatttcttgaaatgtcatttaagtaatattttttaaaatgnnnnnnnnnnttatatatacatatatataggtgagatttgactttaatcattgcagactctatactagatatttttaacttgattgttcaacgagttacttatttttaaatattattactttttattattattggagatgatctacatattatattatattagattacttaaaattaagctaagatagtttatgagtaaaaaaatattttcttgttatttagagattctttaaggaaataatttaagaatcacttaaaattatataattggagtaaaatatgaattgtttattaactatgatgtgatattataatttataagaataaattaatataaagtaaagaatttaaaatgaattatttaaattatatcgattaaagatgttgaaagtaaactatttgacgcactcgaacggaattgaaagccaagctaattaatatcctaatcttgaggctaaaatactaaactgtcttcattcgttgttgttttatacaagttaatttacttttctgtttggatttccagcattatattactaaagtttgattacgagaaaaaaaattatggcctttaaaaagaggaggttattaaaggtgggacaattattaaaaaatcaataaaaatatagtatttgtaatgtaaannnnnnnnnnnnnnnnnnnnnnnnnnnnnnnnnnnnnnnnnnnnnnnnnnnnnnnnnagaggaggttattaaaggtggggcaattattaaaaaatcaataaatatatagtatttgtaatgtaaaagtttttgactatatcatttagtgcatatttggttagaggttactattggttgtcttccgtaattttggagaagcatcacctttattatttctatgctaaagtgcattggtattcccactatttaggttttaataggaatctaaacatattcttaattattgattgttatgcattataagattattaactcttataatcttataatattacctgtagaataaaatataagaaaaaaaataatatatgctagaaatannnnnnnnnnnnnnnnnnnnnnnnnnnnnnnnnnnnnnnnaaattttcttattatcttttttaaataaattatgatttcattatttttatgttattttacatttttcagctatttcaataattaattttagtgaaactaacttttcaactagttttgtcaaatataatctaagatgtatatgtatttttgggagttacaaacttgccttggtgatgatgaaaaaagaaagaagagaggaaaatataatttattcaatttcttttattaacaaaaaaaacttaacaattaatatttttctataaaagttgatgtttgcatttttattccctaaagtaaacctacactttaaaaaaggtaaatgtagagaagaaattcctttcattccccgaccgttcaccttaaacatgataaatgcatatgagtactagatttcccccgccgaacgttattaaactaaattagcactaggccatccttactttaaagtaaggaaattaattgaaaaacagtagaaaattagatatccaaaaaggaggtgaaaagagattgtcaaacaaggtgaaaaggaaagtttgctatttcattaaaatataaatttgttgtctaaggttctccctttgtccagtgagcagacagcataatcctattttctatgttataaatcattatcatatctactttcttcttttcccagacaatcaatttaactttaacagaggaagatctgttcttgttgttgagttatcaaccacccttgggactagaaagctttatttgaaaggtagatttcacatagtacttcatatttttcggctttatatggctgtcattcttggagaaagtttttctcttttgtgtcttatgtcttaaccatgtctgcagataccgttaacctttgcagaaaggctagattattttccctacataattctgtttctcttctttacaagctaaaaacgacccatttaaagacaataatacaatatagcaacacgtttatttgagtcatgatctttaaaaatgaaatctaacaaacagaaatttctttaacctgcagaatagcatgtatattcgggtaactgggtttttacaaggagtgaatggtttgagtacatgaacgtgcggtgcactatggtttattggtccaaaattttcttacatttaattgatttttattgataaaatctgcattatgatagaatgcaagtgagagtaaaaagtctcatattggtttgaacaacatataaatgacaaaaatatatatactcgatgtcttaaggttttaagtaaataaatgttaagtattaaatttatctgtaattgactcatgatttcattaacaaaagtttcttcaatattttatctccttgtattccgtaacatattttttttatatatctaatgtaaaatacagatgaatctgttcaaaatattgaatatttcaggatataaaatttttattcaatattgagatattgagtggaaattctcccacacaaagatagtagaagcatattgatctctaattattcttgacaaaagattctacttgactccattgataaagaaaaagcatcatttttattatcaaatatcatctagtcttttgaattctatttttttttttttatttctttcccatgtacctaatacaggaaaagaatactactactctgtctagaaagacgtttctcttattacttgaaggcattggcattttaaaattctggtttctcatgtatgacgagagtaatgttgctttacttcaaagcaagcatcacattctcttttgcaattttttttttctcttttctttgcttttcattggaaaagcttcttcaaggcctcaacaccatcaactcagcaaataaagagaaacaagggaagaccagaaaaaatttatgacattgcttgcatttttcaacataatttttcctttcttattttcccttaaagagcttcattttgctctcaagtatttttccacatttgctatggcttcactaaaccaaattatatacatctacttatgactacacatattcaacaacttcttccttccttccacaatttcatcaaagaaatcatcaagttgccctgttatagtctcaaccccacatctcaacaacccaaagcaacgtttcaagttgtcaacttttgcttggatctcatattgtgcatcataacccaccattctctccaactccactttcaattcctccatggcaatcttggcttgtttgaattcaagaagcagaatccctggctggacattattctggtcaatctcttgtgcaactttctgctgcaatcttgccatagaagccataaaacctgagccataaaccacgtgctccacgtgcccctcatacccttgttggtcaaagcatgaggaagaccaacaatatgcaaccccacatagcaaaatcatcagaagcaatgagctaaccctcatcattgcacaaagaacacctcggaagccattgaactcgtttaactttgatttcatacacatgttctgatttagacattgagacaatgcctgaattctattttccatcaagcttttattttcctctaccaatcctagactctccctttgacaaatatttatggccctaataacctgcaatatatgttttctagaagaatttagtgcatgtttggaaactcataaaaaaaacaaaaaaaatcacatcaatttagcttaatgaaagctataactattagcttctgattaaacatgaaaaatcacatctgaaacgtgcaatcaaaacacgctattagagtcattaattaaataaagttgatttagttttgtaaaagcactactaagcttttgactaaaaagtaattttgaacagaatttgaggtgtatatatactatataccaacctgatgtgaaaactctggagtcaaatgatggtagccatccactgaggaagctatgttggagccagttaaggaatagttctctattccagaaatggctgatttgagtacatggcagatatcccaaagccttgagctttcatccatgtattcattcagccattttcctccaactgacaagcaaagcctttggaccaaaatggttaactgggaatggaaggattggagggatgagaagacctctgaaatgaattggattgacatgaagtcatgggagaggaaggattggtgaagctcattgagtccttgagtgaggaagatgtagaagccattgacagaagagtttgtgcatgaagaactactcatcatgaaaggttgaagggaagttgatggagattgatagatttatataattggaagattaagttgaaaagagattaagcaatcaagaaagtgggtagcttagaggattctaacttcttttttatggtatggtgaaagttactattgggtgtaattatggctgtttcctatagagtggagtggattttttttttttcctttccaatttacactatttatctccaaataattctcaatttacattacttcttaatttaattctcgaaatacactatttttgagaagtcatgtttttaggatttgaattcccatctaagtttttttttttggtaaatgttatttttattaaatttaatttaaaagaataattttgttatattatttaatttaaaaatgataatattttttggtttaataatttattagtaatcttaaaataattaattaatagtcttaaaataaataaaaagagcaaagtgattaaaaaaataagttgattaaaaacatagtgaatatatagttatcacatctcaattatattatataaaaaattaaaacactcaaataacaaaaaatactaacaattagagagacaaacataataaatggaacataataaaacaataataacggaatgtactaagaataacaaatgaaacacgaaaatgacgatcatagtttgaaagatgttatgcaccagacatgttttcttccatttaaatcattctagcgagttgtttattatgcacaacatgcatcggttattgcaatatgttgattggttattgagactggtttggttactagtttgctaaaaatagctaaaatttatattggacaagaaggcttctggtagttagattccgctaatatctttaacacgtcttcatcgtttttcaattctgttattttatattcgattattttttttgaatattttgtatggcctaattgtcaaaagaacaattttctgatcacctgtgattggtgacttccataaggaggaatccctagaggcacaactcgcttgatgacatccttaagtattttgatgcttcatcttgaaggaatttcaaatcttattaggtttgtttcagtgaaggagtaacctaaaaaactaccttgtcgtggtatctttcacttgctattataatacaacattgcatcatgagtaggaactagtgatggtggatcgaagtaggttgagtatagtatcgggtgttctattgatgatataggttgagtatagtatagggctaacaagcggatatcgcttattgcacattaacattggggatatttgtgcgaataagccaagtgtagttgaatgacttgattaattgtacaaaaaatattgggtaaccagtatccttggttaattccatgttcaaannnnnnnnnnttttttttttttggtaaatgttattttattaaatttaatttaaaataataattttgttatattatttaatttaaaaatgataatattttttggtttaataacttattagtaatcttaaataattaattaatagtgttaaaataaataaaaagaacaaagtgattaaaaaatagattgattaaaaaaatagtgaatatatacttatcaaatctcaattatattatataaaaaaattaaaatactcaaataacaaaaaatactaacaattagagagataaacataataaatagaacataataaaacaaaaataactaaatgtactaagaataaaaatgaaacacgaaaatgacgatactaatcatagtttgaaagatattatgcatcagacatgtcttcttccatttgaatcattctagcaagttgtttattatgcacaacatctgcataggttattgcaacatgttgatcgataattgaggctggtttggttactagtttgctaaaaataactaaaatttatattggacaaaaacacttctggtagttggattccggcaacatctttaacacgtcttcatcatcattctattatttcatattcgatttttttaatattttgtatggcctaactgtcgaaagaacaattttctaaccacatgtgattggtgacttccataaggggaatctctaaaggcacaacttgcttgatgacatccttaagtgttttgatgttgcatattgaaggaattttaaatctttttgggtttgtttcagtgaaggagtaacccaaaaaataccttgtcgtggtatcttgcacttgctattgtattacaacattgcatcatgagtaggaactagtgatggtgaatcgaagtaggttgagtatagtatcgggtgttctattgatgatacataataattctataaggtcaacaagcaggtattgcttattacacattaacattggggatatttgtgcgaataagtcaagtgtagctgaacgacttgattaattgtacaaaaaatattgggtaaccagtatccttggttaattccatgttcaaaggcacaaaaatatttgtctgtgtcattgtttgttgaggagacgtattttaagaccacaaaactttttgttattagaggtcgacaaatacaaacaatgatcaactccggctcgtagtattccaaagtcgtctctaaggcaataaatagcggtcaacatgaatcaaatacgcacattgttaacaaatttgacaaacacaacaacacatttattgtaacagagactcaagtcccacttgaaactcctatatcacctggaaagtttagggttatgttataatcctagaattgcgaaagtggcgaatttcagactaagcacttatcgtgttttcatataatgaatgcctataaatctgttaatgttgatcccataaactatgtgccgctatttactttacaaaacatattgcacgcgtctacgataactcctttggtttactgtcacacgaattaatatgacaagaatatgaaggagatcaatgggtcatgatccaaggaaaaggaagagtgcaaagggtagttcagtttcaaattacattcccactgaaaatggatgaagaaattgaacaagatataaaaaaaatgtgaaatatatcaacaataatgtcataattgaaaaagttgttattattgttcatgtattttatttatgatgtattatggataaatataaaatattaaactaaaaatattatcatattctaaaaattaaataatataaaaaattaattaaatttaacaaaataacattaaacaaaactcaataaagaagttgggttaagcgaaggtggagaatcggatctgaaaacagaaatttttaaaggatagtatagttcagaaattaaattaagaagtaatgtagattgtgaattattaggagataagtaatatagattgataaaaaacctggagaggatgattgggaatctgctgcaattactttttattcctattgaacaaacaaatgtcaagagagagaaagaggcaaataatcttaagaatatatagtactgtggatcatatgtagagcattaaaaaaatatgcattatgaaaactatataaatagttccccccgaccccaatttctcgtacttgatggtttttctatttcttttgttattccatcgaatcgaggtttcagtatgagattggattctgctacttgttggagtataaaagattgactactttggcttaagattctgcttctcattcttctatttggatttggctcgctagctgttgcatttaaagtgcttcccttcggcttcttttctattttttattttctctttcttctcggcccatgttttaacctcttctacacgagcacactgcaccttttcgttttggtattcttaaaaaacgtggtacgtcgtccattttggtttttctcatcctgtagagaagaataagaatgaatatatcaactgtgatcctcaaattaaactcaaaactattgcggctttttttttttccttttcatattcactacaaacaaatgtctaatgtcatatactaataaaaaaatattgatcgttaagcttattcccattaatatattttttagttaattaaaattaaattgttaatcaacttaataaataaatatataccacagtagttttttttattcagtgaaaacaagaacggaacaaaccatcacttacgaataccaacaatgcctaactcatcccctaaaagaagggattaattagacctcaattggaagactataaccgcagtataatacaactatacacccataatataaggtctatatttaattttattttctgataaatggatattatattaatggaggtaagtttaataactttgtctttgttaatatatgtaatgtttttgtaatgactataatgttcacattatgttcttgctattgacgttcacactttgaataacaatttaaggttgacttcaattttttctgactgagtttttgttgtgtagatttattttcaccaaatcattgcacacattaagaatagccatttgaaaggctaagttttaacgaaaggataatgcaccaaagcataatcaaactaatctatctgaaaggacaacacttatatatattgctttttcccacagtttagctgattttaagggtgcaggaaaccaaatcaaatattcatagatattagtcatgtattaagaaaatttctcacttataatcactttttccttgagagtattcaagtatattagtgatgttatttctgatattgactcatcgtcgtcctaggtgtgtggctagttctacgtataattgattcgatttgacacataaattaagaccatattcattttatttagatgatctataacaacattcctatgtagatttgtttttgttggtgtccacacaattgacttgtctagatcttatacatgatttcttttatttgacattgtgaagtctgttgcaaggtatttattattcttgtaattgtcactttccatagttcatgagcacatcatatatacccaaaattgcaaaattagatacacgcgttttcgatagtaagataacctttattattatacaagtgagaatgataaatatttactattaaatcttattataagttatcaagatcaaaatatataaatcacgtgagttcttttttataaaaaaaatcatgatttttaaatttttttacataacatcaaatcttaatcattataattgtataattccgatttactgttcttctcacttttatataaacatgactttctcactagatatgttcctatacagtcaacattcatttatatttttaaaagtatacatacactaaattaatataacgaagtatcagataatttttaaatgatattaaaatttatagatttgacctattgaataagaatttttaatttaatgattgaattaataatgtttaatatgtacaaatatttattaaaattactcttacagtaagttgaaaaagttgactttttatactatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtccatgagcacaagattgtttgagcatgaatgaaaaagaattcgaaaggattatgacacctagacagatacacaagtcacagaaataaaagatttagttcgcaataaaagattatgaaagctaattactagacatcagttagctaataacaaaatagtcttgggttgatcagaatgctctgcttcaattataggtagtataccaagttaattttgaaacattgttaacgtagaagttcactttattatccaaatatattgtcttgttacttaacgtgtttgacaatacataaaaatattaaatccatttaagtaatataatagcgtattaatgtgaaaacttttcatcgatattcaagttaaattataatacaattatagatagaatcttattatgaatatttattatgaatatcataagataacataaaaaaagttatgaataacccaattttacatattctaataaaaatcttttatttaatcaatgctatttaatcaagaacactaattagcatttgccttatacataatatgatgtggttatatgataataattgactttcgtcaaaaattggctggataagagaggttgacaaattcctgtaggtgcataactgtataaatagaaatcatagacaattgtttatagaaaaatgctacatagctatacaaatgataaaataaaaccatagaaatttagcaaaattcagtcaaaatttatcaagagtcgcggttaattattagacataaaagcaggaaaaatacattcctgtaagaattaggggtgctgaaagacacagaattcagtcaaaagtaacatggttttcttatattccagtctgttaccagcaagttcaagcacccacaatgtgagagacacatgaataatcaccaaaaattatgttgatgctgtaagcaaacttgtaacaagttaacactatcactgtaatatttgacattcccaaaatccagcattcttccccattgaattaaacaattatcctgagaaaaaaaaaaggtgaggggttgattgctggtatataacattaatgaatttagatggcctaataggttactatgtccacagtcatcaaattgaaggtacgattcaaattcactaaaagtttcttctaatcaagatctcctttgagaccttggaattggcactgtttggatggaaagaagtcatgatgctacatggtgacaaattgctgcaaggatcatagatttcttgaataaatttcaacttgcacaacatctgtcccttgttcataactcggccctggattccgtgtcctcatttgatgaatcttcactattgaagtccttggattgattagggggttgtattgattctgattcttgatcatcgcccaagatttgtgctgtgaatcttcttgcctcaaaatccaggtctggccactcagaaactattcgtctagcaccctaatgttccgagataaagtagtaaaaaaatggacatagaagacagaggagtgcaaaaacataagttgtgataggaaacaagtttccatgaacacaacttaaaacagcaaaacatttacctgcagtttgggttcttttgtcatgggattgttgcacagatcaatggtttttgccttgtattttgtagcattaccacaccatgattcacaccatagccattcttgcggcaaagagaaaataggcacggtatgctgagcgtaattaggaagatcctagaccatttcagggcaaattttagcaaaaaggcacctcaaaccaaaaacaaaagcatgcattcaaaagagagaagaaggctacattggaagtacataaagattaatcttcataataaataatatgaaatatactacgaaactagtaacttgattttacagtcctaagtatccaattttagcccttcatacaatttatgaaattgactctttcaaattctgaaatattttttcaaatttcaaatggtaagaaggaaagacctgattccaacttgcacaaaaatgatattgattcaacactaaggtagtgtttggaccagcttattttgcctttttttctccttaaaagctgggccaaacactcatatatatatatatatatatatataaaagtccttaaaattataagtagcttatttttaagactaaaagatgaaaataaggagcttattaagaagctccttggagtagctttttatagcttgtgcggagcttttctagcaacaaccatccttcgaatcccatctaccggcctttcatgtatttccttttctaaaataaattcatttcctcctttcttatatgtgcgtgcccctgcagcttttctgtggaataatgatgctgctttttttattcttcccataacattgaaatccttatgcttaacaatatatttttgttgttgagaaagtttctataagttgtactttcgtttgcaaattatcactgaaataaaattatattaattgaagtaatttcaaatttttaatatatttattttaatattttaatttacttttattatcattaaaatgatttaatatgaattaaattaatttaacacaatatttttttgttttataaatatactttgataattagtttcaaataaattaccatacaacttttaacttaaaaagagcttttagttagaaaagataaaaacttccaaacaacttttaccttttctttaaagttcttaatttagctttaacttgaaagtaacttttaagaaaaaaaaaaaaaaaaaaaanaattttttacgacagtgatcacacaatgtttccaacaaatacggaaataccatcttgatcaatgggtataaacatactgaaataatcaaattaaaaagtttctattctctaaataaattatacaacctgttataaatttataatatgatcactcatcaatagtcaccaaagacagattcaaagagcatatcataaagttgctccctagttttcctttcatttttggttaacggattgaagaggttacatattctttaagaattcactttgataaggcatatacatcaaaagttaaaacaactattctttggcccttgtttaacagcatactgttttaggttaaccgttttgtttagagcagtgttactaatcctaagtttgttggtcatgggttcaactccagaaacagcctctttgcatatgcaaggataaggttaggtataatatccttcccccttacctgtgcatagcgtgaaacctctgggtaatgggatacgtagtagtgttactaatcgtaagtggattagagatggttccttatgcctccatcttatgaagttgttggaaagtttccttaattgcggtcatccctacgccaaaaagggctacctaagaccagaaaggctgagtttaacatggtagagtgcagccactaggatgcggctcttaggggattgagatccccattgattagagataaggcctaagtagtgcttataaggcttgggtaatcctcaccttgcaagcaagttttatggggttgagttatgccttaaatccaaattctaagagaaatgttggagataccacatcaactagtgataaggccaaagtaatgtatataagtgggggacaaccctcaccttacaagccccggtcttgtggggttgagttaggcccaaacctaaattgttaaatgctattgagtgtatcctagagattatagttaggcctacctagccatctagtccttggtgaggggtgtgtattggagatcccattgtgggattaagttacgtccaaacccaaattgtgtcccaattctatgggaggattttaggagatacttacgtctttcacttagacaaaaatgatgagttgggtattgatactcatgaccattataattgttataaagcctctctcccatagaaatatcactagttattggggttagttagtgttggaatataagtaatgaacacactttttcattttttcagattgaaacccaaagggttcattatatacaactatgtctaatattctagaatattccacaacttattctaatactctagaatattccacaactaattctaatactctagaatatttcacaactaattataatactctagaatattccacatctaattccaatactctagaatattctacaactaattctaatattctagaatattccacactccccctcaagtcgggagataaatattaatcattcccaacttgctaagtaaatcctcaaaggttggcttgtgtaatcctttggtaagaatatccgcagtctgctctttggtaggtatatatgacaaacatacactaccatcctccaatttttctttgataaaatgacgatcaacctccacatgtttagttctgtcatggtgaactggattttgagcaatactgacagcagccttattatcacaatacaatctgataggtagggaataagagatcttcaattcctcaagaagtctttttaaccagattccttcacaaatgccatggactagagctcgaaattctgcttctgcactacttctggcaacaactgtttgtttcttacttctccaggtcacaagatttccccagacataggtacaataccctgaagtagatcttcggtccattactgagccagcccaatctgcatctgtatagatttcaatcatcctcttgtgtcccctttgaaagagtattcctcgaccaggggtgtttttgaggtatttgaggattctataaactgcactaaggtgtctttccttaggagaatgcatgaattgactaaccatgcttatcgcaaatgcaatatcaggccgagtgtgagataagtagatcaacttccccaccaacctctgatactgctctttgtcaacttctttcccatcttcatttcccaatttaatattaggatcaattgaagtctctgctggtttgcacccaagcattcctgtttcttgcaacaggtctagaatatatttcttctgagttaaagaaattcctgccttactacgagcaacctccatgccaaggaaatatttgagaactccaagatctttcagttcaaactgatcagctaaacactgcttcaaagagtttatatcctcacaatcatttcctgtgacaattatgtcatcaacataaacaatgagaatagcaattttgtcaccatcagagtgtttataaaatagagtatgatcagtctgagcttggaggaatcctcttcctttcatagcctgggtaaacttttcaaaccactctctaggtgattgtttaagcccatagagagacttcttcaacttgcatacagatccgtctcctttctcaaaaccaggtggtggatccatataaacttcttcatgtaaatctccattcaagaaggcattctttacatctaactgttgcaagggcccatcaaggttggcagcaaatgataatagaactcggatagtgttcagtttggcaactggggcaaatgtttcttgataatctatcccatgagtttgagtgaatcctttagcaaccaacctcgccttatacttgttaatgctattatctgcattaaattttattgtgaacacccacttgcaacctactgttttctttcctctgggcaatgctacagattcccagtttccatttttttttaagtgcatccatttcttcaaagacaacattcctccattttgggtcatcaagtgcttcttggatgtttttgggtatttttgtactgtctaaaatagtgttgaaagcacgaaaacctgaggataacttttcatacgagatatgatgagaaatagggtgagcagtacaagatctagtaccttttcgaagagcaataggtaaatttaggtcggctgcatcagtgtatttaggtattgggttgttggaattaggactcgagtcagaatcttggcagtctagaggcttttgaagtgtttttcacctgctgtaaatttttccccatttaccaggaggatctccagtttttggcacagtagctcgccctatctcatgctcaataactccccctgtctccaaaggcaaaggtagaacaacagactcatttggtttccaagatttatcttcatctatcccaatagactccccttgaagagaagtcgaaggaaaaaaggattgtgtctcataaaatgtgacatccatagaaacaaagaccttacggagagaaggtgagtaacatttgtaacccttttggttaggaggatatcctatgaagacacatcgaatagacttaggatcgagcttggacctttgatggggaggaacatgtacaaaagccacacagccaaacaacttgagaggaagggaagaggagttcggaaaaaaggaaaggcgtcggtaagacaagataaaggggaatgaaaatttaggatacgagaaggcatccgattgatgagatatgatgcatgcaagacagcttccccccatagatgtttagggacatgcatggtaaacaaaagagcttgagcaacttcaagaagatgtctattttttctttcagccaccccattttgttgaggggtgttaggacaagaactttggtggagaataccatgttgggtgagatagtctccaagaacagaattaaaatattcagtaccattgtcagttcgaagaattttgataaaggtctggaactgagtttgaatcatagcatgaaagtttttaaaggtggatgcagcatctgacttatcctttaaaagatatacccaacataccctagaatgatcatcaataaaagtaataaaccaacgagcaccggagatatttttctcacgggctgggccccatatatcactatgaatcaaggtaaatggagaaaactcatgatgagctctaggaggataagaaacacgagaatgctttgcaaactgacaaatatcacaaaaaaaagaactgggttttttattgataaataagtttgggaacaacttctgaagataaaagaaatttgggtgtcctaaccgacgatgccacaacaaaacatcattacaatcatcagtcaaagataatgagtggtgtgcaaaaacttttgtttcattaggatccttttcaaaatagtaaagcccttcttcctctctagcactgccaatcttcagccttgagtcttgttcatgaaaatcacaagcatggacagagaatttaacaacgcaatttaactcagatgtaagtttgcttatagaaatgaggttacaagtaagagaggaaacatgaaggactgagttcaaagtaatgtgttcagaaattttaatggatccctttccagcaatagtaaagaagttgccatcggccgttcttattcgtgacagtagggatggaaatgggccaggccgcctatcaggggcctttggcctggcctatttaaggcctggcctggcctggcctgtttattataaaggtcaggcttaggctttttgaaaagcctatttaaataaaaaggccgggcttaggctttaaaaaaagcctgttaggcctatcaggctggcctatttaatatatatatatatataattaaaagatataaatcaatctttttaaaaaagaaaaaatctaaataacctaatctacttaaaagataaaaataaaatagaagatttgaaacactataatagatttgtaaaaaaataaaagtatatatatatatatatatattaaaactaaaaagatataaatcaatcttttaaaaagaaaaataaaaataatataatataaaatctaatctacttaaaaagataaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttattttgtttacaatattttgttgaatacttaaagtattccaattataattattaattggtttgttgtgattagtaaattttaatttcatattagagtgctctaattaattttattttttttcacgcacaaattaaaagggaatatgtgtcttttttatattaaatttacaaaagtattatgcgaattctcgaagttttactatatagtcattagattttttttaatatataatatttattttaaagtaggctttttaataggctcgtaggccaagccaggcttttaaataggctaggccaggcctaaaaaaaaagcctatgatagataaaaaggctaggccaggctttatatttttaaattaggccaaggccaggcctaaccaagcctggcctggcctggcctgtttccacccctacgtgacagttgatagtaaggggtataagaacaaaacaaggttgcattacctgtcatatgatcagaagcccctgaatcaagaatccaacgattactacgatcagcatggaatgtcgtaccttgttgagcaacatgactagttgcttcagcagattgaggcatcactttctgaaattgctcatactccgccttagagataaaaacaccatcagaattaggagaggcactagaagaaatgccggatgaagaagaagaatccataagttactgtgaaggacaggaacaaatgcaattggaggtgactagatagtgtttatgggaaatgacagagagagatgacttaaggtttttcaaaaaaatgggtttcagagttgcagaacgataatagggaaatctgctcttgataccatgttggaatataagtaatgaacacactttttcattttttcagattgaaacccaaagggttcattatatacaactatgtctaatattctagaatattccacaacttattctaatactctagaatattccacaactaattctaatactctagaatatttcacaactaattataatactctagaatattccacatctaattccaatactctagaatattctacaactaattctaatattctagaatattccaccgttagacttagcagctttgtattaaaatctataaataagggggtgtatacaagttgatttgattttttctcaataatacaatttcctctatgatttctctatctttaaactctctcaaatctaacaagtagcaaccaaaaaaaaccttgcatttaccatcaacattgtatctcacacatccacacttctgcttcttcctaccttcctgtgtacgattgttaatgccactgataaagtgagcgatgtttccacgtttatcagctcatataacaagactttgagaactttctcccaaaagaagtattgatttcttcgggatttggagggagttctggtgatggtaatgacaagcgtccttctcaggatgccaagtgttggaaaaattcacgacctctgatattacataagaaacagaggagattgttaccatttgttcctacaaaagatcctgcccagaccatgcttctgctttaacagcattaaatatggaattcagtgatcacctcaaatgcttgcctggaaaggctcctagatctgtgaatcaagccacactaaaaaacggtggcatgaagattctttccaaggaagacatggagaccatagaacactgcattgctatgtctaaaagaggtgaattccctccctttatggttgtttatgattcgtgtgaaagttatactgttgaggctgatgacctaatcaaggatatgacaattattgctgaatacattggcgatgtggattaccttgacaaccaggaacgtgatgattgtgacagtattatgtccattcttagagcagaaagttctcaaagtgttgttagctgtgctgataaacgtggaaacatcactcatcgctccctttatgagtggcataaacaatcatacacgggaaggtaggaagaagcagaactgtaaatgtgtgagatacaatgttgatggtgaatgcaaggttttttttttttttgtggttgctactcacgacatttctaagggagagaggctttattatgaatttatgatcataatggtcatgagtatcaatacccaactcatcattttgtctgagtgaaagacaaatacctcctaaaatcttcctatagaattgggacacaattttagatcctcgagaaaggagtctatctatattcttgaaaacttcaactcattgttgttgcatattccacaagttttgatataaagcagtcatttataatgcactgggttttcatgttatattgggactacaaaaaccagtcaaacttgcttaacaacacgctctcttaagtaaggattcatttgcaggtaaaggaactattaacttaaacctcttacctgatccaagttggctagactatttggatccctgcttagtgtttcataaataactctaagattatctccagctgcagtctctcggaacttcttcagatcaacaacatataaagcactgaaaaccgaaattgaaacagtaagcattgaaattatatttggcaatagaatataaaagtagctactaacctaatatggtatggtttcccccgcaaatgatcattccagaaaccctatgacacagggaaaaaaggttaacaaatatttatagccaatactgcattaaaattacacgggcgtaatgaaaaccaagagtatcatatagattggaattgaacaataattagaatttcgacagtgacatttacctgtctccaaaacctatatccatccatctccttattattatcacaaaatggggtatatgccaggggttttcctcttatatccatgtcatagagtactcccatgtctgccctaacaacttgatcagcatccacaaaaatgacctgcatatattggtagattttagacagattaccttgtaagggattttcattcttcattatctttgtcataacattgttattgggaaaaacccaagtcccacattggatagagataaacccaagatagaatatacaagtgagaggcaaccttcaccctatgagctagtttttggggttgagttaggctcaaaccaacatcctaagaattgtgtagtgtgacattgaaattaattgtacaaaagacaaaaaccaaaagcatggaacttgatgcagaagaagaaaccatgataccttctccaaagaaagggggaaaatgacatctaggaataagattttatatgcccaaattattcgctgcttttctttctgcttatgcaaccatgtgggccacttgtacgtgactagttcatatttaaaaccatattctagggccatgtgtggaattaagtcctgtatgttaagtcaaccaaaatggttcaggatgtcaggcaaactcatcattctactttacattccaatatacaaatgaattaaaatgtaagcatatataatttgggtggatatataaccttaaaaggaggagagaggtagttctttatgaaccagaatttaactggacgatgagtattctttagaacacttagaatcataatcttcataaagcgttcatatctggcaaattgacaagaagcacaaagtgaagattgcatccctgatgacaaataaaataccaccaggctcaactaaatatgaaaaaatattatagaatccaagtatggagtttaatagttaccatgcatttggaagtgtataacatttgtttgaaagattgtgcttagtaaaacttgcacaagaaattaacgtccctaaatttcctattaattacaggcacttgaaactgaaattgtattctgcaatggaaccccaaatcccattccacgaaatctgaatcaacatacatgattgaccccattccatgaagaagcataaaaacatcaataaatgatattttctgctgtacaagacaatttttccaacatgatacatcacatatagtaatcactgtttaaatttcgaaataaaggaccaaacttgaacaaacatatgttaaaaggcaaaactaaaaggaaaaacaagaaaggaaaattgtaacaacttataataagcgaaccacttacaggtgcccagaagcaatagaaaagatattaatagtttttccatgccgtccaccccttcctttctcctatatgggaaaaaggttcaatctgttacaactttggaaatgatgacacaaagataaaaatggaaggacaaagcacagggtaaacacttaataaggttcaatctgttagggtgtgtttggatacacgttgaaaccacgttgaacggagattttgtgcattccaatgtaaaaatgccaaatcattacatcaattaaagcttcaaagcctaaaagcaacatcaatctgataaaatcttttcatataacagtaacttaatgtaccaaaaactaataaggttttcaaggaaatataataaatgatgatttttgtaaaatagacgggtggaaaatgttaggaagtcttacatcgtctgccttaattctcggggtgcagcttatatatttgttgagcagctttacttagtgccaattggttttatttcagctgttggtgacattaattctgtcttctgagatgtatttgtgtcactggaacttgcttctaatttaatttcggttgggcaattggtggataataattgtaatgttaatttctcccagactagttttgtgcaggatcaggtgtcggggaaagtgatcaagaagggacctaaagtaggcagattgtttccagtccagtttacttctcctagtttttcctcattttcttgtactactgtcccgtcctcattcgaggattggcataataaactaggacatccaaagtcagttgttttgtctcatttaatagagaatggtctgttgggcaataaaactcttgtttctgactcatcctttacgtgttcagtgtgcaaacttgccaaaagcaaaaatctcccattttcccataatgctactcgtgctaacaaatgttttacaattatacacactgatgtgtggggtgtgtctcctgtcttgttgcattctaagtataaatactttgttatgtatattaatgactatagtcgttttacttggatttacttcctttgttctaaagatgaagtttttcctatgtttaagaatttttttgcttatattgagaaccagtttcagacaagcattaagattttgcgcactgactctggtggggagtacatgtctcatgcctttcaagaatacctacaacaaaaaggcatcatttctcagcgttcttgtccttatacacctcagcaaaatggcattgcagaacgaaaaagtcaaaatttgcttgatgtcagacgctgattatttcttgcagcatctgtcccagccaatttttgggttgagactctgtcaacagctgtctttctgataaatcattttccttcccaagttctcgagtttgattctcctttctttcgcctctttcaagttcatccggattatattgatcttcacccctttggttgtgttttttttgtccacttccacctcctaaacgtcataagcttggggcccaatcaatcatgtgtgttcttaggttatagtaccactcacaaaggattcttgtgttatgttatgatgccacctctcatcactttcatttctctaggaaagtggttttctttgactattaaattttcttcccatgttttaagtcttcatctaatgatattgttaacctccctaatttttctgatatttctcattctatagaacgtttcaaaccaggtcatgtttatgttagatgtcagccttctttgtccctttcggctgctgatctgccacctgtgcctgctctactgcaatgctcgtctcaggtgtctcgtgccccagataggcatgaatttgggcctatttctcttacagctactctatctggcacatctgttcctacatgttattcacaggccattaaagatgcttattgggtcaaggcaatagacgaagaactcgctgccctccaagaaaatttcacatgggacattgttcctcaaccccctagtgttaagcccattggttgcaaatgggtctattcagtgaagctgaattctgatggcactgttaatcgtttcaaggcttgattggttgcactgggtaacaaacagaaatacgggttggattatgatgagacgtttgcaaccgttgcaaagacgacgtctatttgaaccattctttctattgctgcctctcagggatggtcaatgactcaaatggatgtgaagaacgcctttattcatggtgatttggcaggggatatttacatgactcctcctccaggcctattttcctcgtctgctggtgtgtgcaagctcaattgttctctctatggcttgtgacaagctcctcgagcatggtttgaaaagtttgactctactctcctttgattttcttttactcagaaccggtatgactcctccttattcattcatcgcacaaatattggaattgttcttatttatgtcaatgatatgataattactggttatgatcatgccgacattcaacgtcttaagcagtaactcaaagcctcctttaatatgaaagatcttggttgccttaagtatttcttgggccttgaagtttatactgattctagaggtatctttcttcaccagcacaagtatacaaacgacttaatttctttggctggtcttgcttcagccactccaattgatactcccctagaggttaatgttaaatatcatcgtgatgaaggagatcttttgtcggatcctttattatatcgtcagctggtgggaagtcttaattatttgacgataacattcctggacatttcatttgcagtccagcaggtgagccaatttatgcattccccatgtcatcttcatttggccgttgttcgccccatcattcgttacttaaaaggcacttcaactcgtggtttattttttcctactgggaagtctcctagtttggttgcctacagtgatgcagattgggccggttgccctgatacaccaagatctgtcacaggttggcgcatgtttcttggtcctgcgctaatctcttggaagagtaaaaagcaatcatgtctatcgaagtcctccattggatcagagtatcgagctatgtcaatggcttgttctgaaatcatttggcttcgtggactcttagatgagataggcttccctcaaattgcagccacacctctctatgctgacaatactagtgccattcagatagctactaatccagtttttcatgagcgcacgaaacatattgacgttgattgccattctattcgagaagtattggacgctcatgttatatctcttcctcatgtcacgccgcaacttcagcttgtggatatcctcaccaaggttgtacctcgtcctcgacatcagtttcttagcagcaaattgatgcttctagattagccgcatcaatttgaggggggatgtcaataagggattctgttattatgttgtttccagtatattattagctttcctgatttaggttgtataaattaggaaatagaatcattgcgtcttaatggctgaaatgcgtctttaatgacaataaatctgtattatttatggatgaacagcagaatgaagggaaagcattcgagacagaaattctgacagaaaactaacggacaagtaaataaaagacatacttgcgaacttttttcagcctttttagataatttgttgccgccaatgaaaccagaagcccattttaagaagttggaattcaagccacttccctataaaaatatcatgaagatatctgttatggattgcactggctttagcctttaaataataatgtttatcattttatgcttcaaaacatgtttttaaagaacaatttttaatagaaagcactcactttcttctcatcttgtgcattgtcatcaggaagaagtaattcctcatgctccttgcccttttttttcactacttccatatgaaatattttaccccgtaaatcattaatagtaatgagttttgatgattgtttatcgtaacttccttcaccatcttcctttaaaatgtaaagctcggaacttcttccaggagcaagctgcaagtaccaaactccaggtgagactttcatttgccaatatcccaggttggccatcacaagggtatcaactaaatggggagtagtctttgtcccaaggatcagctgaagtccccgaggaggatcgtgatctttctcagaacagtgacctgattagatttgacaagagtgacaatagattagtacacagtgctcattaatgattgttaacatagaagagatgacagaattaggaatataataattagagagattttaggaaagttgatagagcctctattagttggtttgggtatgtttagtgaatactggtagaaacaccaataaagatgtttaaccagatggaacatatttcattagttagaggtagaaggagaccaatcccatatttacagttaaacatatgacagtaatttatggcctcgtatgatccctttagccaatcacacctagtgggaaaaagctttgttgttgttgtgtttcataattgtaagctaacaaggagaaaacagaagctaatgttatagacataactacacatattaaacatcctaattgcacagaagtgtttaatagaaatttaaccagtgacatgctgctggttcacaggctacaaatggctatattcactttcccttactgtgtaatgagcagagtaggttccccattttctttgttcttaaattgttctgcatctgtttcttcatgaaattgtttgtttcacatttcagtgtgttgggtgtgccctaggtccatggattagattttgttgactagctttaattgttatggtagaagtaaagaagccaaatttttatggtaatgtgcaatctatgctacactttgatgattatgcaggagcattatttttgtttttaagggatccctttggacaagcatattctttgggataagattaggcatttgaattgtagtagttgtagggacttttaaaagtggtgtcaattacaggaatgttaaggttgggaaactttgcttcatttttttgttgttgtcatttcgtggctgttcttttttcttttttttaaagagggcctctaaaagaaaaatttcttatataactttttttcttaaaaaagcgttaattatgctaatgaactagactactacacaaatagatgtggcctagcattctaacaagtagcaatgattatttaataatatcactaacagcttgtatttctaataaacaagatgcaatcttaccagtgaggacaagagcttcaagctcaaaaactgcttgcaatgtccttgtgtcaccaaggttctcaagaagaatgttatccaggtcatggctgcagcatgagagatattactaaggactattaaaattcacaaaaagtagtcattacatataaaaactcagaaatgtattacatagacctccctcaaggcatggaaaaatcatatttatttcccccattcccgaaatatcaaagggaatgccttcgcttgacagaaaaatacaaagcattcagagtttataatttaattcaacaatttaagttgattatttatctaccagagttggtgtgtgtcactaattatgagattcattcaatttagatgccaaaaactttattctttttaaatgttcaccccatttttacgctattaattcaactttataacatgcttctttattaacaaagacaagggtacatttggactaacataaacattgacattagaatggtttaatgagtctaacagctacttaatggaataggttacggttactataaattttaaatgaggaagaccagtgtaatttattcacaataatttactcgtctccagttacattcaaacaaaaaattgataaaagaatcagtatattaacaaattctaaaataatacatacaatgcaataacgggctcaacaagccaagactcaggaacatcaagattcatggtgagagtcttagacaatggcatgtttgcaaagagtgcttgtgggccatttattgcagagtcagtgttgctaaaatcatcctgcaaaaatcagaaaccctgtgagacctagcatcaaatatcatgtctggaattatcttagagaattaagagttaaataaataagatataccattgttggtaccacatatctgtagtagctcttcagaggaagatcagcaagagaactctgtcataagatgaaaaacagcattcaatacaaattagcaaatgtataaagaacttggcaacacattttgctggacgaaaattaaaagaaatatatcttgtagaaaatctcgcataagactatcactagaaatcaggagttcaatccttgttgctccattcttctaaataaaggctaaatttcgatacaagatagatcgggccttcacattaatggatcttgcaagagggagtgcaatggatatcaaactaatcaagagccttcacctaaacagttaagcatttgggagagttggctcttggcaggttacaagctaaaaactatttacagtagaacagatgagggatagatgaattaactcctacaagcctattgatcataatgtgaatggactaatacatgcacatttggtttaagtgtaactattgcatcaaggagttcctttggataagcagctactttgggataagataagatcagacaattggtttttacttggtgtaaagccgacatggttttttatactaagtttcatttacaactcagttgagggattggatagattttctttctttgttctctgttgtctgtatttcctttttattttaagaaggattttaacctcctgattctttgtaatcatatattctgtgtcaaaaataaaaggcctaaacatttttttttatcggcataaaaggcctaaacataagactgaataacagaaggccttatgaaagccaaattaggggaaaattcacagttccacaacacaagggcaacactttggcttgtctcatccaatcacaatgagagagaaacaatttttttccatcttcttttttattccaaatgcctaaaaagaatcttattgaaggaacaatttcagttgcagaaaaaaaattattatataattatatatgtttgcagaacaatagatagatttgaaccaaccactggattcagtacaattctcatgctgggctgaatgtatttccacaaaactcgaagaattccagacaacctctggctggttggacttaaaggatcaagaaccgcttcaatatgaatacttgaatttacattatttagaataatgacactgcacagataaatgatggaaaaagaaatactgacatcatataatacatataaatgagcaatccaaaaatgactaaatcataaggaaaaaaatgtttgagtgcattgtaactaataaaaataacctatgctgatcattcagaatctcaaaacgagcactttcagaattccgctcccgcatggccattgaagatgataaggccatgacaatatcactaatgaatttgctgcaaacaacatagggcaacattaaagaattgttaaatattcagtaaacagacgtgattgaacaaaaaatctgtttaagttactataaatcagaggacttatggcacacccaacattctccaaaaattctcaagaactcaacaaatcagtagtagcagaaaaatgtaacaatagatgagcttgcacagcacataagacacagtatgggagtttgctattttaaaagaaaagaaaatcataggcatattgaactgaaaccgtgtgtctgaatacaccatggatgagagtttatataggcttatagtattcattgcacataaatagaggatattcagtttcctataaatcagagattatatgcctataaactacaattattacaatgaattcagaacattatattctgattcccaacatgcttcatgtgacctatcacctatgcactttttaattctttaatttcttgtttctaaacttactttctattcaactgattcccatattcatttgcttgaatataaattctgcagaaattggtctatagctagcatggtttctcaatcaatcattgggaaacaatacttatgattatctcatcactttattctttgtatgatctgtgcacttgcgttgtgccaaaaatgtcatgtaacacctcacttttaggctttggttttccagaccctccctccaacattttttagttaaaagaaagcatgtcataggaaggtgatatatgtaatgatccatagagaaatcaaacaaaaattaaaggtgagtcaaacagagacagaaaagttcaagaaaccttgttagcatggcggggtaaacatcatgccattccaccttttcaataatttccacaatgtgctttgtcctttgtttaaattctattgattccagaagatgcagatcagcactcaaaaatgtgctttcgtcaattggataagttacctattaaagatagatattaaggaaagaacacaagattaataaggaaatttaaggattggtgaaaattcatcagcaaattttgagagagaagagcaaaattatatttgtaaacaagcaatgaaaacaattattcatcagaaatcagttatactatgaaatagctgaagacaccaaaacaatattacccttccattagtgaagacagcattgacaccagattcaagcccaagcaccctatacaaagaattctgcacctgataacaagacgtctaattaatacaaattatcatgattaacagacaaaaaaatattagtgaaaaactctgaaattgtttaacatagtgcaaactaaaatgaaatacataaaagagaagcagaaatggaaaaaaaaagcagcaggaaaccatttccttcaggtattagtatcaaatagaaaaagtaaaagtatgaggcacagggttgggttgttaagaactaaaagcaaatgtccaaatggcaagataaactagaagtaccttagtcaaatgctttctcacttcaccggcaggaaattctaggagggcagacctatagcccttagatggtaacccattggcttcaccaagctcgcaaacaatatcaacaaatgcttgagtgctttcagcttccataggaggtgtaaggatgtaattcttctcatacagtgagcaaagctgatccaagaagtccaatacattcgtcttatgactgcacaccatgcattcaaacatttgatataaaaatggtgcttccactttggaaaggaattgacaaaatcacagaattgaaattaaacaatcaattaaaatttaaccagcttttgaattaaaagcaaaatccaaacacatacctatacaaggatgcagtgatttcaaagaccttaacaaataggaggctaaacaaattaggattccgattggcattaaatagaagacctacacgagcatttttggatccttctatctgtagcattatgttcaaataacaaaaacatcaaatatgcttaaaagcatcaaataaattgctccaactcataataggcattaggcacaataatttaaaaagaaccaagaagatttaaaagaaatgcatattggtattaaccagataatgtatgccttgttgaagtaatttcatcccattccttgaagtgatatcaacagcaagaagatgtgtcacagccttcgtatcatccattgctggtttggatcaaaacaattcacatgtgacaacaaaagaaacagactgtacaaaagaaattaaagattctaatatttaaacaacttacttccaggagaatgcaagtagacaatgtcatttagtacagattcctccccaaaagtaaacattgacagagatatgaaccttggtttgctgtcagaaataatctataccaaacgattagcattagaaactggttaatgagtatcactataaatgttcccaaaatttaaattattaaattatttaactactataccttaggattataacgttgtataccagcttctgatagaaacttagctaatacatcagtgtcagacattatttgtccaaaatatacttgttcctgtattcttggagtctcatcattcaaggcatttataagagcttcctggtaaacacaattgcatagaaataagtagaggaaaaatctattctactaacactattaatacatcacagttatactagacaaagaaaaattgggcacaactcaccttaaactaaagttgagcacatgcagaatatccaaaattaaacaacacactaaggaaaactacaacagtatggataagtgcaagtagtcaaacaatgataagtatacgaaggggatcttacaaatttatagatagctgtgagtttattagtgcattgtaagagactcatctgcattttactacataaagtgtatccagtgctatttattttattttgttttgggttgccagcattaagaaaaagcacatataaaaaacaaagagaaagaactcattttacaaagaagaccacaatattactgttaggtattattacagaaagtagtattagagatcacctctcatgcttgcactgtaattttctttttctgttttgggcttcagttagtggtctgggccaagcttatcagctagcccatagtcagcttctatcagttgtaactgattttttcaagtgtcaaagattatatgttttaactacagcagtttagtatgagatgatttccattattactcattattttgttttcttattttgtaaacctccttcattataaataagagtatttcctgtggtctgatacgacaacacaacagtaaataattcttacatggtatcagagcaggttattattgacaaagaaataatgaaagtcgttctccatcggggacctactgtcatcggtggacctttatgctcactgcccttcttttgatgaccctttctcctttcttctacacgccaaacagttttggttccattatcactgcagtgtgccttcgttctcgcatgaacagtaccgcaagctgctgcaaccctctattggcagtcatcgtgccttctatctccgacgcaaccatacccccggagtctccacctcccggcgaccagcgtgcaccctgtcatgtcgccgttcaacgacgcacacaccaccactctccagcgtgtgtgcatcacatgccagctacccatgacacctaccaccaggctgtccacatgtgcaaccaactcaacacaccgccacagcaaccccacgcagggcccttttccagcgagaaaagttcaagcacataacatgtgacgtgtcacactggaaccgcatccttctgcctcagggcatgctattttcaaaggtgaacaatacccatcgccactacaggctttcgttggttgccgccgaggtttattctgcacaaccccatgatcggaatcgtcttttgtttctgttgggtttgccacatttgtaacaagcttggttcatatgatatatatgctccagcttgaggggaagtgtcaaaaatatctgatatgttttaattagagcagtttagtatgggattatttccattattactcattattttgtttccttattttgtaaacctccttcattataaataagagtatttcttgtggtccaatatgacaacacacaacagtaaatcttacaacaagaatcaataatacagtttactttcagttgcacaaatcttttttctctttctctgaattctatcagaattaatgtaaacagagtaattataggtcgattatgtaattagtgatatcacgtaattacagtaatcatgtaactataaatccttgtacggtacttattacactctatatatataatttgctctttaatacacagcaattcatcacatttttcattttctctttctctcaacacttatatcttggccaaccaccttgtacaatataaaatattgtgaattgacagcagaattgaagaaaaagtacaaaaaaaaagaggaaataaaattttaaggcagtggaaaatgttaaaaaaatcattacctcagtgggatcaataacaaggccattcatcaacaatgaacattgaagcttagacaaaccaagcttaaatacaaacttggagctttcttgtgacaattccttcaacttttgattcttatacagctttagtaatatctcttgaggtggggactttacctttgatctatagaaatacagagaatatttaattcatgtttaaaataaattagaacgtaatgttactgctaaaatattgaagcactacattagtcaaatgtcagaaggatactaatcaacaaaaagtactataaaacttacaatattgtttccacaaacactccttcaacatggtgcagttcaagagcatcatatgcattgccatctgactcgatgtgtaatttgttaacctacaaaaatgtacaatatagttcctttaattgaattgaaaataagattagttttaaagtctcaaaacaactgctaaaatgtgtttcataaaaatcttagatataatagcatcatctatttgtgtatgctaattccaacagcataaacatttttatttttatcaatataaataaaaacctctaaacaaacctttcagatttatttttcccttttttgtcatgttaatggggaagagatgaagccacttaaaaggttgtcaaatgttacgcactaggttcatgattttttttaaaataaataattgaattcataggaaagtgattatctagaaatttgcatagtgatagacaaggggaaaatttaaaaagaaaaaaagattagtgagtcataaggttgaaattcaaagttaagtcaaatcaagcaacttggaaggttcaaattttgaactttaatgatatcaaatagatatgtagttaggttcaagatgggtggagtaaaatgaaagaacaacataacaatattaactgcatctgccacttttctttcctaattttggatttaagtcatgtgcttctggcatatgaagttttaacttttaaaccagacgtaagtaagttcatggaaagacattgaactgaagatgacactaatgactaagtatcacactcatacattgctcaaaaaccggtaagccatttcagcaccataattctcgttgatataactgaagagacatataatctgaaaagagaaaaaaaatgatgtcataaacttgccagtgaaactataacatatagaaaaatttctatgacatttatcacacacacattcctgaacaacaaaaggtaaaaattaccgtagttgaaatatctccatcgctgtgctcttttgtagcatgattttctaactgtgtaacaaacatcgaagaatacaacacaatcccaaacctcacaggaaaattattttcatacaatgatatgatcatatcaatggactgcaaaattccaaacaataaagcaagtgactaagattttgcttggaaacatatacaatgaataatgtgaaaatgttaagcttgaggaaaaaaaacttgcctccagaccacaacgggttgctggatcaagaacaaagacagcatggaaaaggtttttacggatgtaacgtagctgcccagggaaggctggcatcaagaactaagcaaaataaatgtaaaatatgttaggttaggctaaatctttacacaaacagtacttcagtcagaaaaatctcttgaacactttgatttttatattttttaattaaaaaaataaagctaatccaaacacactaattcacctcttctaaattgttactccaccatttatatttagcatcttcttccaagttgttgagataatgaacatgactagaatgaaaatcaactcgaaatatactggactctggaggaggtgaagttgagagcaatttcttcaaagtggcttgaggaatctgcaaatagtgagaatatcaacaatacagttcaggtgtatgtacatatcacaaatgagttttataaagagaaaaaaatggtagcaattaatagaagtttaaaaaattaagggcttgtccagtttgagaaaaaatttatgtttccataaataattacaaaatgccaccttggtaattatttatgaaaataggaaatgaaaaccaaaacattttcttaatccaaacaggtaatcgtgccattttttctatggaaaaaataccattaacttcttcacctcccactcatcttccctcctttcaatacaaattgttttcttgggagactatccaatgttacttttgaaaacaacattttcttaggtaatatgcatcagatgactatttttcatctgtcaattactaggtcagtgaatagttaaacagaaattagtgcaatagtaaaaatatgacaaaatgaaaattagatggcattcaccttcaattttgagaactgatcagtcaacaagagatcctgacggatcaagtcaatcaacctaataaagaataacaggaaaatagtatcagaaattcaaaaatttcagcactgccaaaccaggatcaaaccactgctaaatatttacattcttagaacctaaaaccaattctcccaaacataataacaattagttgacaaagcatttacaattatatataggaaatgactttaatccaacataaaaaaaggaattccatacgataagtaagatactttgaataggctcaactcaaataaacacaaaaccaaaccataggtatataaatagacctgggtttggctcttccaatcttgtgctaagtgctaactaacatcaaaagaaccataaatatgagacagcaaagtcttaatgtgctggaggggattgaaaaatactaactctagctataatagaggcacaaacatgaatacgacaagataatgtataaattatcagtaggaaaaaaagttattacagatagaggtcaacatcttcgacattgactaaagcaccattgagagccattaaagacttgccaggtgggaccatccgctggtttgccattatttcatctcgaacagaatcatcaagctgtcatgagaagcagttccgtaagaataatagacatttttttccaaggaaaatgtctaaaaatatgtgagtgcctaacataaataacaattaacaagattatgtaccttcatgcgagacaaggaagaaactatgctagggaagttttgattgatttcctgcattgactgcagaggatcagaagcacggacaattctctgtacagtttgatgtcctagatctgttaccatcagaaagaaggggaaaaaacatagaacactgttcattgaagccaactgcgataggattcagcttccaatctttccaattatcagaggaaaagagaaaaatattttaaataccctttaattcccaaacatcaagtgtgtctgatacagttgatgacaatagataatcccgaaaagccatgacctcagatgttaagtcaggtttacgttcctgtgagtaaacaaaaacaggtaaatttattggtaacactagtgtctggataattttgaggtggggcaataaatatacttcactataaatattaatatacttttataatgttatgaaattaaccaaagcaaataatgagttgacaaccatatggaagcagaaaaaaaaatctaatcccacaaaagagactaggaaataaatttctgattcaaaactatgcactcttttctgttcataacaccacaagtatgcaaaaagtgggcaatgccaaaggatcttagcttccttcatcctgccaaaacctttcatattaatcgattaaaaggcattaaataatatcctacagtaaatatatcaagctgcaaggcagtgagaaggcaaatggacacaactttacattatatcnaaaaggcattaaataatatcctacagtaaatatatcaagctgcaaggcagtgagaaggcaaatggacacaactttacattagatctcgcaaagcacataatattatcacatttaacactattttataaaaaaaagaaatgctagcaacacaatctctaacacacatcttctattattggttgaaatttattgaaaattacaaaattctcattatcatgtgtgtgtccaaaaacaaatgtgagtttacacaccagaagtttagagaatatgaatcctctgacttcctggctaagatcttcagttcgaggatcctctaaagtcacacctgcaatcctcaactgtgttaatgagagaatcaatcatttaatcacaagtaatctttcttgatgtatataaatatccaaccattttaattggattagcaatatacaaaacaccaaaagaatttgtgaatccagaaataatttaacactaagaaatgtacttttcaattatctatttcaaagttataattaataaaatcttcaaacctgaaactcattgtaggaaaacaagatggagagtctttaacgaacgataaacttataaatcaatgcattgaggtaaggttggagaaggtcaatgctaactaactcaagtaaccagatagaaagaccataaagggtaaggaaaacttctttaaatagcagaattagaccttgagaatagtacatattaccatgcaaaatgaatgaaaggacattgttggaaactgcaacaaatctattgggaatagctgaatttaaagcttagattcatgaaattttagattcatgcaaggtgctttaattcaagtacttaggtagttgcacttgtgcttattcttcttgtaaatgtaatatgcaattaattaattcaaaagtgtgtgtattaactctgctagtgctaatcactcaagcatgtcacaggtttcttagtccaaatctaaaattgacatcgtaaaaaaaaaaaatgcaagttcaaagaaaacttacataaagagtattgttaggatccaattgccccataccttgcaattggttcctaacaaggattaataaaattgtcaaatcctaggaatagcaatgcaagcatggaggtcatgaagtcaaagaaaattaaagaaagaatacttttataatttctcgaaaaatatgacattttaaaaattacaaaaattacaaagagtaaaaaattggaaaggatgatcaggcaatcacaatttcatgtactaactttcttctacaattgactcagtatgcaaagttaaagagaactagaagccttcactcaacatgtgtcaatcattctaacctttttttactgtactgtcatccatggccttatattccatattcttcagtgcaagttccacaccataaccacccaagttcactgattcaccagcaccaacagaactacaatgattgatatttgattcacatccagcaggcaacactggccgtacaacatacttaactttcccctaaaaattattcagtcaacatattaatatagttgcatgggaaatatattagataagcattacatttttttttcaaattccaatcttaatatatgggacaacaatataaatctgtttaatgatttcatcgtttcacaactccttgactattaccatatcttcaaaaaacattagtgttgcatacaactaacatattaatctaaacttcacttgaagagatatataatatctgggatattttataacacagaagatggacatctcataattcaggtgcaattcaaataatttacattactcttatcagttttaaaccttttgtttcacattcttctctccattgaaatctcctggggttttatcaaaaaatgattatgtttacatcatttgatacttgaaagcaaatccattttggaggcttgtacagcagaatgctaaatgattataatagctgccaaaaactacatcacattatattttctaaagagttaggcaaacgctctgttaagtaaacaaaagtaaaaaagtttttataagaaatgagagcttttattatattgggtaatacaaaaatcattttacatgtgctttttaagtaaatagaagcatttagaaatgcctaaagggcattggttagcaagatcctaaattcctaatagttaataccaaaacaagaaataaaagttaaggaatgtacctctttggcagctttaactaaagcaacatgaaactccttaaaacaattggttccaagtgcaccgtaaaggatagcaactggacttccaacacttaactcataatagacgtggtcaaaatcaaatatttcaggtgtctgaaatgaatcacctaccctgaaggcaaaagtttacaattgacaacaacattggaaaattttaaaaaaaataaataaataaaataaaaaaataaacaaacaaacaaacagaagtgcactaatggcaacaaagtactcacagctcagcagagccctgaagccactccagtaattcataaacatccaaaaacaagtgttcaccggtatccacccaacaacattttcctccatggcttttcaggtttacaccatgcaggggatctaattttctcctttcaatcttttctgttagcaacttttcctcagtctcatcatctgaataattttcatcacctaggggaaaagatgcaagagattcttccgctaattgctggtagagcatcagtctaggggatgctgatctcagcataagagagaactcaaataatgattttaatggttcccttagaagagggcgcccacattccaaaattttcttcagacaatctttagctgtttgagatctaacagcatcgttatcagtattaagccaaatctcaacgaagtcccagaaaaggtcctttttttcgttagataataattcactgtttccaaacaataaatggatgttataacatggaaattttacaattggccaaaaattgtagacagatttaaaaaaagaaaaatagtgtatgataatgtaaaagacaatatgtgctgcagtcgaatgctgcatatgaagtaacaaggcatttaactcggttgaaaacagtaatatatgttgtacataagaataagagggaacgacacaacaaaagtatttcacactcatcctcataagtcataactaaccacatgatgtaaagataaatcaaattccatgattttcagttcagccgaatatttccatatcatccatctatatgaatcataagacgagcaccatgtgccaaacttaataatctgatgatctttttgtcatctaaacaatctcttccgaccacaaaagacttcagaaagaaaaacaatcaggaaaagtatcacataatgcttcaaaattccaccacctgacccccacacactactaaatttgagttggaaattctagttttagacactacagtccattatgtcatgtctaactcaaacaaatgacaatgatattcccatttcacactcctttacacgcattcgtatacttcaacacaatttcaacaaaacattagaaacaagtctaaaaataacaccaccccacattacaaaaacacataaaaatgtttgaaaaaggaagagcaaggacatacgcagcttccaaaagcaggggagttccagaccacttagcacggagtgcagtttgaacattcttgggtctctgaggagtgtcagcaatggctgaaccaatattcgacaacaccaacacaatgagaacccaacatcgagatctccaaaggcaccccatttgaatttgtggagcgagaatgaatgtgggttcagaattgatgccccatttgcacgtgcgacagctgaggaagtgagaggagcttcgaaagtttcgatctttgttctcacttcgaggactcgcaggttttttgggaagagacgaccaaaggcgacgactgcactaagtacgttagtgcagcgatcccatgttacatcttggttaccttttttagataataattacatttcggttactaaaaataaaaaggattttctttataaaaaaaaaatacttttttgcgcctttgataaattaataacaatattagaagttattcagaaaaatgtagtattatattgtttatactttatatattataatatgtcagtttcttaactatttaaaatttttccataaaaactatttagagtttttaaaataagttcatatatttcagaaaaaaaaatgaattttaacttataaatattttttaattgaatttttttactccagccagcgatgaaaagttcttaatgttaagttgagtgctgaactcttcaatggattggcccacaataatacatgttgcttctcctaatttcggcaagtgatcatttcaaaaattattttttatttaaaggtgtataactaaatggataaactcacactagcctgttaatttggaaatcaatttgattccttagaagatatcataaaggaatttaggaatgtaataatattattttggttgatcatttttttgagtcagatcatcttattggtaagttattacctcacaaattagctaatcaaacacgagctctttttcaagtgaatttctttttttactcctcaatattaatagtctttttcagttgttgttcctcattggattctattaagtataagaaattgattaaaattatagtttaattttgatatatttttattttaaagatttttatattatcaactaaaaaaatattattaaatgtgatttttttagtaattatgacaaaagtaaattttattatatgtaatagatgacaatataaaaatttttaaattgtcaatgtattttaattatattcttaattttttttaaataattcaagaaacctatgaatcatgtcccttgaatctttattctccatactattacatgcttaactcatgaggctgaactttgatatcaactgcaaatacaagagagggaaaaaaaacataagaaaataagaaagaatttaaattatgtttttgagatctcttaaacctttttgaaattgatcaaaagcttttttgaaaaactttagcaaccaatgtaagaatgaaatgggttttgtgaactaggaggatgattcaaatgcaacaaaacattttataaaagctttgtttttcatgaaaaatgtttatttcatataataactccttcttcatttgtaaaaaaagacaataaagataagaataggagaaattaaaattaaatgattcatggaaaaatcttgaactacatttaattcttgattacttagtagttcatttacgaaaatactaattgataaaaatcttaatttcttacaagatttaaatatgtttttggttttaataagttagcatttttttatttattttaatcttttctcccaaagttgtcagaattattcctaaaataaatctcaattcactgaatcataggctttttgataatctaccttgaagaccaaacaacttttgtttttccttttagcttctcccaccacctcaatagccacaacacactatgtacaataaatctcttgcccaagaaggcacttttgcctttgatcaataacatcattaagtactttcttcaagtgtaacacttttgtcacgatcttgtacatacatcctactaggaagataggtctaaactccccaaggccctgtgggtcgtcaacctttgggattagagctatgaatgatgaatttgagcctcttgaaaaaatacaaaatctatgaaattcttccataaacctcacgatgtcctccttcaagatatgtcaaaaagctttaatgaatttaaagttagattcatttaaactcaggcttttagcacttccacattgccatattgcctcctttacctccttctccccaaacctctcaacgaaaccaacactatcaatttgtgtgatttgattattttatgtctttcaatatttacaaaactaaatgccaattaaatctttgaattactatattagtattttagtgttaaaaagtttaaatgggaaagacatttctatttacaagagctagttttaaagttgtaaattatcaaaatatcacgtttacgtttctaacaattaatatgttgttaattagaattcattatggatatgattcatgaactaaagaaggtaactgaaattatcttattcttactaggtgatattcttttactagtaagaataagatagtgtcaatttcttaaacaaattaatttaaaaatttgaattgttatcttatcgttattctttatcttttcatgtttttttattacattatgataatgatatatatatatatatatataaaatatgatatactatcaaataaatttaatttaattattttataaaatgatttatgatgtatagtctacatttatgttaacatttagataaaaaaatcatttttttataattttaacatgatttcgtaagaaaaatatttaattttgtaatttttttatccactaatgatcattattatcaaaataaatatcacatttagtttagccttctttattagttctctgatatgaccgtttcgttctttctaacggcgcttcaatttattcattctttcttagttctttgacatgaccgtttcgttctttctaacgacgtttcaattgattcatctataaatacattgctattgtgtctgattcttccacaatcctactttcatcaaaacaggcttctgcattgctttatggttcaggatttctattcaagaaggaagagaaaaaatctaatagagggaagaagatgagagaatactgattttttcttttgacatgcatgcatggcagaaagcatgttctctgcgtcttccttcttctcttatgttttctcttctttctcgtactctttagacaattgcttggactgatattgaaggtgaggttttatctaatatgtattcatcttttaaggcagagttcttgattgcattgataagatatattgcaggaaattattaaagaaaatgaccaaggtgacttgttctaaagtattgtttttcaagaaggaagtattgtttttctttctacccttcttgtcgtgttaattgctccagaagtgttggattcttcccctgaaccccaccacgggcaccacctatccctctttcaggtttgaattaatgagatactgggagttagtggacatgcaacggtatgtgtatgacaaaaatgctgctttcttctcttgtttccttaatattcttgtaatttcaataatcttggaattgtttacttatttttagattgaaaagatggttaaagacattcatggaccagcactgacgctaattgttgagaagttgaaaccatatggagtttttcaaggcacgttctttggttcattcttcttcgcgaatgttggtgaatttgtgcttacatatcttctcttaactccctttttttttgtctttagagtcatttgagtcagctagaacagtttcagtggatgcaacatcgaaagcaaaggctgggaaatcaactgccaatggtgtttcaaaacatggaaatagagctgtatcttctgcatgttgatttttctttggttaagtacttttagatttgttttgatttctacctatttgtttcattatcacataagagagttgtggcaagtggcaacaaagggtgccaagtctgatcaatatctgttcaagatatagcggtccagtctcaagccttgttaagtaccaaggattcacataaggtattgtaggctgaactggagtacaccaaacgttgcttaaaatcttataaatatgtggttggactgccatctggattttcttggaagcaggaagttcaagagagaattgtggtttgaagttttaagtttcaggaaccacgtattgagtaaattcaagatcttgacgtgggaattttgtattatcaaataatgtttgaaaaactgagaattttattgtagctttacaagatcatgaaggagcataagaaccccaaggttagggaattttgcggatggtttctgctgtttaagattttggtgtctcacatataaagcttaatgtgcattatctgaatttgcaagttttttagatattttatttgttgttggaagtttgtatggtttattgtaaatcctattttgcaggacttaattgattttcttaaagaaatgggctgcagtcaagtaatgctgctactagaaatgcatcaattaattcttgggtgttctgcatagatttgttggtcaaggtcactttgcattaactttcaaattttgatttctctcaattttgttttcaaggctctaatgtttttctccttgcagacattaaagggtttcttcttactgatgtaaagcctgcactgttcagtgccccggatacaaagtatgagatgaatccattttaggtatattatgtttgatgaggttagttctatgcagggtcttaaatagaatgctatagcggtgtagcagagcagagtgacccctgcccgctacgggtgctgctgtagtgaagtagtttagtgtagtgtccacagtgaaccaaatagcgggttgaatagtgtctgtagtgggtgctatgtgttgattccaaaaaatccctctgaatagagacattagggcttgtttggagggctatttgtgggatttaatttcctaaaatcatatttgtagatgtaattatagtgaaaatgatgaagaaggctttgatttaaaaaatgattgttgatgatatataattcctatctaggaagcttgtatttaacgtttgttggtatttacttgtatgttttgtataagacgtctagactttttgttgttaatgatgaatgtcattggaagaggctaataagcacattcaagcaactggaactggtactccattagcattttttttaaccttatgctctctctttctctctctctctttagtctcccttttcatcaacttcctccccaaatggataagttgcatggtatctttttgtagttattctagatttctagctgattattttgataattgttcctaactgttttattaccaggtgagttgtttggggctcttaggggacgacttgttgatagcaacaaaaacattgtcatggcttccttgacagcaattggcaatgttgcatcagcaatgggtcaagctgtagagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgtttgaacatttctggaaatggtttgttgcagggtattctgtctgatatatattgaaatgtcttggtgacaacaagaagcacatgagagaatgtgtgctgaatacattagatgcttggctggctgctgtccatctggttgaaatggtctgtattctgtgctggttctgtgttctttcattcttttgtcctggtatctgtgtccttagcatggttttcctataggttccatatattgcaattgctttgatggactctaaacttggtgcagaaggacgtaatatttttttattggttatcggggcaactttctgtgttaagtagttttgctgaaggtgcacaactgctgaagcctgcctcttctgcaatgacagtatgatctggttactctgcattctgctttttcattttttataccatttatcgaattaggtctagtgttccatgttcttggaacaaaatgtatgatgacttcttcttaggataaatcttccgatgttcgcaaggcatcagagcttgtattaatgagatactgagagctagtagacatgaaatggtatgtgtataagaagaatgctgctttcttcccttgtttccttaatattcttgtaatatcaagcatcttcattgtttacttatttttagattgaaaagatggttaaagacattcatggaccagcaccgacactaattattgagaagttaaaaccataaggagcttttcaaggcatgttctttggttcattcttctttgcgaatgttggtgaatttgtgcttatatatcttcccttactcctttctatggtctttagagtcatttgagtcgggtagagcagtttgtgggtgcaacatcaaaagcaaatcaactgccaatggtgttttaaaccatggaaatagagctatatctgctgtatgttgatgtttctttgattaagtacttttaaatttgttttgatttctaactatttgtttcatcatctcaaaagatagttgtggcaacagagagtgccaagtctgaatcaatatattttcaggatcagtctcaagccttgttaaatatcaaggattcaaataaggtattgttggctgaactggagtataccaaacgttgtttaaaatcttataaatatgtggttggactgtcatctggattttcttgcaagcaggaagatcgagagagaatggtggttcgaaggtttaagtttgaggagccacgtattgagcaaattcaagatcttaaggtggggctgtttgttgaggaataatcatgcataacttgaactatctataagtattgaattataataaatgtgcctgcaattttcagaatgataaagtatttcagagaggaattacataggagactcttaagtgcagattttaagaagcaagttgatggacttgaaattctgcagaaggtgttgttcttttaaccttctgaattacattcttttgaagtgttgagtgcactagaacttgtacaaactgctattgcatatttcagacacttccatccattgctgaggaagttatacaagttttggacagtcttctgaggtggtttgtgttgcagttcttcaaatcaaacacaatatgtctattgaaagttcaatttatttttgtttttgttgtgatttcagttttcttcttttcctttccttccttttcaaggagatgtctggtgttagtcttaactttattcaatttaatttataggagtatacttacttgatagagtcttatcttttcttaattgcataggtgccggaatttcttcctgaactgcttgacactttgaaggacgaggggtactcttggaccgaatctgaaggggcagtgtttcttctgtgcctagtagagaaggtttatattagcaactttaatatttgtgacacctgaggatgttgttattccagtgaatctttctgatggtatggttgatttcagcaaatttttggtttacatagatactagtttgactagtgtacttccttgggtgttacagatgaggaagtcacaatgcatttcttattttactgttgcagttagggcataacattgagaaagtacgagaaaaaatgcgggagctgacaaaacaatttgttgccatatattctgcatctaaatgtttcccttatatattagagggttttcgctcagagaataaccgaactcgaattgaatgtgccaatcttgttggatttattattgatcatcatggtggaggtattattactatttttggtattattattcagtattttccttgcatagttactccttgcattatgtggacagattagtgggcagctaaagtcgttgcaaattgttgcaagtttgattgcagaacgggatggggaaactaggaatgctgcattaaatacactagctactggttttaagattctaggtatgccatacactgtagaactccatctttctggtttccaatgtgcttgaaaaatacttgtgcctagtgatatatatatatatatatatatatatatatatatacatctttgaaaaggaaacttgttaaaacaaaagtacatctgtgttattttgttgaattgggtagtgtttttgcatcagtgtgtaaatttcaagagtttctatggatgaccacttgaggaacttatggtagagcagtttcagagggtgcaacatcaaaagcaaaggctgggaaatcaactgccaacggttttttcaaaacatggaaatagagctgtatcttctgtatgttgacttttgtttggttaagtacttttcgatttgttttgatttctaactatttgtttcatcatctcaaaaagacagttgtggcaacagagggtgccaagtctgaatcaatatctcttcaagatatacgctccagtctcaagccttgttaaatatcaagttttttccaaatctttataaaataataaaaagttaatcaatttattcatattctgacattttaaaactatatattacattaattatgatatatatatatatacacatatatatgaatgaaggcatccaataattttaaataaatataattttttgtatgtataattttttaaaatttaaattcagtaattttcagatgaaattattcaaccaagacgtttcccgcatgcagttttcaaccaagacgctgcacgtgaaagatcccttagatttgtcaaacatgagctgaagaacccatggattggatatacaacaacccccttcgttctttgcttttcttttgtattttttaggtagaaagtcagcatttcactgctgtcgtgcttaatatatatatttactaatttattaacaatataaaaggttgttcataaccataaaaagagaaaagaaaaagagaaaaaggttgttcataaattaacaagtcgtatttcactgctaatgttcttgatgtgtctttgaatggaattgaacatcgaaccgaaaagttaatcttcctttttcaacatataaaacattagttaagaatcaagtttttttttaatgtctctctcggcgtcttctcagttaaattctaaaaactcgtttaagaaatttaaaaataaagaacctttactgagatataaatttgtcacaaagaaattttttatagaataataaatatttaattgaagaaatatagaagagaacaacgacaaaaaaaattaaattaatttcattctataaaactattgtcatgatagcaaagttaatttagttaacaaataattgtgtatctcttgtttatgacaactgacttgggtccacgtgacttctaaaattggtattcagacaagcaagcaagctattggtcatcctaatactaatcgtgatattcttaattaattcaaggtttttgtttcaaagctatactaagaataacgtagcaaaattttgtattctaattctacaagataacattccactttctaaagaatgaagagaagcaggttggagaaaaggaacaaattacgcgtcgaagggctgctgctgtagtcttaattggccaaattggcgaaacgaaacaccgttggtttagaagacataatcacaaatttcatcaaaaaaaaaaaaagaagacatggtcacaaattgggaaagttatttagactcctatgttgaatggactcaggctgcttcattctaattcttctgttaggactgtagaaaggtcattcgagagtaccctggaaaaggaggcagcctccaagaagacaagaacagaagcaaaagatgtattattttccaagattggtgctattgacaacagatgtactaattcgccgcaaacatgataaagataacaaaaacaccttcactaacagtttaactaatttactagtattatgcatctgcttcttcaacaacacaccaaaaagcgccaccacacaggaagctcaactagcagatggtggacgctgctgtgaaagaaaaggtacttccaccactgttcccttgatgttgtcaccgacaattacagtgtctccttccgaagcagctcgcctcttgatgtaacctaatccaaagtgttcagattccttccttccagatgtgtagctggttaactttccaacctgcaaaacttgcaaaaaccatcaatttctttccaactcgttaaggagaatgttaggattacagaaagcaacccaacatcacaagcactaggctactgactcagggaaccactattagttatccattttttttacaagatggttctccagagaaacattgtaactggagttttcaccacgtacctgtcatctttagtttcaactgggaattacgctatgcaaatttccatcttcctttttaacaaatacataaggattgaagaaaaaaatagtgaacatttttcaaaagaaattatatagcacctttttcccatcaactgtaataatgctgccaggttctgcaggagcagaaagatgaaatccccataacctctgcttgattccatcatatgttatgagcctagatatagtctcctgacctttgtaacaacctgaaaaattcagtcagactaattattcagcaagtttcaacttttacgcagatgggtagcggcaaaagaacagttacacacccttatttagagaaaccgagttccaaagacaggcctccaggacattgaattcatttgtaagctccattccaggagtgggccttcctaagaaatcaagttatgatcaatattagataaaagaatcatagggagtgaaactatatacacacaaaaaaaaattactcgcatttcaaaaaacttcccagtttcattatccaatagaatataccattcaacccaaaggcaaatattaaatgcttacaaatcttctagtagttataaaaaccagtcattcattttttggttttacaaaaatatcctccataggaagaaatttgcttgacatatgatcaaacacaaaatgagaacctctcccaatagggactgaaactgtagttcaccacgttatggggactatcttccattacttccaaccctcattggtaatactagctattcttaactagaaggaaattgtgcactccacaattgacatctaaatgcatttgtattctttcttgcaccaaaagtccgcatgggcttgaagcattttttacatacaccggaagaattaggttgaaaataacatgatgagaattcaagtaatgtcataattcctaattccagtgtgcaagtgtgcaactgtgcaacctcaattttcattagtggaaaattggatcttggggaaaaagaacaaagatttatttatgccagtatcattagtctccaagactactcctaaataattcctaaattacgacagaaacaatatgcaggaaataagttagtatgctatattattcaactgtagaaaccaatgacagacatagaaatatgcacacaatctaaacaattcagtacctcgaataatccgtaatttattccatgcattagaacccattgggattgctccttgagtaagaatagctttccaaatggatgcagcagccgctggagacatcaataatgaaaaaccatcttcagaaatgatgtttccaacccctatagttacaggctgcttatcaacctacaaattacaatacaaatatatttgagagaatttgttcacgataataacaaaagactatacaggtctttaagctttcaacaaaaggaataaacaattggaaaaaacaattactaggttttggtattgcagttgaaagtttactactttggaagtaacacatatacacatgagaaatgctaacaatacactctctagcacactcttttgaatacactctctactcttggctaaaatttaatgaaaatcacaaaaattgtgcaggttcacttcttatttaatgaagttcattcatgatgttttagtttttgataggagtaggattaggaggtgggggcaggtgtacaaaaggagggacaattagcacaatatagttagtaataactaactgaattgttagacagttagtgggggggttagtatacagatacggaaacagggtagtgggggggaattatcgagattgtaattgggaggcatgagtacctcgaatactcatcacagcagctctgtaaacacattcttcagcaataataattcttttcgttcctaaattctgaaccagtgtctatcaactggtatcagagctccgatcttggagctgggcctgattaatggtgcagaaaaacaacggaagaatggaggcgagaatggatatgatggagcgggctatcgaggaaacgcgcgactccatggaaactcgcttacgatctatggaggacgcaattcagaagcttgcggcggtctgggagcaaccagcggcggcggcgaaagctagggaggaggaaacgaggattcgcaacaaggagaacgccggaattgggggagggaagtggcggaatcttgaattacctttctttacgggagaagacccacttgggtggctttccaaaatggaaaggtatttccgcctgcaatgtgtacgagaggatgataaactggaggcagtaatgatggcaatggaaggggatgcactgggttggtatcagtggtgggaatcttggaacccaaaccattcttgggaagggttcaagattgcaattgttcagaggttccaaggggctaatctgggaagcccatttcagttgctgctagccttgaaacaagagacaactgtgcaagaattcattagccagtttgagaagtgtgtaggcacagtgaaaggattggaagaatcgtttttaatagaaattttcctcaaaggattgaaggaggaaataagcactgaggtgagattgcatgagccgagatgtttgatggatgctatgaataaagcaaggcaagtggaagagaagaatagagtgctgggaaacataaacagaggctacagcaaggggttcaatgtgcagagacccagttttacgaatcaaaggaatgcaagagaagtgccaatttacagcagtaagactgttgaagcagtgccaagcagcaggggaggggagaatgaatggaagggaagaaggccattcaagaggttgtctccattagaggtaagtgagaagatgaagaaaggggaatgctttacatgtgaggagaaatatcatcccaatcatgtttgtaaaaataagcagttgagggtgatgttaatggaggaagaggaagacacagaggaggaaaaagaggaggaggaagaagataagcatgagttacatcaactgtcattacacagcattgaaggatttaccaccaagaaatcattgaagctgtggggtagcataaaaaacaaaatggtaattgtgttgattgattgtggggcaacccataacttcatttccagaaaattggtagaggaattgggtttggaagtgaccccgacaagcccatattcggtggaggtaggggatgggcataagataaggtgtaaaggagtttgtaaagctctgcccatagttctacaggaaatgcagatcatccaggattgctacctttttgaattgggaggagctgatgtggtgttgggagtggagtggctggctggattgggtgaattagaagctaactttgataagttgactttaactgtcaaggtgcaggacaaaagggtgactcttaaggctgatccagaattgataaaagctgcaatcagtctgaaattgataaaaagagcatggaaagaggaggatcaggggtatgtggttgagttgaaatccatgaaacaagaagaacggaaaggaaacattcctaaagtgatggaacagacattgagggaatttgaacaagtgtttcaagaacctcaggggttgccacctagcagagaaaaggatcatgctgtgaacattcaaccaggaaataaaatccctaatttgaggccctataagtaccctcattaccagaaggatgaaatagaaagattggtaggggaaatgttgtctgtgggtattataaggcccagtactagtccatttgctagtcctgtgattttagttaaaaagaaagatggaagctggcggttttgtgtagattacagagctttaaataagatcacagtgcctggataaattccctataccagtcattgaggaattactggatgagatagggggagctaagtggtttaccaagctggatttaagggcaggatatcaccaaatcaggatgaaggaggaggacattcacaagacagctttcaggactcatgagggacactatgaattcttggttatgccctttgggttaaccaatgcaccatctaccttccaagctcttatgaacgaggtactcaggccttttttaaggagatttgtgttagtattttttgatgatattctggtgtatagtcagtctatagaagatcataatatgcatgtacgagcagtattgcaaatgttactgcagcaggaattgaaggtgaataaaaagaagtgttgttttggccaagaatccctagagtatttaggtcacattatttcaggccagggggttgaagctgatcccagcaaattagaggccatgtctaactggcctattcccaaagatgtaaaagggttgagaggtttcttgggattgacaggatattataggaggtttgtgagaggctatgggaagctagcacagcctttgaatgcattgctgaaaaaagatgcttttaaatggaatgcggaatctaccatggcttttgttcaactgaaggaagcaatgaagcagttacctttattaatggtacctgatttttctaaaatgtttatcctggaaactgatgcctcaggaactgggctaggagcagtgttactacaagaagataagccgttagccttttggagtaaggcactgtcagaaagaagccagcagaaatcagtgtatgagagggaactcatggctgtcgttctagcagtgaaaaaatggagacactactttttggggaaaaaatttattataagaactgatcaaaggagtttgaaatttttaaatgaacaaagattattgagtgaggatcaatttaagtgggccactaaactgattggttacagctttgagattcagtttaggccaggaagagaaaatattgtggctgatgctttatctagacagtttgcttttcatgctatttcaagagtacaagaagatgaatggggagattgggaggaagaattaaaggctgatccagacctgcaggcaatttatcagggaattttgactaagacagcagagaaggcagggtatgctataaaaggcggtaaactatattttaatggcagattagttttgtcaaaaaattctgctagaattcctcttttgttgaaagatttacatgattctgttgtgggaggacactctggattttttagaacatttaaaagaattgctaatgtagtattttggaagggaatgaagaaaactataagagaatatgtggcaggatgtgaaatttgtcagaggaataaagctagtaccctatctccagctggtctgttacaactcttacctgtaccaaccagggtatggactgacatatccatggattttattggagggctgccaaaagctgaaggaaaggatactatcttggtagtaattgacagattaaccaagtatgctcacttctttgcattgagtcatccttatacagccaaagaagttgctgacttattcattagagaggttgtaaagcttcatgggtttccagaatctattgtatctgacagagataggctgtttatgagcctcttttggaaagaaatattcaaacaagtaggaacccagttaaaaatgagtactgcctatcatccacaaacagatgggcagtctgaagttgctaataggtgtttggaagcatatctaaggtgcttgactgggtccaaacccaagcagtgggttaaacaattggcttgggctgaattttggttcaacactaacttcaatatatctgccaggatgtctccatttaaagcattatatggacaggacccaccattgttaattaagagtggagacagtccttcaaagctggaagaagtgaacagattgagcagagacagagatgagctgttgcaagaattgaggagcaatttactgaaagcccaagatcaaatgagaaaatatgccaacaagcacaggaaggaggtagtactgcaggaaggtgattgggtttttctgaaattgcaaccctatcgaatgagatcattagctaagaagctaaatgaaaaattaagtcctaggtactatggaccatatcaagtactgcataggataggagaggtggcttatcagctggagttaccagttggaagcagaatacacccagtatttcatgtatccttgttaaagaaggctatcaaacccagttgttctccacaagctttaccagtggccttaaatgaagaatgggaattacaggtttatccggaaaaaataatgcagaaaaggactgcagcagatggcagagaagaagtcctaattaagtggcaggacttaccacatgaagaggatagctgggaaatggctgaagagatgaaaaagattttccctcatttagaccttgaggacaaggtcaatcttgaaggagggggtattgataggagtaggattaggaggtgggggcaggtgtacaaaaggagggacaattagcacaatatagttagtaataactaactgaattgttagacagttagtgggggggttagtatacagatacggaaacagggtagtgggggggaattatcgagattgtaattgggaggcatgagtacctcgaatactcatcacagcagctctgtaaacacattcttcagcaataataattcttttcgttcctaaattctgaaccagtgtctatcagttttccataaattttaaccaataagagagatgttgttagcactccttttcaacacattctaaattttgaagttatgtaaaagatgcaaccacaatccaggggaacttgttgccaaaaacaaaagttgcaattacaaaaatatatgctcgttaaacaaccaaaatatgcatttctgacagaaagaaagttatcagtgagaaacaaatacatgaagcttaaaactagcaaataagacatgattgatcatgtaagttgtttttggacaaaataaataaataaaggcataaacccatgcagtcatcatcaaatacacatgaccagttgtatcttgtagagagaaaccggtgatgaaaaagacaactggtaattagaacacatacttcaaaaaagccagtttcatccagcttacattaaaatgtagatgtgtgccatatggttttccgacaagatcaccaaggttcaagttctccatcacctgcccattcattatactgaaaattaccaactctgtcattctcaacacaaaataggtataattatgtaacttacttggccacttttgggtcccaccaaaacaaaaaaactggtttgcttagttatgtcttgaatctctaccttatcagcaaaaaatatgtaccttaaaatcattacatgtaaaagatttagttcatgtatttgataatattcataggaaagaaaactatttggtttctctctttatccttttagttttacttctgttggtaaatccttacatcacaactaacaagaaattacctacttgttcagcatttcagtaatggttgtacaggtctctggtgaaaccactaatgttatcgcatttttctatcaaaaaccaacaagagaaagtggtcagctacatgataattaattatattgtagaaaagacaaacaaatgaattttgtgagaaggataagaaaagaaaatcaccatgagccatgcatgtgcgatatctattgttcgagctgttggtgttacaaaaacagtgtcacatccctaaggatttcagttagagatccaattacttaatcctgtattataatatgaaatataaaaaagaattgacaagaacttgccaataacatataaatgtagaaacaatgctactttctttcaatacatacttgtccttcgtgtagagattcgaagtttgcagtactctggttgtgaaggaactgaatgcgatcttctccactgactttggttcaggtgaggcaaaacatttgcatgtaaaattaagaaaacattgaaatatgtcaaggaccaactcttaatagcctaagaaaagcaagtacctcttatccgaccgaagtgtgaaagatccacaacctatgccatcagatgtcataaagaattaatttaagcaaacaaataaatcctacattatctaacaatatattaatatacctttataaattggtaagcatgcaattataagacttcaaatttgtattagcttttacaaaaacttgatagcaagctatcacataatatttttgtagaaactctagaattacaattcaataatctacaaccttgagctaatccaagtccacaaaagacatgtaggttagttcacatttactgtactacttctatttttttaaaattacagactgaataaaagaagttccagagtaagtaatagaagttacaggttgaaaaattaaagtctgtaatttttatgagtttgtaacttttataactcaaaccaggaaattttataagttcgcaacttctattactcaatgtgtaacacttgacataaagtcttcaatttcaaaaaataataccaagcctgtatcttttactatttaattgtagcatatgatataaagtctactgcaatttcaaaaaacaaatagtacagtactcctttttttagagggagcatcaaagtgaaccaccaaagtcaaagagaattaagagccaacgaaataagcagtgaagatttaccatattttgtttggactataaggcgaagcatctctagaaccataaataaatcaattcaaagaagcaaacaattaaaacatgcattgattcttgtggtttatattgtttctaccaaatgaagttgttcaagcagagataacaagaaagcacattaagctacaggcgtaaaaaaaaaaaacaataaataaattacataccacaaccccgttgtccacagcagccagcgcttcatcatcattatgaaatgtctcaatgatcccttcaccagaaatctctgcgcctgcagttttgatagtatcctgcaatgagtaaaattaataatttgacagtaaaaaaattgcacttagccacctgatttctcttctcaagcaatatcataagggtattccaaaaaacaagagtcataatatatttttagtccttatatgttacactcattttaatttggttcttatatgacaaactttcaattcagtccctacacatatcctttaaatttagtaatcactgtctgttgttgatatgatattgtctgtcggagggataactcaatgtagtgtagaaccaaataaaaaatgtagggatcagaaatactctatttttttgtagtgacaatcattttcaactcaattcctaggtaaacttattcgtaaatccataccagtctcagtatgaagtggcaacaaacagcaagaacaacattgaaatatattatacaaatagagactaaattgaaagccttttacaattaggaagccttttaaaagcaaaattatctgttttttctttaaaaaaattgtaaaatcgagttctctactgccataagttatcaatcacaaataacagcgcatagtggctatttctaaaaatgctatagcagcgtggtcactattctggatttttttacagttgatataatgtatatccatataaattctcaaaacagataaaaaaattactcaaaattcatgacattcataattaacaataaaaattcataggtgtcttacacaaaacatacaagaaaataccaacaaaagtcatggtaattggtaaccactatccactaaggtttaagcctctaaggttagaaataattaaattgtctaaacgtattcaaaataaaagttttctagatatgaatcatcaatcatcatcttctaaatccaagtcaccgtctttatcgttttcactactgttacagctgtagatttcttcctcttcctcctcttgaacataatcaatttctaattcttctgctgaaggtgcagcacctctcctcagttttatttgatgcctagtgcatgttgaagtctcacccacaccagctaaattggcaacatctcccccaatcaagttgttgtcacaatcaaaatccaaatcatcttcagcatcctcgccatctcctcatgtctcccactaaccattcatcactaccatcaatatcatcaaggacaatgggatgacatcacgagtgtcaaagcgttgcttaagcgcttggttatatttaatataaaccaagtcttgaatcttttgatgctcaagcctacttctcttcttcaagtaaatctatattataattaaaacaagttagtttcacaatcattgtatgaaaactctatatatttaaaacttctaatattgacgtatgtgctcaaaagtactccaattacgctcaaatccccatgaactacaagttaagctcagtactttaatggcaagcttttgaagatttggagtatgcaatccctcctccaccagtcagctgtaatgcagtgcaacaccttatttattagggcaactaacttaaataaattgttatgaaattaaatttcaaaaaaagaaatgcagttttgcacttaccaggagctactgtagtcttttgccttattgccactttatacgtagacaactcgcttaaaatcttatctacaggtttgttattttcactaagcctctcaatgcacctataaagtccttccatcacttcaggatcaagatcaagtcttgaattttttgtagaagaactcgggttttagaaaatgacctgctgcatgcaatggatgattgagttgacatttccatcttctatcaatgattgcaaatatttctttgtacttttcttcattccctttgaaagaactttgaattgtctccttggctctatcaattgctttataaatgtaacccattgcaggctttttctcattattaactagcctaagcacatgcacaataggccgcatagccttaaggatgtaaacagcatcattcctaaatgaaggcataagaacaatgccagctgccctattcacctcatgattttcagcaatattagttttcatccattcatccgaagtgaacattcttctaagattatttttctgattatgcagcctttgcaaagtaagaaatgaagtaacaaaccttttcactccatgtctaaccaattccatcttgtttgtgaactttctcatcatgttcaaagccaatgtgtggttatagataaaactaacaagatagatgcctcttcgtatagcctttttaacttcatccatcttcccaatgtcctctagcatcaagtgtaacatcctttataattttatttatttatgtatacttaattattttatttcgtttattcctttaattcgtcaaatagaaatttagtagaaagaatttaaaacaaaaagtcattagataatacattcatcgcatatcattacacatagttcatacgggctttaatttacaatcccatcatcctagtgtttttatttatttacaaagtgctccacccctcactttcaaacgtagtctccattactatcttcttcgctgagcactattatggggtccgtgataggattcggatacacgggagcaaactgaaggaagggatcatatggattaaattttttactaaaaacagagattggaaaatgagctccgaagtagatgtgagctcggagaactggctgcatggtgactacataacaatttctgacttcagcaacgtaccaagctatatccaatgtatcaaggaacagtatgatggaagccatctaagataaaacattaaataaatctactgagaaatttttgatgaagtcagaaattgttatgtagacaccatgcagccagttctccgagctcacatctacttcagaactcattttccaatctctgtttttagtgaagaatttaatccatatgatcccttccttcagtttgctcccgtgtatccgaatcctaccacggaccccataatagtgctcagcgaagaagatagtaatggagactacgtttgaaagtgaggggtggagcactttgtaaataaataaaaacactaggatgatgggattgtaaattaaagcccgtatgaactatgtgtaatgatatgcgatgaatgtattatctaatgactttttgttttaaattctttctactaaatttctatttgacgaattaaaggaataaacgaaataaaataattaagtatacataaataaataaaattataaataaataaaattataaaggatgttacatcaagtctatacaataggaagcaaatggagtccaaaacaaatgctccctcttgatttctaaaattttccccaagactgaaatcaataaacttaaaatgagtaacaaactaacaattaacaattaaaattgtgaaattaattaataataattcttacaagctaatacaaaattagctccattgttcgtgatcacttgcacgacagtttttctccaatatcctcatcaaaactatccaagagctcaaatagtctcacctgagtcaccgcagtcttcatgcacctagaagcatcaacgctcctcacaaacattgatcccccttggaaaatccaccaaaaaaataatcaaggttctattcattctatccgtcaatgcatctaacataactgaacatccatacactgctcgttcttcttcatgactcttaagaaatccctttgtgtattccaactcctttttaaggagtggacctctaaacacatggcagcaccattggttacaaaggaatcccgtttgtaaccaagaatcgtactatatattgctctagctttcctgtcagaagcaccattacaaactttggcatttcgggccttcttcgaagcagataaagagacctctcctgctgttagaggccttttccctctttggagattccaaatttcccgcatatcttccatctcatgttgcaactcattcccggcaggtaaagagacctcaccagttgttagatgccttttacctcttcggagattcgaaatttactgcatttcatccaagtcaagtcacggtacagaaactcattgccagcaggtaaaaagacctcgcttgatgttagataccttttccctcttcggaaattccaaattgcccttattcttccatgtcacgttcatgcatctcattcccagcatgtaaaaagaactcacttgatgtttgaggtcctttccctcttcgaaggttccgaattgcccgcatttcttccatgtcacattcatgcaaccaattcacgttgcatgcaacatcttccccttgttgaggggaagacgctgatgcagacccttcctgttgcgagggacgttgccatgacttagaagaaagaggcacgagtcgccggacagaagagaaaaactagccggaacggagagaagagaggcaaagctaggtcgaggctgaaaaacctttttcataaaatagccgcaagaaaaacctaacgtgagggatttttcggaatgttacgggtgcagcgcgatagcggcgttacactccgcgattccggcgacgctgaatcgcgccgcgaacgacgctgtagcgacgctattgagaagagtggagagcaagaaataagaaagggaagtttacaagtgctggaaaattaccaggaagtcatggtcgatgggaggaggagaaaggtcgaaaggtgaggactgggcacaaattgaccaagacatgagcttcttcttcttctccttcacgagatggtggtgggaccaaaacgcaacgtttcggggcaacacagagagacaccatgttaatgcttggtttggaggatggttcaaccaagttgcagctgctgccaccggcaccaccgttgttgtcattttggattagataatggacaacaaaacagagtctctctgtctctctctcccacaaacactactctgttcgggatttttattcttggaacccgtgcacagttttttttagtaaaaaacagaagcgagagatacaaaacaataatataaaatgtttaaattttatataatatgtagattaggagtcaggaatgcagtaatacattttattaccttttttgtattttttttaattattatgagaaaatacatccgattaccaactaataatacattataatacttgtttaatgttttttattattatgaaaaaaatcaattacggactaatatgtgaatatataattattaacatttattattaacaagttggctaaaaagaaagattaagatgtcatgtaaatgcttgattttgaggagtgttcaaccaggctgctagtaccatttttgtcattttggattagatagttaataataggctgtctcaaacatgcacgttattctgctccgcacggtgtacaattcaattttaatataaaataataataaatacaaaacaataaaaaagtaagttcatgaggtagagaaatttgaccaaatgaattgcacaaaaaggacgcaaaaaaagttgtgtttgaacattttgatttttttaggaattaattgaacatttgataattaataaaatatattaaattaaatagaatcaagcgcaataaataaaaatcaaatagaatgatacattacgcatagcaaattttcattcaattagatgcataatcacatatagagcaaaccatcacaggaaacaacacattgactcaactactgggctaatagaagaaacacggtgtacagaataggcactacacaattctgcagcaggatgttgatgtgattgaggcataaccactgcaaaaattcttccagattttttatgctaacatgtagtcaactaaactatgcactctagttgggtcaaataaataaataaacactctagtataatttgatttttggtagtagtctatacatgattaaaccggatcagaaatgccaaatccacctccttcagtggccccgagtcttctttgctcagattcaatcacgcgtgcaatcgggttcgcatagttgtgaaactgcgacaattcacacccaaaaattcaactatttctctattataacaataagcaaaacacgcatcatcatgcaatatttacaaccaacattataacgctaagagcaaggattgaagcaagtccgtcaaaaaaattaaacaataaacttaatagtagagttcaagcgaaagttgtattggctaactttagaaacttttaaaatttaatttttctttcatggaggagatgggtgcaatttaaagatttttaaaccaagcctgttgattagatcacacaggtttcaagaataggataaatggccatttaccgcttcaactagctcttcacatttgcgcgctaacagtgccactttaactgctccagcttcttttactgctataattttactacttatggcatcgacctgtcatttgcagataagaaataacaatttattctttcacctaatataattgatatatcatgaaacttaaggaatgccacctcagataaaacagcctcgacatttctctgccttgtttctgtaacagatctcttagattcaacatctgattttgtactacttaagtatttagttgcttcttcccgcataatattgcactctttctccaattgcttccatgattcttccatctgctcaactaaggaaaaacaagtcgaaaaagttggaggtaaaacatgctagtaacaaatattcatgcttaaagagcagttatatgtggcatgaaagtttccaacaaaaatcattaaaaaaataatgtggcgtacaaatgtgctggttttcaatcaccaaatgctgttaaaaaggaaaacaaaattattggacaaaaatcatgcaggttacttgtgaacaggttttacagaatgtgtttcgtaaaaattatcattactcattcttaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtacctctctcgctctcgctctcgctctcgctctcgctctctctctctctctctcatctctcataactagtaacaaatattcatgcttaaagagcagttatatgtagcatgaaagttttcaacaaaaatcattaaaaaataatgtggcgtacaaatgtgctggttttcaatcaccaaatgctattaaaaaggacaacaaaattattggacaaaaatcatgcagcttacttgtgaacaggttttacagaatgtgtttcgtaaaaattatcattactcattcttaaaccnnnnnnnnnnaggagcaaacgtcgtgatgatatctccagttaagatttcttcttgctccgccgcgtgctgccgccggaaccgcagcgtggtgtctgtacctatccccatcgaacctatggctaggagggtatctctctctatcctccccgaaatatctctctctaccctccccaacgtacctctctcgctctcgctctcgctctcgctctcgctctctctctctctctctcatctctcataactagtaacaaatattcatgcttaaagagcagttatatgtagcatgaaagttttcaacaaaaatcattaaaaaataatgtggcgtacaaatgtgctggttttcaatcaccaaatgctattaaaaaggacaacaaaattattggacaaaaatcatgcagcttacttgtgaacaggttttacagaatgtgtttcgtaaaaattatcattactcattcttaaaccatgtagccagaaatggagacacggcaatgcttgcacaagaacatacctttactctgtttttcaaccaatttggcctcaagtgacttctccaatatttcttcatcactaagtttagccttcaatgctttaagatccttttcaatagatttagcagaatttacctatagaaggcacaactgccatcaaacaaggttttgcacggtaataatctttgaagcaatgtgaagaagtgcttcttgcacatgagtctcaattgagaaatttcacaagaaaaatgttgtttccattgatgttgcaacaacatcctctgctcctctgatttctaatttggacactgctcaagttaattttaacactgcttaggctaattttgtgcaacagaattagaattctatttctaatcagagtcagtccacaaactactctcaaacttaaatgaaactgaaagtaaatctgagagagaactaaattgaggtgaaagagtattgtattcaacccaaagagaaactgagtacataacagctacagatatgtaactgtcaactaacttgagtgtcagtcaatttgccaaagataactattcatcctaatgtttgcttggtgaaatctcaggtatccaatgagatacttctcaaaggaaatctaggttctgatggactgtacaaatttccaagtttgctgtcatgttcttcatctactgtcaagacaagctctcccaggcctagttctatttttcctatttctgttttaaattctgtcgctgtaaaatccattaattcaagcgcttggcactctaggttaggccattctagtgtttatgttcagaaaattgtaatgcaactttgtaagatttcatttatcaataaaactgagcttgactttttgttattcatgctgtcttggtaaagctcacagattacactctccctgttctctcacaacttatataatcaacctctggaactaattttcagtgacatttggggaccagctccctttgtttcctctacagggtatagctattatgctacttttgttgatgcctatactaggtatacctggatttttcattttttctgcttaaaacaaagtctgaaacactaaatgttttcaaacagtttcaagctatggctgaaaggcaattaagtctacctattaaagctgtccaaacagactggggggagagttcagaccttttactgcctttttacggcaattaggtgtaactcatagggttatttgccctcacactcatcatcaaaatggtgtggtagagagaaaacatagacacgtagttgagcttggtctcactcttttagctcaatctcttcttcctcttacctactgggatcatgcattcttaaccagtgtttatcttatcaacagacttcccacctcttcccttaattttgatataccctttgtcaaattatacaaacagcaacctgattttcactttcttagagtgtttggctgtgcctgttttcctctcttaagaccttacaacaaaaacaagtttcagtttaggtcccaagaatgtgcttttctagggtattcacctggacacaaaggatgcaagtatctttcctcagatggcagaatttacatctctaaggatattgtttttaatgaatctaaatttccctatcctaaactattttcatcttctacttcttcacacccttctttagagtctcatgttcctatcaccactatcccgcttgtgtctatacctcccacacaattacataactcttcctctgttgcttctccagccagtaccttagaaatttcaacttcttctctacctcaaaattctgtctctcactcacagtcaagtcaacctgcccctctcctttcagttgacactcaaccaaagcttgacactcaaccagattctcaattatctactgctattcatgtagatgagtctgaatcatatactgctgtaccctgcagatttttctgttcccagttctgacatacagcaactaccactcattccctctattcctcaaaatactcacccaatgcaaaccaaatccaagtctggaattgtgcaacacagaattcatcctactcttcttcttgctcacatggaacctaagtctaccaaacaagccttggctgatcctacatggctagctgccatgaaagctgaatatgatgcattgattaagaatggtacttggtcacttgtttctttgcctcctagcagagttcctattggctgtaagtggattttcaggattacaaaaatccagatggttcagtaaacaagtacaaggccagattggtagctaagggatttcatcagcaatatggaacagattacactgaaactttctcacctgtcatcaagcccatcatagtgagacttctcctctccttggctgccacctatggttggcctcttcgacagttagatgtgaatgatgcttttcttaatggcattcttgagaaggtgtatatgcagcaaactccaggttttgaatcttccaccaaatcaatggtgtgcaagcttcagaaggccatctatggtctcaaacaggctcctagggcctggtttgataaactaaaggagattcgactgaagttagagtttcttactccactaagtaaaatgtattggttttttacttagtggaaattgtcaactgcaatctgttagtttgttagatgttcctaactataggttctgttggtctctctatatataaagagttgacaaggacctttgtaacatggcttgatatttttctaatcaatgaaatcagttttacaatttctatcagtccataatagatctcatatctctaactctaagacagcattccaattgtgagttccatccaaaaaataaataaataagcttcttgtcacagtatacatggtgaattgatagtaaattttcaatcattatgataaacaccagagcagacgtcaactaacaagagtatgttaatacctgttcttgtatatcctgcatcagcttgtagtgttttgacattttcttgtacacctaagataagataaaagataaaaagatctaaattcaagaacaaaacatcatgaatttatccatagttacagctgtttacattgtagcttgccttctgaaataatgagtaaaaaaatgtccagaaaatcagtgcataaattattcaagtattgtagatatgacagaatgaacccacagtatgcatatcaaattcaatcagtcaatccatattggcatttgatcttccagtcaatattcaagggacgatttggcttgcataagcccaatccagcttcagcaccaactaattgacaactcagttgatacatgtgccataagactcactagctcaaggctttacaaaattcgaatttatgttgcaaactgcaattgcatcctaaagtaaatctcgatggaatgtttggttggaagaaaacaaaatagagtgaacgtaaatacaaataactacatattttcttttgtttgattagagagagaaagtgagaagaaaagaagttcaaaaaaaaattcaaaacttcaattccttccattttccttttaatttcaattcaaaatctccaatggaaaatttgtgtatatgtgtgatgatataagatcactttaccatgaccaaaaaggctaaaatgcagatgaaagggggataaaagaagagtctttgacaatgtaccttggaaaaaacttcaacaagggcagtcttctcatgaaaagcttgcattgctaatctttcagcattccttgcctcctcacgagctaatttcttttcctctaaagccctcttcaaggaaaatcagagataaaatttacataagaactggcagagtaaaatgagccaatgttttttccaaaactagtatcaggtcaagttgtggaactaacagaaggaagatagtccaataatctccaatataatattcacacaagcagattgtttggatagaaatgcaaagtatgccacatttttgtagctaaaaacataaacaaaaccaattaactttgattatgcctacaacataagagcaaataaacaacataaatgaattagggttgctagctacaagggagaaccacataaaagagggggaaaaatacctgtactttatcaggtgattgaccgatttttgaacgtagatttgcattttcttggacattttgtaccaatgtaaattcggcatttgaaatctgggatacgaaaaggaaaatagaatgaataagaattaacataattcatacatcaaggagtcaaattttcagaaggaacgggaattgatgttagttagtagacaaagaaaggaatctcaaaatccaaactaaaaacagtgctaacaacattcagaccacaatgtaatatgcacaagaataaagacctactcatcaaaaccaaagccatgtccagtgtctacacaaatgaggaaacactaatatccaacaaaatataattaatctggttaaaacataaatttccaattgtcacagcagaaaacgaacaccatgtcaatccattattggccaaagacaatcactgaccttctcatccgtttccccggtcttctccttcaacttcctcaaagtacttcttagagaactctggttgctgttcagcaccgcaatcatttgcttgagctctttaacttgggcctccacctcctcaacaagaggcatctccttctccttcgcctcattgcattccgaaatctccgctttcaactaaaaaaaaacactcagcaaaacacacgctcagttaaaacctcaacgagtttgaaattgagattgagatgagattccaatacaaacctgcaaaatcctattctcctccaactccgttcgctgcgcctctagagcgttcacttcctccacaatttccgagacggagttcattctcgcgtccctgagataaaaaaataaaaatgtttaggttttctctcagcgaggcaataattaatccaagaggttaaaagagagtgacctatcgaggcaaaaattgagaagagagccaaggaagagatcggttcggtgaggatccggcatgagaagatcggcgagggtgaatttgcgcggacactcgagtgttgtgagaacttcgttgatctggttgtagagtttcacggcgcgaacggaatccacgtggaaatcagggttttcaagatgctctagagcgtggaactcgagttgctcgttgtcttccctgcggaaaatgaaaagaataagaatctgagcgaggaatgtagaatcgaagaaggtgcgaaaagagaagaaaatagaaagagagagagagactcaaggagaatgtcgagatgaatgaggacgcgagtgtagagatcggagatgaaatcagggttagggttggtgaagtcctgctccgtcacgttcgcgatctgcaactgcgctaagattgtgactatttccggccgccggagccttgggtactcgtaattcgactccgccattttcttcttctccaaagcccaaacgcaacctctactcgagagaattcgggcttcgactcatacgagacgagactataagtacaacggcgaaattgattaaattgaaaacaaaattagtggccattttcccgcccagtactttcccacagaggctgattcaacaaattctcccaaaattacagggaaaatactaaaattggattattgtaaaatataggggaaattgtattaacctctttttatgctttttttaagaggtaaaataccactctttttattctttaaatgagataaattaacatcttgtatgatccataaaattaaatgttttttcaataaaaatgaatttatttcattttattgataataagaaatgtaatatatgttagaatgtagtcaaagatattaatattaatattaatataggatcttgttggattggcaagaaagttgatatcatgatttgaatcattttaatgttttgaataggttaattattttaatatatgttagatttcatggtttaaaattgtcctattatttctaataaaaatcttttgttttgttaaagaaaaaaagtaaataaaaatccaacacatacaatttttgataacataagaataatgtgtaagtcgttaatacttcatgcatactgattttattattatataataaattttcacgcttttttatatgaaataggctaatgggacaagttgagcttatataaaggcaaagtttagacctaaaaataagctgatgacaagtagcatattcaaactttggacataaaaatataaagtaggtaatatccaacttaagtagaccctaacttggctcaacccttgcctccttaccaaactaaccatatagtttgaaaaataagaaagcctatatttacaagctaaaataatggtgtcaatttcagtgctggatggaacgtcgtttgttgaaaagcatccatgatggtctcgcaatctaactcaatctcaatgccaatgactccaacgtctgatagctaactaattgtctccatgaaaccaatatccttcaccttttgagctgggagaactccatatattgcacagataaatttgaatattgggccataactcagtagccaaacaaacactgataagtaataactttagggcatccaaagaaaacatgtcaatcgttttcaacacttgattcgcaattaggacaaatattcgggcaagagacacccttcgcgaaggtagacaaccccaaagaattctccataaaatatgtttggttttaggaggaatattcaaacgccacaattgtatcgaattactaggcagtttcaaatttatccaattactaggcagtttcaaatttctggcatccatagttacctccatgttgttgtggtatgcggatttgacctgtaacatctagtttgactcaagttccaaataagcttgtcattttttagtataaaattaagttaaacaacattaatgtaatatcactaaatttaattaaggtaattcgggtgatatttgcgtaattaaacggatttacgaaagggcagtttggtctttgtcagaggtatgggtgtatttagtaattgctgaacgcaccccctgtttcttattaaaaggtagcagatacgtttctgcttaagggtttctcctcttttcttcttccttggttcttctcttctctcaagccctcttctcaccacttccatgagattagtggctgaaatcacaaaacaagcaaggaggaaagccattttctttgttctttgttgcttttgagcattgggtgttggtgattgaagagaagagtgggtttcaaatctgcccattttcgtttggcgccgctaaactgcgattgagagtcatagagtgctggtctaccctccaatttggtctactgaaccctaaggtttgaaatctcctcctatctctccttgattcttgaggttagggttagggtttggagtgagattgttgaatgctgcgttttaagagggtgagacagttttaaagtatgatttggagtgggtagaagttgtttttaagttgaaatggtgttccatgcataaatcatgcatgcttgttcatggcagccaagaacacctatttgggcagttctggtgttttgcccatagcaggagctatcggtgtccaaatggtgtaaaattggtgccatttgaaagctaagagagttagcttcactctggaattttcgtgctatttttggagtctcctagaaattgtggtgcagagttataacaggctgttatgctctatttttagcatatttttctgctgcagagaaccattttgcagaaagcataactttttctaggatgatccaaatcgagtgttttcagtggctatagaaagatgggtatgtgaaattcatgcctgtaaaatatcagctcatttggacaagtaacctggtgtgggttgtcctcgaaagatggctggttgagttggtctgttgctgtcagcactattttagtgtgtgacagttctggtttttggtttgctgcagaggctgtggttcatggtttttgatgaaaccagttttgtttaaaagataagagatatatcttgatgcctctaaattctcgtgattttaggagcctcccacaaggatttgtgatttttccaagtgggtgtaaaacctgcagaattttatgcagcagtttatgcttttccgcatgttttgctagagatttatgcgttgtacggatagaatggtatttgatatgtgattgtatgtcttttaggacgtgagtccgataccgttggtggtggtagccacgagaccggggaagccagcgttttgcgaagagcaggtaagctcttggaccttgttgtatgtcatttgctgtgttccgccataccctcagtggagggatggttctgatgtgactaattgtatgtatgcggaacatgagtgtgaatatgaatggaaccctttgatgagggattactatatatgtatgcattgaatgtgatctgaaccctttgttgagggatgattatatatatgttgaatgtgaatgaaaccctttgatgagggaatgtggtataatgcatatgtatgcttaagtatgtggactgaatcctttgatgaggggattatatgtatttattgtacatgtttgacaggtgagctgaaccctttgatgagggggataatatgtatggcctgtaatggttggatatgcttgagatgttgattgaaccctttgaagagggcatgttatgtaggaatgtgtattgaaccctttgatgaagggataactgcatggaatgtatgatgaaccctttgtaaaggggatgatatgtgatgatgttcccatatacacagaggcagcctccccaggcaaatgtattgtgttagaggatgagatggccctgtgatacatagaggtagcctcgtgataagagatgttcctatgtacatagaggtagcctcaccaaaaaggagatgtacctgatatatagatgaagcctcgagatagagatgtacctatatattcagaggaagcctccgctagggatatatgcaagagatgtgcctagtatgtagaggtagcctccctgtgaggagatgttcctacatactatgatgtagcctctgcatatcagttatggatgtgatgattggcgtatgccatcaatataacctgattgtagtcaggtagtggtgatgacctgattgtagtcaggtagtacttgatgacctgattgtggtcaggtaatgcttgagacacttggttgtggccaggtggatgataatttgatattgtgtttgcttgatgatatgattatgatgatgatttgtttgtattgaaaagtgaaccaggggaaggaaataccttcaagggccctgagtttactgagattttatatctcaccccgtgtgtggggcttatgttttgcaggagaaacatcaagcggaacagatagatcccagggcaagaagcctatgcagggatagctggatgtgtaaccataggctaaatgacctgagttgtggctcagatgttttgtacttgcctttggttttatatttgtacccctgagagggaggttgatgtacagttttgtataagacacagagactttatgtatattcatcatgctatatgtacaatgtatatgatgacggcatttgttgatgtcacttttatgttatgtatgcttccaaactgcttaactctgatgattatctagtaatgatagtaattaaggcgtggtaatgacctcggttgtagctggggcgttacaattaatattagaataaatttatgtgtggagtgtttaaatctatgtgacattataggattcatcaaattaaaataagcaaccctatttaaacaaatacgtacgtactttggatgcacttaaaaacttatcttaaatgagagaattttggtatttctctaatgagaaaagtgactacccgttttctcttctcatcagaaagaaagtatacaaattaattctctaggttttgatgtctcggccaagtcgttgatgcacctaaatccccttattgttgagttcaattcgttgcttgttcatagtttctttctttgattagttatcttcaaatacaaagacggattcagggaagtcctcgttatattttttctcctctagttcacatgtaaacacatgacttactatgaatttgtaactctatgttctgatatttaatttgttgtaagataaacagacaataattaattatatatatatatatgtgcgcgtgcacgcgcgtgcactttttgagtgcaagagtagtcttaaatcttaattatagctttggactactatatatgaaatttctaatattgattaatgattagattaattgcatgatacataaagttaagaagtataagttaagggaactaaccatgtatctgcctagctttgagattatcaacctagcaatactagtataacttttcgtttttatagactcacaagacatgaaatttataattttatgatgtacatgtaaacaaaccggctaaatatatacgttctcatgaatgcctaattttatttcaataagtgtttaaatatctatcacttctgtaaattaatttttgtgttggagtggtttatttagcattacaatttctttaaaataagtgacactactaatgctttatgatcacgagcaaagggaagattaaatcaatggagttggacttaacaccgaagacaattaacagaagcattgtttgagggagatggtggaggtttgatgtgttgcaaacacatcttaattctagcttaattttaggttatattttaattaaatagttagaaaatagttcaaaaattaatcatctttagtatttttaattatgtcaagcattttaatatcatttaagcattggcaggccaaagagaaggacttaagagcaaataataaagaaagcaaattctggagtatcacgcgtgtcgcgccattattcgcgcgagtcgcgtggaagacccaagaagatcacgtatgaagcgtcaagtccacgcatgtcgcgtcagaactctgaggattaatgaattcttctctgccaactcacgcgggtagcgccaattctcacgtatgtcgcgttggaacttcaatgtttaaaccttttcatctctgccatctcacgcgacaaacgcggtagccacgcgggtcgcgccaagactttaaggaataaggatttatcttctgccaattcacgctacaagcgccatttcttctgtcagcccacgcgactcgcgtggtatcgcgcgcgggtcgcgtggttgtgattttctttcctgtattaaaagatatatgtttcgaaattaggaaaaagggttgattcagttactgtaattaaattactctatatatatgggaggtttctgaataaaaagatatacttggacagagagagaggagaaaatagagctttagtcattgcaagccctaggaatcaagatttcaggccaaagttctgcacaattatgaattcatcttatgatttggtgttcttgaagtctatggctggctaatcatctcattgtggaaaggccatgaacttatgagttttcctctgtaaattgactggtattaaatgcatatgttgtgtttactttaattcttttctgggcttatattttatcttgtttagaattgatcactttgaatgagtattgggagttataattcgcaatggacacgttggtattataacatctgacttgttaagaataacacttgttcttcacctagacatagggatgcatgagtgcggagtttataatatgttatttgattgcttaaactgattaatttcactaagacattaggctataaattcagtttaaagggttaattcactaagaaattaggggttaactagtataggaaagacttattctccgagtaatcataacacaaacccataggatttattctctgaattcttagtttgacagaatcgctagaaggttagggttcttgatcagattaaaaggtgagattactagttatctagtatttacaactataggagagatttatcttatgtaaacttcaagttaaaataatcagtcaattgaaggaggtaatgcttataagagattttgtctgaccacaattaattctctttggtaatctttcaagtttaaatttactgttttgtttaaatttcctttttaatcaacacaatcattcaacaacttctgcgtacttttctgttttctgttttaatcacaattgttcgaattgctgaaacatcctttcaatccctgtggagacgatcactcacttacctactttattacttgttaaacgatcggtgcacttgccgtatacacattcgcataaatcacacaacaaggttactacacttggtcaagttctgaagtgccactcctggttaagaataatgttggtgcaggtcgccttgtgcttcagcctcgtggctttgtccttcctcattatgcagattcatccaaaattggttatgtcattcaaggtcagacccgcgcgtagatatcatcatatcttttctatttttaaattttaatttcccctcccatttctatgacaagttatacatacgagtttaatttaatattcacacacttatgagttatgacataccaaccagtggttggtttgaataaaattaggcttagaatttttaattaagattttattttcgaacatatatagacgaaaaatatgtaattaacaaaaaaaatctcattaaaaacagtcaattaaattacaaaaatatcattattgttgtgaattagtttaatttttttccttttttaattagtgacatccataatataatggtattatgtattgaatcgtacgtgtaataaacttaaatggctcgtggtgctagttttcttagaactttggtgatcatcactgtctcctattaaatttctcaattttatggcacacatgcatgcagggactgatggcgtagatgggattgggatggtactccccaacactaaggctttgtttgagagttaggaggggatgggaaggaaagagattcaaggggaaggaaagggaggaaaataaggaaaattcttttctccttgtttgggagttaaaaatatatcaagagaggaaaatagagagttaataaaaaaattttacaattttttccttatttaaaaaattaatatattatatattttacactaactggggtaggataataattttattaacactgactagtataataataattttagttatttttccttctaaaaacccccaaataggggggacaacaattttaaggttttggaggatctaggaggagttttgaaaatcctcaaatcctttccctcaaaaattaaaactcccaaacaagggaatgtctctacataaacctttcatttccctctctttccctccaaaatccctctcccaaacaaagtctaaagaagaggtggttttgaagcttaagaagggagatgttataccagtgcctattggagctgtctcgtggtggttcaacgatggagactctgatctcatgcatcattgcttttcttggagaaacttcaaaggctcttgttcctgtccaattcacctatttctttctaactggggctctaggacttataggaggcttctccaatgagctcacaagcaaagtatatggtttggacaatgaggtggaaaagctcataaagccaaacttggggttttgatcatcaaacctagacaaaagtcaacccatgccttaagccacaaatgaacatcaccaaaaagctactctataatatagatgctgcacgcccagaaaatgttgtggaaaatgctggattagtcaaaaccttaacggagaaagattttccttttatcggggatgttgggttaagtgtgattagagtgaaacttcaaccggtagcaccctcatacccaaccaaccttacggttcagttgatttacattgccagaggagaggtggtaagattgaaattgtggactttagtggaaagagtgtattaaacactctagttgaggctggtcatttgcttgtcgtgccacaattctttgatgttgctgaaattgcgggtgaagaaggaattgagagttactccatcgtaataactataaagtatgacttaatttatacaaaatatattcatttaatccaagaagtagcacatgttggcatgcaatgacattaaaaatgattgattatattactttaaagtatgacacagtataattaagtgttaacaaaattaacaaaaaaaaaatgattgattatcttatttacaggccattgtttgaagaattggctggaaggggatcaatttggaacgccttttcgcctacactgcaacaagtgtctcttaacgtggattctgattttcaaaagtttttcatatccaagatcaaggaatctaccaatctcatccctcctactgcttagttcgatgcatgtgatgtacgtactaccgtatttgtttatgcataattttcagatgatgatattgatgtaagataattctgatcgaacttatctttctaaaaattatgtcgttgtattgcttttattttaaagaaaaatatttttgtgataatacttatttaagtgttctatattgagcaataaatgcatggaaggatatgaatgcgtagacccaataactaattacaatcacaatttctttgattgaaacaacaacttttaattatcaggatgaaatgttgaagcttgtggccactcatgaacttttttttctttcttttcttttcttcttctttttatttattaaattacatgtaatttttataggagataatattttattcagtatgtcatacctaggcttgcgtgtacactgttttgttgtgaggaaaaaagtaattaagagaatgaaagggaatatataggtgagaaaagaaaaataaagtaaaaaataagtttgattaaaaataaaatagagtgaaaattcatttttaaattaattgattttaaaaaaacattatcatttatttatttttattgttaatattttactattataactatacaagaggaaggaaaagcctaacttaatcgaatatggtggaaacttaaacggtgtttcttctcagtcctcttatatatattgcaatttcagatttatttgtgctattttttttaattgggttcacatattcttaaaaaaaattgccctatacactaccactcttgtaagttccaaacaaccaacgtttccttatttttactctcttccttcctccccctctctatttccatgcgacctaacacaacctaaatccccctatgcttccctcaagcttgttgctttcgacttcccattgttcaatattcaccatatctccaacagagaaatgcatgttacacgaaaacctaataaccttgctactacagaaattatttcccaattaattagacaatgatgctggttaattatattaattgatggtgacgaaacccttacctcgcaacaacggctatgtgtaggggtggcaaaaacaaaccgaacttcactgaactataattaactgaaccaaaataaacaaaaaaaaaaaaaattgaactgtttaaataaaaattgaactgaaccatcttttaaaaacttaactgctaaaaaaaggcaattcagtgcactcacaaactgatattcatcagtgttggaaaaataaatcccgctcctctccaacatacaatattctctcctataccctctcattatgttgagtacatgtgtgagttaaagtctcacatcggatagaaatcgaaaaaaagtttaacaccatataagtgaggagaaaatccataaacctgagccttaagattttgggttaagatgtggtgtccaatcccattatatggttactcgatgtaaatctccatacattcattaaaaaatgtgctttgctttcacgtttggcctctataagcaattttcaaatatgttgatcataaatattcaaaaacctataattttaaaaatgctaaaacttatctttaatattttgttcatagcaatttgaaaaatcacaatcatataaaaaatcattacttatttattcaaacacaaatcaatgtaaaaatgagaaggcaaactaaaacaatgtggtattttttaaattaaaagcaaaaaaaaagtattttctacaaaaaaaaaggccccttaaaaatagtttggtgcagttcttaatagcttaatttgaatcggttcaatccaatttaatacacctgcctttaaaatagtttgattcaatttcggttgactgttcaatttgattcaaataaattaagagaccaactataacatactttcgttgtgtaaaaaaccgaaaaataaaaaataaaaaacttaccagtatgacaaagagatgagaggagatttggtaaataagactatatatccaaatgtgattcctcttttcttaatgaatttacaaataaaaaatggtatgcccattatattatttaatacctatagagatggataaaaaaaaacagaaaagtatgagtcttattttttaacatctataaatttcaaacattgatatttttattttctctatatttctttctatcaaattattatcacttattatatatatacttttctctctcctcgctctttctctctcaagtgtgtactagcattagcaaaatgtcaaaaaaatctttttattttttattttttaaacataggtacgatagaaaaagaaaaagagataaaaaagaatgagagacctcgaagaggcgtttctgtattattactcacatagtcacatttcatttttgtccacgtgaaagcaaagcacactatagagaaaaacaaaaccacaacatagaaaacgatccctcgtcgacataactcacaacagtccaataacagttttaatttttgaaattttgtaccgtcaaaatatgataccattgttttgttattctttatttaaacaaattttcaaaataaaataatgtatttttatatttttttttataaaatgtatttttgaaacaagtatatcctaaagactcaaattaaggcttccaacctatttacacaataattttatttgaagttctcgtattttttttaataaatgtttttcagcatttttaataaatgataaacacaaaattataataatttttataccttatatagttatatatatacatcttatatatttattctattgacttaaagtatttttattatttaataaagagtattaaatataaaaatgctattctataaatataaaatatttgttctaaatcttgtttttttatataaatatttgaaaagaagtttatccactcaaaaatctaatacaagaattcttcttatatcaataacttttcaaaatattatttcaaatcataaacaaaaacacaaatttactttaaaaaaaatatcacatattataattataactccacttgacaaatttaaattcttacataattaaaagaacatccaaaacaatgtgccgagttaaaacataattattttttttgtaatattcattttatatggaaattgttacataaataatctataataatattttaatcaatatatgtttattcaatagatacattattaataatgagatagtaagaaaatatattcttatctcatcaaaataaaacttacataacatacaatttaaataaatttaaaaatattatgtggatttaatttacaaatatcacaattccgatgatgactgattccatccattctagcttcgacgcgtagcagtcgctctcaatcattttacaattgttttgatgagtaagcaacacaagatcgatcaagctagccccatgagctctccacttaatttggcttttaccaatctgttgaatgattttgacttttgagtaggttgattatttgcgtacgtgttgttttaaaaggttaactctaaattgtttctgtatgcgtaaggtggcaataaaagtcagcacgaggcatgtcccacattccgttggtggtgtttcattggtatacgttttctcttattggacagaaagtatatgaagtttcaaaaataattgtaatgagccaatatctatatatagccctcaataggtcttcatgtcttggccaaatcgttgatgctactaaatcctcttaattcgctgctttttcttagtttctttctttcgactagttatcataaaaaagatagacaggttgaggaaagtcttggttatatatgtctttcgcctctaaatcacaggtacatacaatacaagacttattatgaatatggtttttcggatctttgatttgttgtaagataaaggaatatatgagtgcgtgactttcccttataactttttgaatacgtacactagatatatgaatttctaattttaagatatgcatgcttgatgctcaaagttaaaaaacatgttaaatttaagttctacaatatcaaaaagtataattagccttttagtgttttgttggtttaatttgttgccttcatgactcctctaatttgattcctcaatacgtctagcatgtgatttttggttatataatttagcacaactacttttaacaacaatgcattcatttatctgaaatatttttcatgaacaaaaggaaaatcaaatcaatggagttggatttaatgccaaagacagcacaaccagtgtttgagggagatggtggaggttactacacttggtcgagttctcaaatgcccattctggctaagatgaatgtgggtgctggtcgccttgtgcttcagcctcgtgcctttgcccttcctcattatgcagattcatcaaaaataggttatgtcattcaaggtcagagcccgtctatatctttactatattttttcccctatatatggcctatactatacgtaactaagttataagaaattgatcaaactaagaagttatattaaaaatatatcactacaaatagggtaattaaacaatggatcaaagtcacacagtgaccaattaactgcatcatatacttttttaagactacattaatgccaaatagtattctctgtcgctctctttgtgaattagtgagacgcaatggtaattgattgcgtattcaatcgtgtaataaacttcaatgattcacggtgttaattaattttcatagaactttgatgaaaaatgactcaattgcaaattaatttctttaattttatggcacacgtgcagggagcgatggcatagttgggatggtacttcccaacactaaagaagaggtggttttgaagcttaagcaaggagatgttataccagtgcctattggagctgtctcgtggtggttcaacgatggagactctgatcttataattgctttttcttggggaaacttcaaaggctcttgttcctggccaattcacctatttctttctaactggggctataggacttataggaggtttctctaatgacctcacaagtaaattatataacttggacaaagatgaggttgaaaagctcacaaaaagtcaaactggggttatgatcatcaagctagacaaaagtcaaccaatgcctaagccacaaatgaacatgaccaagaagctagtctataatatagacgctgcacgtgcacaaaatgttgtggaaaatgctggattagtcaaaaccttaacggagaaagattttccttttattggggatgttggtttaagtgtgattagagtgaaacttgaacctggtgctattaagacaccatcataccctaccaacactgcagttcagttaatttacattgctagaggaagtggcaagattgaaattgtgggcttgaatggaaaacgtgtattagacactcaagttattaaggctggtgatttacttgttgtgccacaattttttgtggttacccaaattgcaggagatgaaggaatggaaagttactccattgtcacaactactaagtaagctgttgggattttatataaaataatttttatagcatgcaataacattaaaaatggttgattatatattatttgagagtatgtcccagtatgattaattagtactactaacaaaaatgtttgattatattatttgtaggcctttgtttgaagagttggctggaaaggcatcaatttggggtgtgttgtcatctactgttcaacaagtggctcttaacgtggattcagaatttcaagagttgttcgtatccaagatcaagaaatcctctaatctcatcccacccacgtcctacaagttagtctgacacatgagatgatgcatgcgtgtgaatgtatttgttttgtaaaattcagatgatgttatacatatgagaaaatactaaatttatctttctacgtgaaaatccttagtttgatgttgattcaagagacagggatggagaagaagtcgatgtgtatgtcattgtattgcttttgttttcaatttaaaggatatactttggtagcagtaaaattctttatatatgttctgttatgaacgaagagtattcatgaagtgattataattaaaatgtttacatgtatggtcttacattgcatagtggattatattgtagaattgattttgagttaaatatttttagataatttttatgttaaagataaaaatttatattgaatttttcaataataaattaaaagtattcatgcacttcatcttttgaagaatttattgagaaagtttatataaaagtaaaaggcataaattttatttcaaatcacttcatttcaaaatcagtctagacttctcacacaaattaaaatgaattcatccacttcatcttttgaagaatttattgagaaagtttatataaaagtaaaaggcataaattttattttaatttatagagaaatttaatttatttttttcttttcttatacgtttcatnnnnnnnnnngagcaacacaaactttcctgttaataataaacagaaaattaagaaatgataaaactcaaatgttgctcaaccacaacttgaagggtttattttttctaaatcatgtgtatcttctattgaagctaatcttatttgaattggataagaatcattatgaactataaaatttttcctttaaatatttaacacatttaagtattcatgattcgaatttaaattttttgattaaattgaaataatttaaggttaattgacccactacatattgctaattaatacttgaagttgaattgatagaatcaatatatcaacaaaggttatttttttagataagaaataaactcatatttctaatggacatgagnnnnnnnnnntaacttctctatatataagcttaattaactattttaggaaccttagctttttagaaaaatcaaatgaaaataatttttataaaaagtaaatagtacataattaatttaaacttatataaattacaattcattctattttatatttttttctcttataattatttatggaaaaatttattcatataaaacttaatttcttataaataatttcatctaaacaatatacataacttatatgtttcaatgtaacaaaatttaaggttcaaaactcatatttgataaggacatgcggaaagtgcttcttagaatagacataacatatatgtttctcatttccttttattataataaaaaatttaaatatttataattaacttgattaaaacatattactactaaaaaaatttgtattctactacggtgaaataatgacagttttccaagaaccatctgaaattcgattacaacttcaatgatgacaaatttacaaaaattatcttaaaaagttgcgttccacaaacattttttgtaaaatcgtcctggtttcatttctcttctagcaaaaatcgaaaatgctcgccactcactcattcagtcactcaaactcacaccagtgtatagagattaaagagagaaccctaaaattccgccacccgcgatggacatgcatcgatgacgacgaagacctcgacctcggcgacgttgatctcaacccgaccaacggactcatgctcaaccgcataagcaagttttgatttcatttcaacttcatccttcatcttcttcccctgtcaatctagccactctctttgaatttgacggttgtgccgcgtaatctcatcagtttctcacttgctcgctcagtgactcgctcactcttctttagatctgatcgaagaaataaatagaggaagcgctggaactatcacgcatgaaggacacgaaggagaggatggcaggtgtggagtgcctccaccaatttctagaagcttctagaaagagcccatcctcttctgaggtcacctcgctcatcgatatatgtatggatctcctcaaggacaacaacttttgcgtcttccagggtgcgctccaggccctctcctctgccatcgttctcgccggcgaacacttcaagctccacttcaacgccctcctccttgccgtgggagtagcaaagggtgttgaagtgtcgacaatgcacacagtttgtctctcaaacttagaattttgaaatataattaccttaagagtgtgtttggatggagaattttaattggggaaagtaatttattaggggatttaaaattcttcaacttaaaattccctgtttggatattttgatatgaggaatttaaatttttagaattttaaaagagaattttaaacaactaaaaatgtgaaatttgaatttctttataaaaggtgagaaattgaaattctcttattttttagaagctctaaatgcacaattttttgctccgtctcaatcatcgacgtactccgacctccgctgctttcaagacactatccaccttacgtatttttctgtgaatgaggtttaaaattttaaaataaagaaatttaatttctttatccaaacacaaaattttgaaaataaaaaaattttaattgatgcatcttaatttccctgaattttaaatttcctaaaattttaaaatacttcatccaaacatactcttaatgattttgtgaatatatctgagatatggtcttcaaagtttgacagtattccaactcctaattatccatgattacttgatgtctcaagaaatgacatcgggtctctaatatatttactcctccgattgaatagttggatgctttgccaaattaattgcttatttgttgtctatccgtagcttcataggtcttattgtttccaaattcatctctcccaacaaagtttcaagcttggcattaagacaatgccaccatatactactttttgaaacactaagaaatgtattatgcatccattgcatttgcagcacatgaaaacacaacaagttgtattcttttgatcattcttatctccacaccaaccaaagtccatacatccaatctttacacttctacactgcatctcatttgaaaatagcaacccgaaatcaatcgcccctttaatgtacctcagtatccgtttgtttgttgcatagtgagatgttcttggcttctccttaaatctacttatgaagccaactccatgccagagaatgatcacactgcattcatcacatcaacttcttttttatacatttttcatcacgagtcccacatcaaccaactaatggagttggttattgataactggtaaccactattaaaagtaagatcttgttaacctgtgacataaaaaagccttaaagacgttgtgactttgtgaacacaaagtcaaggaaacagaggcttgcattaattgcaactattccaattcaataaaatgcatgttgcttctcatacaaagacaatcctccaccatcaatagaagcaaaccagagttaacactgactaaataaaattaaacacacatacatgcacgatccaccttaagaattctaacttcaatgttacattggcattttattacacaccactgcaaatttctttttcactggagacaattttgttccagtaagataggattataccttcgagtatttaacacatctgcataaccaagacttaaaatcgagacctttgattaagttggaccaaccccacgccaattgatccacgtgctcggtggtacaccactgcgaatttcattcattcattggttgattcatcccattgatcctctcaattacagagataatcccttgcccgccaagcttcccctgcctattagccaccatactagaaaacaactgtttacacaacgaagcccctggcaagacaacaacatcagcatcatctcctccttccacaacatcaacccccatccccaaatccttaacctgatactccgcaaaaccccctggtcgaaaatccctctcaatcatcctctccccgaacaattcaagtgccttcgaacccgcagcaccgtcttttatggcttccacgaactccttcaggtccagccccgcacgcttcgcgaacaccagcccctcgctcagcccgatcaagttcgcgccaatcgtgatctggttcgcgatcttgcagctctgcccgcaccctgcggggcccatgtaagtggctctcccgaggatcgagaacagagggttcagccattcgactacggctttttctccggcggcgaggatggcgagcttaccgtcgcgcgcgccgatgtcgccgccggagacgggggcgtcgacggaccaggcccctagggagcgtgctgcggagaagatctggcgggcgaggtcggggtgggagctggtggtgtcgacggcgacggagttggggcggagggaggggaggacgggggagtcgaggaggagggagcgtacgtcggaggggtggcccaccatggtgaagaggacgtcggagaattgggccagttgggccggggattgggccagggtggcgccttgggattggagagagagggcgttggggtgggcagggttgcgggcgtagaaagagagggtgtagccagcagaaaggaggcgagaggccatggcgaagcccattacgccgataccgatccacccgattcgggtttcggagggtgagatcggagttgggtacggcgttcccatggtaatgttgatgcccgagacagagagtggactcagtggagtcacgagtgaacactgtgactcactcactcagtgaattattagtttcctttttttattccatgcctgtttctatttttatgtttttttctaggtgaaagaatccgctttttgagctagaggataataattactaactttatcctccaattttttttcttctaaatcctcccttcaataaagagaaaaaagatattaattaatttagagttgatcaattaaaaagtaaaatatgattaagattgaatttgatattttatatgaatgattcaaacttatttttaatatattaatcatttatgtttaattagttaatttattagtctctttcacatgcagttgtagtaatttttaaaataattaaatgttttattatttttgtctcttagttaatatattttagtaaaattttgggattgattttaaaaaatttaatatcggaaggattacttaacataatttttaatacttttaaaattgttttttttaattttaagaataattaatgagaagagagagagaaaaaaaacctgttaagcataatagaccagccttgttaatagtttcttcttcttcttattattattattattatttacttcctacacaaataatgctcatgttgaaatcagaagcgcactagttccgcatacttacatatataggtccactaacttatttgggctaataggtctgttgtattgtttgtaaggggttaacttcctacacccaacaaagttctaatacacccaacatttttgtgaaaaaggcaatattacccttgcttaaaataataaaaaccaaagcttttcaaatttctaatacacccgtcatttgcttttcgtttctgcttccaatctcctcgtgctctcctgctttgtggcgactttggtgctctgcggttgtcgttctggtatcttgggctgtggacggaggttttgtggtggtcggtggtcggcgacgaaggtgacattgttttccagcgatacgaggtaagtggcgctttgcattgtcgtttcgtctttggtttaggatgcttatggattggtaatctgtatcctgtgcattggacggattatggatccgtatgaaggattggaatccgtatcaagcttctggattgacaatccgtaaggatcatatggattgcaaatccgtaaggctcatacggattgccacctacgacgagttttcctcgcaacttaaaaggacaaccgcattttctactgctagtggtcatgcgaactaaatctttgttgaatgctctatagttttcactcctttcacaacctatcaaaataaatgaggtccttcccctcttgccagttgctgtgtcatacctcattatcacagctacaaaatcaatctcagatgcaagactacgagcccattgcaatacctcgtcacgagaattaaacacctacaacttttcagaatacatgctcaatctcatgaaattaattatttactgacattcaatatgctactttatcacataaatacatttgaagtcttaaatgcattagaacaatcaatcatagagttgttattctaaaatgcaaacggttcacctctgttgtcttcacccatattattttcttccgccataatatcatcatgcatccaatcatcgttgtccatcttaataaacaaacaaattcaaaacaaataatcactaacaaaaagtatctttatattcatttcacaactttgtcattaattcaaaacaaaattccgtcataattcaaaatttaactgttattttaattgaaaaaggaaaaatacattaattattaatacctttaacaaaaacaacacaaatatttaaaaaaaaaaacaaaaatcaaaacaaacagaaaaaaaatccatacggattggcaatccgtataacccatacggattgctaatctgtataactcgtacagattgccaatccgaatgtgcgtccccagaaacagtacaacttacctctgacgactccgacgacgacgatcccggccaacgaaacctccacgactgctaacaacgacctcaacccaacaacccacaacaatcgaagctagaaccaagaagccagaaccaacaaacacatcagacggaagaagaagaagagaaggaagaagattcggcagctggtgtatgtgaaaataatgaatgacaagggaaagtaaagcaaaatgtacaagggtaatattgcctttttcacaaaagtgttgggtgtattagaacttggctgggtgtaggaagttaacccctttttgtaaaccttatataaaattggtctttgttgaaagggaaaaaaaaataaaaaaataaacataaggcttctatattatgacttgggtaaaaatatgtttttgaactttcggtcaaattgattttagcatgtgtagttttaaatccatcaattttgtttctaacttaaaaaaaataagtgaatttaatctttatttgattcttcggtggtcagcacgtgagaactaaatcctattttttaaaatataagaaacatattggtcgattacaactaaaaaactaaaattaagtttaatcaaaagtagaaagagaaaatttattttatgcttaagctatttaaatagattatgataaacataaaataagaggcctataacaggtgcataagtttaaagaatgagagttaagtccatcttggaccttgcaaaacctaacctaccattgttttccttacacccttattaaaatctttcttttatttttatttttaattgtgaaaagaaatattgataataagtaaaatatttagaataagaaaccttatttgtttgagaacaaaccgacctaaaaggaaggcctcctagggaaacttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtgttaaatcaagttatagggggggtcaatatgcaatctcacttgataattaaaagaatgttaaaaagagagtgatgcaatctcacctgataattaaaagaatgttaaaagcgagtgtgaaattgcatatcattgacgactttcttcataattagtaacaaaaatcatgtttaatcctattcccatcccccttgaatgataaactagaatctatgttatatatatagacgataaggtttatggaaaattcacattatatatctattaacaatttttatatatagtttatgattttttttatgggagaatatattccnnnnnnnnnnnntcaacaaaggttatttttttagataagaaataaactcatatttctaatggacatgagttgaaacatattctttctggtgaattattgggacttaaatcaactaaattttgataaggaaaaaaattgatagaatcagatgaaaggtaatgaattgaaaaacaaaagtatgagcataaatatggaacaagaagaatcagatacaaaaagcatagatgcattttttttaagccgaacaagaaccatcaccgactattgacttccataattttatgagataaatggaactcgtaattttatggcatggaatgcaatttataagcaatattattctatttaccacataataactttagagtttattggtaaaaaatgaaattcaagaatttaacggtcatacacatttaatataaaataattttatattattattcaattcaatcataaattatcataaaaaatcatcattctcatcatacattattaagtttattgtgattaaataatgatgtaaaatattttactctaataatgcataacttattttttcataaatttactctaaattcatctataattcacgagatataaaacaaataataacttatacaatagtttatattttatgtttatctctcttctagtctatcatttattatatttcgaactcaaatttctctctttttctccatcttaattgtacgttttgttattctacaatttgttatccaagtatgagttttcataatccactagttatagatatatttcacgaatcttttaccgaatattgactttaatcaatacttatcattttaagctggtcctatgctctatcctgagatggtgcattactcacattatgtttcttgcccaatccataacacgtatataacaataaacgccgttgtttacgaaaatattttattacacgaaacaattgaatctaaatctatcttcatgtgccctagcgatatataaggtctatatatgacaaaccatatctacttcatttaggaagaatacaacaacaggatgatgctaaatctgatttgggtttatttgggtgtaagttttttttagtaaagaaaaaaaatgaaataaattaaaatgaatttttcattagctgatttgtaaatgttatcgatgaatttttaaaaattaactaatgaaaaacttattttttcttataaaaaaattatttttattgtttttagaagtgcttttagagaaacttatccaaataagtctttaacagtaatatactaatagttttctaattttctcaaaagatattaaaaaaaattggttttttcaaaattgaactaaaactataaacacgtatcaaatactattattttaaaaaaacacgtatcaaatatcaataatctcaaaatgtcagttgagctgagaatctttggcccgagggacaatttcttttcgaaaaagaagtataaattatacattggaggttgaccttgaatctgttagcaccaaatatctctacttttaaataaagttatacactagttagaattaatttggctcctttgcgcatatatatgtgcggggaggaaaaggaaaagaattaggatggtttgtttatttatttattggtaaaataaagaaaattatttttttagtaagagtaatttttaaaaattattttatgcgtatatttttcagtttatgaattaaaataccaaaacatctttaaattttttgttttctaatttcnnnnnnnnnnnnnnnnnnnnnnnnnnnnnnnnnnnnnnnnnnnnnnnnnnnnnnnnnnnnnnnnnnnnnnnnnnnnnnnaaaagtttgattttaattaaaagagaaaaatactcgtgttgctttgcattcaataaagaaagaatattacttttttttactgtattattactttattattatctatttataaattaagtatctattggaaatattaattatacttttaaattacttaattatcaattttttaaggaatagttataaattttatatgactttgttaataaaaatacatttttacttatttgtcacatttatagaaaatatcattacgtgaatttaatatgaatattaaaaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattaacaatttttatatatagtttatgattttttttatgggagaatatattccctaactagagaggacatacttcagacttcagagtaacttattttagtcttttattatcaatagaaacggcatgttaattacatatctgccttttaaaatttgaatttagttttttttattacatttgaatattatagttttaaccttaattttttcaaatatttgtaaattagttatgcatatacgtcatttatctttttaatattaatattcttttaaattctttttcaattttctctaatttataaatatccttacaaagcataaaatacctgctgattaaaacaagacacaaatatcttatttttcattaagaccatagtttattattattttttccattgaatgcaaaaatttaattgttttaaagtaaactatatgaaatcaatataaattaatgacctgcagccccgcacactctttggtttgaaattattaattagtgaattaataaaaaatactacctttgtcccaaaataaatgtctaggaaaaaaactttatttcaaaataaatattggatttgacttttcaatctaatattaattattcttttttattaatatatttaataaatgttattttgatatttaaatataatattaataaatgttatatttaataattttatttttgtccatgtaaaataacctactacaatacttattttgggatggagagaataatttttatcactttataatttttaattaacgaatatttcaaacttttttatctatgcatctgctattaaagttatatatataaattgtggaggaataagatgacacatacacacacgttatgatattgttaatcagtgatgaattaattaagatatttttgttaactttgcatccgatcaaagttgtctattgaggaagaataggatgctatctatgtgggcggtgattttattatgcgttgataaagaaagacgtttatatatgcttgctatagctaactttctgaatcagcaagcaataaattaattatatcataaagttgtcacaaggcgattcagacatgattagcctctttttgtttttcttaaatcttggttccaacgtgacttgaagtttggggcactaactaaaatattctatataaaaatgcaatgttaattatttgttccagatgtttggcaggctttggtaacagctccacttacctctcgctctgggcaagaatctctctccatgcacttattcttcatgatcatgtgcaattttctattgttgtctcttatatactaaagtttcctgtgataattagttcaaatttgcattcatgttgactcacatgtcgatatttaagtttgacagaataagacattttcatatttcgttatgttgatgtaagttctttctttttacactatgttatcaagtggtggattgacattgatatatcattaagaaaatgtgaatttctgtaaattaaaggaaaattctctcaataagttgagaaaggtaatctaaaattcattacattgattccgtgataattgagaaaggaagaccggcattggatgccaaatgccaataatacagtgtgagcacnnnnnnnnnnnnnnnnnnnnnnnnnnnnnnnnnnnnnnnnnnnnnnnnnnnnngggaccaaaattccagaaagttcgtactctgtcataatacgttttgaaaaccagttaatcgtaaaaaagaaattttcaagcggaaggaagtttatcattcaaattttcaaacaattaaaccaatagtttgactactacgtaacatatagaacattataaataaataaaatttcatcattgttatacatattttcttgtttaatttgatttgaaaaattgttaaattttaagtgatattttattttgttataacgctccaaaaatatatatagtaataannnnnnnnnnnnnnnnnnnnnnnnnnnnnnnnnnnnnnnnnnnnnnnnnnnnnnnnnnnnnnnnnnnnnnnnaaaatttataataatgcctaattaattatcaacttacaaatgtatgtttttccttaaattttagataatcttaagcaatataaccatgaatcagcattagccaaaaaaaagaagaagtcgatatttaaatttctgtttgactcaattcaagttattcaacataaaatttattttcacacggaactacttgagttttaaaagttatctttaaacaataattaaaccattttttaaagcttgatgaattgatttataaatgattgacttcatatggcagttttaagattactattactcactaacggataacttatccaaggaacacatatatctagtattttctttcttaaacaactctaaactttagattaacaatatattttttgtgtattgaaaggaaactcctctgcaagagggtgtgttattcaacgcccaatactggagtgggccttttccttttcgtgatagatactgttagtactactttgcatcatgcacggacagctgtgtgatgtattgacaattttatttcttctcgtgttgtaattagatgacctacacataatattatataattaaaatttggcttttctaaaatcaatcatttttttaagtaatatcagtaattaatattgctatatatgtatatataataatcatggatatattaaaatatcaatattaatagacatcttgtatgtatcaacgacaattttttttctcagtgcatgtaaattattaaagttatcattttttttcaataaccgaaattacttagattatatgtttgtttcgagatataaaaactatttttgaaagtaaaatcaagaatatcacattttaatgtttagtgtatatatatataaataaacattataaaatattgttgattctagcaatataaattattaatatttttattttttaatcctcttaataaaagatgcttacatttccataataatgaaagttttttttttaattataataactacttatctcaattttgtgtgtgtttagatgatatcaataaaattaattttaaagtaatataatttatgtttggatgttttattataaaatcaagttatgagtaaaatttattataaaatttagatttaatatataaactatttaaaattatttcaactcataattaattttgaatttttctttaacataaaattaaatatataaaaatatatctaaaataaatccttaacccaaaatcaattcctccacatgaaccaaacatgcatgaaaaaaattaattctctaacgttcattttttcacaaatctttttctattttcaattttcttattaaataaaaaattaattgtttctgaaattaataaatttcaatccaacatactcgtatgaataatatttctagatacaatttcctaaaaacataattcctcaaaatccaatattactatacgttgaaacaaagccacagaattcatggttgatcacttgtcacattctttgtatttgtttttcttttttttccttttatacataagattccgacacagtaaggagctgccacgtacgtgtccagattccaaacttgaaacgatgcccacgcaatagcttttcaggtgagttaaaagtggcatctttcttctttgcatggcaagccaaggacaaccacaccccactacttagtacttatgttttcgttagttattattattaataaagcagaaaaagaaaagtcatatataagagctaagttaattcgtttgatttttcaagtttactgttatcacaaacacacacgcataagtctatagagagagagagagagaggtgacgtgtcattattggagcatagtatatatagtagctggaggtataatctgttgcaactattctatagaataataaattatttttggtggtggggcagttgtcggctaaggcagttggacaaggattcgtgagctttgtctcagactgttttagaatgaaaagcgcttagcttaagttttttttgctggtttttgattattgggtggggggttacatcttcctcttcttgctttcagcttcttttgcttcacatcacaggatattgttcgttggcacttcaatatatctagtctaaggttagtttagtgattcttatcttgatttttttgttgtgttggaatctaggaatttgttgtgtgttgtggattagtcacataaacggcagattctgctgttgtattggatgcccttttattgaattgacccagatagtatttctggaagaatatcggtgtagttacttgtttttatgcagatagtggaatgcaaatggggtattcattcgttcttcatagtagggaatttattcatagtacgcaaatggagtatgtgcttttttctttttttgctgagttacgatatgatgtcaattataggctcatttgacaaggaatacggaaaaattcttgggttgtcacagctctagaaagaatgagcacatcttttcaggtgtaaattttataggatttacaatgattcagcatatgcagtgtttacaattatattattatatgttgttgatatacaggtagtgtggttttagttgtagcaaattgtgagagtaaacaaacaaattatgtgttgttagcctccctctttatttcattaagaaattattcctccctaaacattatgccaaattctgcagttagtatattaatttatactttttgttcccattgaaacaagtactacatcaaaagcaggagagtttttttttttcccttgttatttgtattttgtgggaaaattctgaaaagcatttttcaatgcagaaatctgctaaagaatttactgtgacttttcttctattgcattttgagattcattatgatggttgtacctgtttcagagttcactgaggagcacaatagtgtcataaaggtggtgaaggcagagatgaatttccttattatatcaatgagtggcacatttaaccttttaaaggaaatggaacctttcttcgagttatcagcataaatcagtgaatactgaaaacctgcaagtcatggaggacagtgaaaggtaatattcatagaaactccttctctgttccattcatcctcttgtgttctgtgttttatgtagtttttgcatctgttgtgcttgaatgtactatgatatcactgtctcttgtaaagtgtaggtttgaagaaaagtccttttcaaatggggatgtttacattggtaaaatcaagggcaggcttccccatggcaaaggaaagtacacatggtcagatggaacagtatatgaaggtgattgggtaaatgggaaaatgacggggaaaggactgattacatggccaacaggagcaaagtatgagggtgaattctctgggggttaccttcatggtcatggcacctttacacattctactgggtgcatttatactggtagttggaggatggatgctcatcatgggattggacgaaaagagtattccaattcagatatatatgaaggtttatggaaagaaggaattcgtgaaggctgcggaaggtattcttgggagaatggaaatacttatattggaaattggaaaagtgggaaaatagatggcagaggggttatgaagtgggctaatggtgatatttttgacggctgttggttaaatggacttaaacaaggatctggagtttatagatttgctgatggggggctttatattgggacatggagtaagggcctaaaggatggaaaaggaaaattctatcctgctggtggtaaacaaccatctctaaagaagttgtgctctcttaacagtgatgatggtttgttattgaatacagagaaacatacagctccaaaacaaaaatttacgcgtagtttttctgaaaagatttctgtcagtggtagatcaaaaagttcacgtcaaatatctcacaggacttcatcattagatgcaaattgtatcattcaagatcctgctggagattgcatatgtcgtgactcttcacccacattatcacagacttttaatgaaagtcaatctgaggcatctggtgtaaactctttggtttacgaaagggaatatatgcaaggagttctaattatggagagaattagaaactattcagaaataccacataaaaacaaacgtcaaaataagtttagtgtcaagcaagctaagaagagttcatggattgatatttttggaggcagccgaagctattatttgaagcttaatttgcagcttggcatcaggtaaattatatgatctaacatgaaccttgtagcttattttggaataattgatattgtatctatttgtcaccagtaatatcataattctttctactgcattatacttattgttatttttaaatcaagaccatgtatagaaagtgatccaaccaataaattagatgacgtctaagtaatggctgagaactactcaacaagtttccgtgaagctagcatacattagagtgtattgatgcatacttgctgattgattcacatattaaagataaggaatgattttattataaatgatctgtttcatgttgttcgcagcaatactgacagatatatttgggtatgggtagagaatgtaaagacatttaagtaaaagaaaatataaatgactatcccaagggttttagagtcatcattgaaaagcttattcttaaggcagatgcgaggttatttagtttgcagaaatgaatgcttaaaccgcctttaacaatagtatattttacactcatattaacgtcagtgctgtaatatgattattggatgctagtcattcaggatgatctgagaggggaaaaacagagagatgaggaggaaagaattatatattctgttgaaatcatgtagagcttttgtccgatgttgatcggtaactatcaaaaggcattcctcttcacctcattcttaagatccataaacccaattatatttcttgtatttttaccgcagtttttgtttaaatagttaatagaaaacaatgacaaacaaattacattctcatcgtgcatcagtatgatgaaggtttttttttttttggttggggggttgtaaatcaaagttaatgtgtcttattccatttggtattttgtatttttgtttcatatgaaggtttgatttaaagaaatttggccaaattctcaggtacactgttggaaaaattacaccagtgcctgcacgtgaagttcggtcatctgattttggagatcgagctaggataaggatgtacttccccaaggagggttcccagttgactcctccacattcttctatagacttctactggaaggattattgccctatggtattccggtatttatttactacatacacacctgaagagttatatgtttagtaatgtttattgaaacgctttccatctggctacagtaggatcaacttatttcaaagttgtaaggcatgaaagcattatcacctcttaattttattgttagcttatgaaaccattggtgcatcataatgtatttcctatgaagaacttccaaactggagtatcaatgttgaagtttggtccaacccttttccttaggcataaaagaaggaaggaaatatgtccaattttaaatgtgaacatagtcattatcaaaataatatacatgaattctcgataatacgaatttgtgattatagtggcataatagaagtgcttaagggttatggttaaaagcacatgatctttcaagatgtattcattggcagactcaacataaacaaccccatattttcagattaacattttgcccatttaatgaattgaaggtttcatgtgcttgattaatgtatgcctcccaatttattaattacatgtagctttctagcatcttttttttttctttctatctttctttgcgtaattacataagcatatatttccaggaatttgagagagatgttcaaattagatgctgcagagtacatgatgtccatttgtggtgattctggtctaagggacatatcttcacctggaaaaagtggcagcatcttctttctttctcaagatgatagattcgtgataaagacactgaaaaaatatgaactaaaggtttgcaatgacattttttttttctttcttcatggatcagaaaacatttttatattaatcatattgtgttgaattcatcaactggtatgtgaattcgacttttgtgtagttggatacataagcatattagatggctggcacatagacagcactttagagtgatatacagtttcatatatacctactatccacttaccaaaccccatagatacaagtaatactttatagtgccactaatctggtgacaaagtttaattaaatccaatgccaaaatggctaattgagaccatttgggtgggtattttctggagagaagtattttttaatgttatatggagaaaagatgattgcttataagtgtatctttgacaatccatcaacaccagtaggacttgctagtgccagtaatttgattactattttcaaggacaatattcatgaaatccaatctagtgaaggccacattatgatagacgtttctggataaacacgtttttatgctgaaaagacaattctagaccagaatacgtgatggcttatctttctggctcttgtagttccatagacaccaataatactaccagtgcctataatctgatgacaacttttaaaggcaaagttcatgaaatccaatgccaaaatggctaatcaagaatgcgctttagatgggcctttttggtgaaaaaatgttcttatgttagttaagaagtcacttttacagagaaatcagtggttgcttatgtttccatctctcacagtaaataatcaatttgatttacccaattaaatgacaattccatagttcgtggttatgtacatatattttttctcttcttgtaggttatgctcaatatgcttcctaaatactaccatcatgtaggaagttatgagaatactcttattacaaaattctttggtctccatcgaataacactaagaggtgggaaaaaggtataacaaatatctgtctctagcttcttttcaattagtactacagatatgaataaccttgttttccaccccacctagtgagaaaagggttggatgttattgtttttgtataaatatttctttctttcttcattgggtgttgttttcattaggttcgctttgtggtcatggggaatatgttctgcacagaacttcatattcaccgtcgttatgatctgaaggggtctactcaaggaagatatacaaacgaagataaaatcaatagcaatacaacattgaaagatcttgatctaaaatatgaatttcatatggataaaaaattacgagaatccctattcaagtgagttcctactttttaagagctacttctgttaaaagtgattggtatgcaatttatttttctgtacaagtggggagtatttgttgacaaagttccagaatataacaatcctgttcttctagatcatataatgcctatttcagaggaaattcttaactgttattgctctaagaaatgcttatggcaccaaacagcaataattttactttattagtttattaatgatactagtcacaatattgatcatggttgtgatagagtgtttcgttgatcccctgaaaccataaggttatgggactaatttgcttgaaattctggttggttgctatctctacttgccataattgaaatagatgacctttcaaagtaatgcaaagatatattggattatccgtagtctgaatcaagcttcttgtttgatccagctattacagcttttactgattcaatatctggttaatttccaagttaagaacttcagaagtcatgaaagttgtgccttttttcatattttctaattgaaaagatataatcctgaactttacattagaatcggcaaaccaaaatgtgaccattgtagagatgttgcattagatataattagtgtagggtgattagatttgttatgaaactgttagcaaaggttccacttctttcagtgaattttctttttcttttcaatagagaagttataattcatgcattaaataatgactaaatggaattcacctaactatcaattactgggacacctctgggttatgattgatttacttccataccagcacacttagcctggaacgttacagaactgatttgtgactgtttgctcgagtgtatataaagtatttatcatgacaattttattggactactcatcgactgaaggattaataagcttagcttctatgaatcaaaaatacgcttagcttctagttatgactcaaacttcttttttctggtgcagacaaatttctctagactgcatgttcttggagtctcagcacataattgattacagtcttctgttgggattacattttagagctccggagaatctaaaggccttagtggaacctcccagactaccgcagcctcaacatggcttaccctctgaagatagtaaataccttctctggtgttattttagaacatgatatgggattcttctttcaaaaattagtgattatagatgacacctagcaatagcattcattagaatggtttataaaatgggaggtagaatgatttattaagtaactaatccttccatgcatccatccaataactgaaaaaaaaacagaccagctgaactatctagcaccttcctattagccagaagttcatacagtgcacttttgttcctatgatatatctccatcttttgtttattttattttgtaaattcaggtatattcaagtttttatttcaactgttcaagttcactacaaactgattctgttctctctattttcttgcatttgtgcctcagtttccttcttttgattgagcactttttgacttgctttgctttactagatgcacaaaaacaaggggagcagttgattattcctaaaggcttgttattagttgctcatgaacctaggtttgtcaacactgcaccgggaccacacattagaggaaatacattgagagcatactccataggtgacaagcaagttgatcttttacttcctggtactgcaaggtatcgtctataacattattctgattgtttccttttcaatattcattaatctagcacctttgcaagtatctcctttggtcctagacagttgcatgtagcaattattgtgcattctgtttctttcactgtacttaatgtcactttctttaaataaaagtcctaagcagaaatcgtttgctttattgtgttccattgtaataacacatgtcataatatgaaatggagtgttactcaggctgagagtgcaattaggagtaaacatgccagctcaagcaacacggaaacttcaggaggataaggtggaggaatcagaggtagagctttttgaggtttatgatgtggtcctatacatgggcataattgatatattgcaagaatacacagtgaaaaagaaacttgagcatgcctgcaaatcactgcaatatgaccctatgactatttcagtggtggaaccaaagacatatgctcaacgtttcatcaatttcatggagaaaaaagttttcccagagccagagacttcttgaatatgtatattttatctttcctttttggtttaatacttctttgtaatcaattgttcttaaggaagagtattttgttttaccaacaccgtttagatatatttttttcataattctttcagattttttctttttctttacagaagaggcctgctattcggtcaagagattaatcatcaaacagttgaaaatgattaattgatgcaaatatgtgtattcacttccaatttccaaagaattaaattacatttaaattattttctttttttaatctttttttccacctgaaaggtcctgccctttgaaactcagaagtgctgctattaatatattctgcaacctgccatcttcgtgaaataaagtgtaacactgacctttgtttaataattcagcaattaagaataaaaccaactttacatgttacttcctccaaagtaagtcacatttagaaaaataatttattccaaaataactgttatattaatttttcaaatattatttttttttactaatattcctaaatgttactttaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaagaattaaattacatttaaattattttctttttttaatctttttttccacctgaaaggatgataaagtgtaatgctgctattaatatattctgcaacctgccatcttcgtgaaataaagtgtaatgctgacctttgtttaataattcagcaattaagaataaaactaactttaaatgttacttcctccatctcaaagtaagtcacatttagaaaaataatttattccaaaataactgctatattaatttttcaaatattaattttttttactaatattcctaaatgttactttaacttattaagaaaattgattaattcagttatcaacattagatttatctataactatagtatttagttaccataagaactatgaatgaattaattgataaattcccattgatcaataaccaaagaaagcactattaaatattaattaacaagattctttttttattaggaattaataagattctttaaaaatacaatcacacaaaagaaggaaaaaaaagtaggaattatccttaaattattcttaaagatttttttcccaatctaataataattataacatctttcctatcttaatacaaaagcttgaccacaattaaactttacataacgaatacgtcattatatcctcttatctcgtataaaaaggaaaacaattcataaaggatgataaataaatccatagattcctaattcgtcaaataaaaataacttaaaattaaaataaaacgtttaaaattaaattgccttaagaatgaaatcaccttaaacatatagtgtatttgattacatatttcagatatgttttttactttttacagattccaaatgtaagacctaagacaccaaagtagtgtactaatataaaattaaccatacgatcatcttgtaactaacaacaaagcattgattaaccaaaatggtaatcacgtaaagctcatgaacccttaacccattaagatatatataaagaggagttggattctcgagacaataatttatcattatcaattattatactattaacctagttggtccgatatctacttgaacattgcatagttttgcagaaggtgtcacatccgttgtacactcatcaaatcaagaattatactattcgaagcaaaatgagattactaagggaaacgtaagatccactgaataacataatctgagaggccctggtgttgtgggggctgggggctgacagcttcaaagcaaaatcgaaatcttgaaaagtgaaagaaaaagttctaacaataatatctgcaagagacatgcactaataaaaaagacaataagcatgaatatagtcgatatttgtttactcgcaaattagtcaagaaatcagaaccaaagaagtaataaaaaacaagaaaaaaatgggctaaacccctaaatacagtgcgtgttcaatgctcaacaggttaagttgcctgaagtactaagcctttgtatcagatccactcaaacaaatacacctcttggaagcaacagaagcagcattttctgctacacttcccattctctcaaggtcttcttctaagtatctaaactcttccatgacactctccatgacccagtcaaagtgatcatctgcttgttgcagcatattaacctctgcttcttccactttcttttgctcaagttccacagctaccccatgcgttgtatgactcaactcaaatagcttcatggggtcttcggttgtgaaaggataaaaaatttgtcttggaaagcttgatctaagagaaaggtgaacagcgatatgagggtttccatttttcttttgagtgtgaattgaagaagcaactttcattggtgaggcatataaaggacaaaaaattggctttttgcaacgttaagaattgttttggcaggaatttgccgtagggtcacgtggttcctaaacctgcatgttgaaccaaatctgagtgaaaattcttgtgggacagtgaaaccagtaagataggatttaattatgagatcttttattctctttgggtgtattttttttttatccatatgaatcaaaaatggtataaaaaatttacaacacatagaggactaaattgtcctcattgtattaattataatgttctttaatgaactagacttcattatgctttgaaaaaggcttagagagccgttggaacttcttttcttctcatctataagttaaggttaagctttctctaaatgcagactttgtgtgaaggatgatttttcttatctaagggccggcaatttgattcaagtaatttttaaataactaatataaattaattttttactttaattcaaccatctgaaatgtttgttaaatgaactacagaaaagtaagatacagttactattttaattaacaattattgtggtactcagtactcacaaaagtttgaactaaaactgcgtctaggataaactttggaattaatgttgctttggtgatcaatgcgcagtttcctaagttgggatatgcatgtgcataaaaattcagacacagaaattggaaaagtatagctagaaagagtaacgtgtgattcaatccctgtctaagtagaaaaacttgtttcaattgatatagactttgccttatttaataaaaataaaactgatgaaactttttttttacaggataaaactgatgaaactcttaatataaacatcgtgcttaagctaatactttacattatatctaaaataaaaacgctcaataatgtatcgggtcaaagcatgaatgaaattataataagtgtacaaaaagtagtgatataatttatttggttatatagggaaaataaaattgttctcgttatccttatatatccaataggatctaattaaattcaaaatgccaaattatcaaattatgatctatgtatatatatccaaaacagatcatttcctgcggtgctgcttaggcagaaaaaaaactgaacaaaattaaaaaagagctagaggatgaaaaaataagatgaatgatgaagttttttaaaaaaaaaaattagaaaaatgttaatcattagatttattagtttttttaatataaattattcgaatccacttttttttcctttctattttcaagtcaatcttataattttaaaagatcattaatgagaaatagagtgacactgaacggttaaggggagaggtatccagagagggtccaaatccatatacaaatacagccataatctgagatggaagtaacacgatcacgaaggaagaagcataacctaatgggttattggacttttaacctcttcaaagaatataatgagtaccaatcgaaggcatggtagttaacggctaataattctattcagattatataaataaaataaaatattcannnnnnnnnnagtgatttttatattaaaataacgtatttcttaataagtttgacagttttatattaagtgataaatagaaattttaagtttttagttatacatagatttgactacaagtacaaaggtgacataatataatgaaggaaaaaaatgtgtttttatccttaaattttcagcaaattttggattgatctctatatttttaaatcgatgaatttagcttttcaatttgtaaaaatatgccagtttagtcaccttttacgtttatacttaatatttagtagcaatttttttttattgagacatggttagcaagttgataaaaaaatatgatttattttttattatgctcaaatagacccaaaatagtataaataagaataaaattagattttccaaatttttttataatcataattttgaaaattagttcaatagggacactttagaaaaataatggagtaaaaaattagtcaaatagataaaaaatggtgtaaataaataaatgaggagttgacannnnnnnnnnnnaaaaaaaaaagagctacaggatgcaaaaataagatgaatgatgaagttttttaaaaaaaattagaaaaatgttaatcattagatttattagttttttttaatataaattattcgaatccacttttttttcctttctattttgaagtcaatcttataattttaaaagatcattaatgagaaatagagtgacactgaacggttaaggagagaggtatctagagagggttcaaatccatatacaaatacagccataacctgaggtggaagtaacacgatcacgaaggaagaagcataacctaatgggttaattattggacttttaacctcttcaaagaattgaatgagtgccaatcaaaggcatggtagttaacggctaataattctattcagattatataaataaaataaaatattcaattttggacaaattacttagttaaatgaaaaataaaataatcattaaaattacttagttaacggttaatgaaagattaattctcttgtgactgtatcttctaagatcatcataactatcgaatttaaatacgacatcaaaacaagtaattcaaaacaagtaattgaatatattaaaattaaagttaaatagtttagataatatttgaatttaatggataaaaataattcttaataaaaatattactgtgcaatttagtatatagtattggcttttagcatatactaataactagtattgatatcatatcactcgatatttaaataattattttataaattttattttaattaacattttatgtaattcttaatttactttaacatattataactgaataatttaaaataaatagtcgcaaaagtgatttttatattaaaataacgtatttcttaataagtttgacagttttatattaagtgataaatagaaattttaagtttttagttatacatagatttgactacaagtacaaaggtgacataatataatgaaggaaaaaaatgtgtttttatccttaaattttcagcaaattttggattgatctctatatttttaaatcgatgaatttagcttttcaatttgtaaaaatatgccagtttagtcaccttttacgtttatacttaatatttagtagcaatttttttttattgagacatggttagcaagttgataaaaaaatatgatttattttttattatgctcaaatagacccaaaatagtataaataagaataaaattagattttccaaatttttttataatcataattttgaaaattagttcaatagggacactttagaaaaataatggagtaaaaaattagtcaaatagataaaaaatggtgtaaataaataaatgaggagttgacnnnnnnnnnngaccaaaaatagtataaataagaataaaattaggttttccaaattttgtttataagcataattttgaaaaataatggagtaaaaaattagtcaaatagaccaacaatggtgtaaataaataaatgaggagttgacattttcatttttaataaattttaaccaatcacaaagagagtaagtaagagaaagtgttgctagcactcctctaaataaataattaagaatcaagacaaaatagcaaaattgaatttttaaattgtgctcaaaatatagttttgaaaattaatccaataaagacaatttataaaacaatggagtaaaaaatcagtcaaatagaccgaaattggtaaataaataaataagaatcaagacaaaaaaaaagacaggttaagttgcactttaaaataaataagtattaaattatttttaatcaataaagataagagtaaattatactcgcatccccaatgttttgctcaaatttcatcttatatccttcatttttttcacattacttttactctcttatgttaatgtcgttaactaatgtcaattaaaatatgtgagtaggcgaaattatttttatattttaattgtaaaattcaaattatcccctcccaaataatttcataatttaggtttcacgttcttcaccgttcctctttcaattcaccgagttctctattgttcctcttccagttcgtgagttctccactattcttctgtttctcttcctgttccacgatttctgcttacactaaggttatgcttgtaagtgactattggaccttgtatataaattacattttaagaatatttatttaattttgattatttattgttgcctatttctgaatgggattttaatggggaccagtttggaaccattatgatatttaaaattatctgtttattattattgattaaaataatgttgatatttgggaccacatgaaacacaatgaatgaactgaaaatcatttgtttattattgtagattaaaataatattgatgtttgggaccacaagaacacaaatgcaggaacaaaacactaaatttgaagcaaatgatcatattcaatcaaagataaaaaaattgaactaaaaaattgaaaaaggaaggtgttaacattgcgtaccaagaaggtgagtttacgtctaacaaaaagttgggttcgcgttcaattaggaaaaaaaaacaaaaaaaaaacaagagtattaaaatattttcaaattgagaggaagaagatacgggtatttttaaatataaaatttcattaaaagttatatgaccaacacgtgtctactttcattaaacggtgtttaggacggaaggatgtggatgcaatgtgagttaaacaattaagggattttttgtatagtacaaaaaggaaggagtatcaaataagatttaaacaaaacataggggtttagatgtaatttactctaatgataaagatttaaaagtaagtcatcttaatcagtgttattaaaaccggttcagatcgggaaccgttggtagcaccggatcggattgagtgtggaaccgatcatgtaagtgacccagttaagcccggcaagaaccagccaatttttgccaaacccggcgacccagacgagttcaggaacccggaccagtttttgtaaaactcagaaaaaatgcattttcttcgtcttcttcaccgacaccttatgctggagaagctctgctccgcctactccgccactgcatccaaaaacatctttctgaaatgttaaaaaaaaatcaccattttgaaaaaagggtttctggaattaaggttttaaccaagagaaggaagagaagccaatatggaatgaagcagcaaaattaaggagatgttaaaaaattctatgcccagcaaaagaaagagaagccagctgcaggaaggaagcgtcggaaatatggaataaagaatggaagttgctcagcacaactagataagcatatatattattagggtttttttaatttgggcctgattgttgctttttgtacccatgttattaatttctggagcttccattttatattttttaataaaaaaatgttggcaccagcttcctacaccattctcaatttcttctacaccattatagttttgaaaacccaaaaatacccctggcagctttcctcttatattcctcttatatttatggcatgtacagttacgttgcagctttcttcttttctccctttattcacttcattttggtgccatttttgttgctacaaacgctgttcattggttgttctcggtggcattctgttgatttcgtcggagttttggcgtggtggtggccgtcggagtcgcgaagtggcgtcggggttgcagaggttggtggttattattttcgtgtgtcatacggattacctaatccgtatggtattaaatctactgtttgagaaatttttttaaaaaaattggttaaaacatatatttttaaggaaaatttaccttagctgataattatttgagagaattaatacggaaagttagtttttggattcaataacaattgagtttaatttataaaattatttgagtgagtaatgcatatttgaaatttgtggattgtttatgtatgtagatgattattaagacgttaatgaataattgtaaaaatgttattttatggattagttatgtaaatggtgatttatttgtatgtgattttagtaatgataaaataaaatgtgtagttgtaaggatggacaccgatgagtggatatatgaaagtatgttgtcggaagaaaattatatggatgaagacatcgaagcggaccctgatgcgtttgaagacaatgattgtgtagttgattgttctgcagcattcaacacgactgaggtatttatgtgcttttgaatgtagttaaagttgttaaatgattaaattgagaagattaaagatgaattactcatttgtgtaggtgtttgaatctcgtgatgcggtattgaaatgggctcgtggggttgcatttgagaatggttttgtggctgttataatgaggagtgacacaaaaaccggaaaagtaggaaggacgtcatttgtgttaattggttgtgaaaggagtggaaaatatagacaatggaaaaaaggtttgacacgtttgaccactgggactagaaaatgcgagtgtccttttaagctgcggggtaaaccaattttgggaggtcaagggtggatggtgaaactaatatgtggtaatcacaaccatgctttggctaagtcattctgtggacacccatacgctggtcgattaactgaagaggagaagatgattgttgcagatatgacaaggtcaatggtgaaaccaaagaatattctgttaactttgaaggagcacaatgcaaataatgtcacaagtttgaagcaagtatacaatgcaagatatgcataccgcacgcgtataagaggcgaaaacactgaaatgcaacagctaatgaaacttcttgaacgtgacatgtatattcattggcatagattgaaggatgtaaatgttgttcgtgacttgttttgggcacatccagatgcggtaaagctgagtaatgcatatcatatggtgttcctcatagatagtacctataaaacaaataggtacaggcttcctttgcttgacattgttggtgtgacgcctactgggatgacattctcagctgcatttgcctatttagaggcggaacgtataagtaatgttgtgtgggcccttcaacggtttagaggaatttttcttaaaagtgaatttttccctaaggtgattgttacagatagagatttagcagtcatgagtgcagttgaaaccgtattcccagaggcaacaaatttattgtgtaggtttcacattgataagaatgtgaaggctaaatgtaaaacttatattcagcagcagaatgcgtgggattatgtgatggatgcatggggaagtgttgttgactgtgctaatgagaagaaatttgatgattgtcttatgaaatttgaggttgcatgtgctccgtggccaacatttattgattacgtgaaggacacttggttgaaccctcacaaagaaaaatttgtcacagcatggacaaataaagtcatgcattttggaaatacaacaacaaacaggtaaatttcacttaagacattaggtaatttatcatttatatcatcatttgcatacgtttaaaaaatatgaaatgaactatcttcatatcataccttgcagggttgagtctgcccattggactttaaagcggctactacaaaatagtgttggtgatttgtgcacggtttgggatgcgatgaacaatatgatcaccttgcaacatactgaaatcaaggcatctttggaaagaactacacatgtggttggacatgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatccgtatgagtcatacggatcacccaatccgtacgatagtccccaacggattaccggatccgattccgccattaacgacctgcaacaccctccaaacagcaccatttgcacgaattgcgaaagaaatcactcaccagagtcacgagagcggcggacgtgcggcggtgtgaacaggagtgaacggcaaaatgcggtgcggtgcttgccggagatgaaggcgcacaacaatcactcaccaatgtcgttcaacgggaagaagaaggaagccaatgcggtgcttgccggagaggaaggcgctcagcaaaaatgaagaagaaacgttgcgggtgagagggaggaagaaaggtttaaaaaaattatataaatgattttaaaattaaaaggatataatgggaattgcactgtgtaaaaatggtgtatgagtaatggagaatggtgtaggaagcgcatgccaaaaatgttaatgacatatgaatatataatataattttgttttttgcaccccttttttgttttatgcagtttccattttactgttttgattttgattgtttctatttacgctctttttttattattaatacacttgtattatcaactttaatacttcaattattaatttgaatatgaaattatgaatgaatttttcttaatcaaataatgttaattatatgtatatgtatatagttttgaattttttaatatagaccgaattaaatcgaatcaattactaatccatagattggacccctgatccactaacccactatttcgactgagtcaatgattcggctgcttttcataactatgatcttaattcttaagccagaggcactaagacgggggtggaaataataaaataataaagaaaaccattaaaaaaaaaaaaaactgaaaaatcatagatacagtcatacagatccaaaatgtgcagagagagaccgaaaacgattgtttgctgtgttgtgtgcatagagggagggagagagtagaggctgctatggggaacagagctatgttaaagctgctactcttcttcttctcgaccaatttggttccttccgttctggctatctggctgacgttacccaccgctggcaccaagtgcgtctccgaagaaatccaacacaacgtcgttgttttggccgattacgtcgttatccccagtgatcacgcccacaacccctccatcgccgtcaaggtactctttttcccgtccattacgacacccttttgcgatttctgtcatgggtttcttcaattactcattagattctctttcccgtcttctgatttgtttggttccttgatttgcgtgttgacggatttgttttgtcgtggatttgctattactattcggtttcggaaaattattgtgtgttgttggtaatttgaaaggctttgtagaggtgcttcttgctcaactgattacctggaagaccatgttgtggaaaattgttaattttaggtcttatctttgggtatttattatcccattgtcttattttggccatgaattttgtggtattataataatgttatgaattttcataactttgttttgtttttacatatatttatcagtgaatgtaatttttattgcttaaaactactcctaattttttggtatatatgtctgtggagcctgaatggtctaggtgttcacgctagagaacacacacgccaggccccgggggagtcctaatgctcggtatgaacttaaaaaaccatagcgagcctctactatgttgacctgttgtaacccggatagatcacagctatttgatgagtgtgttctctaacggttcccaccatttttgggagtggcgtgcatcgtacctccctcacatgtaacgaggggatggtgccaatggtgccttagtcatgcatggggagaatctagaatctcgctatactggacccagggccggcctaaagcaaactttaaaataacattttttaatttaaacgtgagagctaaatttgaggcctttttgttaacatatgacatttttttcattatatggggccttttttgctttataaaactaatagaaaatattttttatataggcctaaagcttgagctttagttgctttacccttgtgtcggccctaactgaacctgagggttcaaaacccacaagactgtgatgtgatatggtgagtcagttataattggatggtcagtctacagacacaggccagtctacaagtgtgggccatatatattaactgatagtcttgatagaagttttcttactcagctggtctaattcttggccagacagtccaatttcattgtcattgagctcattgaataatttgctgctggagaagtggtggtaatggaaagtcgaaaacatcttagaatatggcttgcacacataatggtggaaatttcttacagcatggttcgcagagtagtattcttgctatgctgagtggtttgccaagatcaaagatggcagagttggagactttaatactgatgggaacaaattatagctgtcatgagaagttatgtatcattagatatacaagtaataataactgtcatgttggaagtatgtagtgtgatgtagaagggtgttatgtgtgcagtagttctgtaagtttggacagagaataatctctataggagtcataaaactggggaactgcagcccttttcctgattgtgtgaattctgtgattcagtaataaaaaaaccactaatttatcaactgatgctctatcaaatacctcagctacctggggaatggatcccttgcatgataactgcatttacaaaatttcaagtcttaacagaaataaggtttaataatgttgaaaaaatgtacttggaaacattttacatttctactaagtaataatagtttattttctgttgtttagacttgcttgtgtttatgtgttttcaggatgtaatactggttggctcttgaatgacaaccttctgatacagcttgttataaaggtctattacttgtctctttgtttctaatagtaatttgtttcctttaggtgacatcaccatatggaaacaatcttcatcacaaggagaacacaacacatggtagtatcgcatttacggctcaagaggctgggaactaccttgcgtgcttctgggtggatagccatagtcaaggagttggtgaggttaatgtaaaccttgattggaaaattggaattgcagccaaggattgggattcagttgctagaaaagagaagattgaggtaaacttccaagagatacgtataattttgaatctccctataggcctatactataggtagatagaacttaagtgttctacctatcaagggctgacatttactcaaggtataataagaaatgagttcagcactgttttaaaatagtttttaagagcttcttaggtttgtagtttgcttgaagtagttttgtactgtgagctggaagcagttagtaattgcctgtgaattgaaaaattttggatcctctcatgttccttatttgatgttcccctcaagttatgagtggaaaagacactatagaatgtttaatggaccctacacaaataatggtgtattactatagtttcttttgtatctttctctctcataacataacatgagaggatccaaatctgaattgaattctatacctaaaccttttactcttgaatgcttctctctgctgattttgctctacatgtgattgatacctaagggagtcgagcttgagctgagaaagctagaaggagcagtagaggccatccatgagaatttgctctatcttaagggcaggtaattccaatcacatcaacatcttcccctgtaaattgtttattgcaaataatcttttaaaaacttttcatatgcttaatttttgttttttgagttatttgttcagggaagctgagatgaggactgtgagtgaaaaaacaaatggcagagtggcatggtttagcattatgtccttggctatgtgcattgcagtttctggtttgcaattgtggtatttgaagcggtacttccagaagaagaagcttatatagattagttaatttaattttattagtgatacagcaaacatataataacttaaaaagagtttttatgaacattatttacaagtgtagacagaaatttttgataccacaagtagagtttccagcatttcttttccacggatgattactacaatgaattgtcttgtatgattgggatatgaaaatccgcagataagagggaaagaattttagtgaatgattgggtaaaagtgggtcttcatacctgcttgttcttgttatagctaccatctttgtgttgggaactacagggtaggataaaaattaagttcattaaggaggattgttttttttatgttcaatcatggttgtgtttcaattgctaatgctgttgaggatgtaaaggtctgttaggttaattgctttgtgtttaggggaagcccttcacaaacacgcatcaaaacacgcatgtagtgtgcatttagttaaagtgtgtgttttatttttttgttttaattctcggtttatcaaggtaagggattttaattaattcagcattcggtcgaaaaataagcaaagttagtacctcttagaatgtgagtaaattagatgtaacggatgcacaaacatactattactcgttgaaaagttgttgaccacgttaaaaaaacaaacgtgagagattttggtttttttatgttaatctaaaactttgttgatcagatatttttaatacaaatacattagattttaactatattcaatcttcaaaagccataaatcgtctaattaaaggagaaaaacaaagtattgaaaacagaagacctgtttgttacttcgtaaaaataaagacctatttatttagtgaaaaatttaaaatagattaggaaatcagcattaaaataaattagcgaggagcgcaaataaataaaaggttacgctattagtttataaccgatctaaaaaaaagtttataactgatgtgtttgattttctttttaataaatatagttgttttcatttcttaaaaaagatggttagtattttatattaaaataattatttaaaataaaaatttgcatgatagttatttccgattacttgatgtccaactaccaaaatattcttttaaatcttatattcgacatataggcatagcataatacaacaatcaaaacaaagacgtgtgtgaatttagttaacattcttatttaataaaaaattatcatataagactttatttacttaaaacttattaaaatatgttaaagaagttattttaataaatttgttaaaataaaatgttttttttttaaaaannnnnnnnnnnnnnnnnnnnnnnnnnnnnatttattttcataaatgtgaatagattctacaaaatccttccaaacacatccatatccattgtcaagaagttcaatttgtatgagatgctgtccaatacaatttttttcattgtttgacacggattatgcgggcctgtttttttagttttatgctaatttctcacaccatgtgtatattttattttaatataaaagttatgatacaagttaatataaagatactttttaattacatttagtaattcaaaattaatttgatctaattttaaaataaatgaacactttatatgaaacaccaaaaaaaataaagcaggatttttaatttattcataattcatttaattgttcttattaaagataatgcgtagacaacttaaataatcaccataagctccttgcttattgcaatagtcatttttcacatcctttatgaaatgtaacagagatataaaaaattaagataaaaagaaaagaataaagagaacatgagaaatatgatgaataatataatagggaggaaagagaataaaggtgaatgaagcttaagaaattaaagttgtttatatttaactcgttacctgttggctgctactatatttttttttttggttcgaaaaaaaaatatatgcactcttcatgaaaacatttcacatcaacggttaactgttcttatcttccgtaattgaaaatggtgtaatgcaataatatataatcctttaaacacagaaattaaaaaaatcattaggatctttaaagcaaccgcaatattttggaatcatgatatggacgctaaatttattctgcaaatttactaaaacgggagtcaattttcaaatgaagttcaaaatcaatacaacaaaatcgtataccagagaaagatttaacaaatatttagctccaaagaaaaagtgtctgaaattaagtaagcatcaagaaataataatgagctttattctattcgaactatgttatggttcatatatctgaaccggcaaatctcgtcaaaaaaatcatcagcgctactatggcagctcttcatctcaagaatctttataaccattctcctaagacttttcccgtacttcagcaatgattcaagagtactcattttctgttcagcattaagaggtgacctcactgtgatcacaacctcctccaaaaacggaatcacgaatcctgaatccacctgtgaaatatcctcattagatgaattgaaatattaaataacaccttcaatcagaagggtagaattattatgaacttacatgtttgagactgttcttctggcatagagctgcaaacatagctccatgaatatcaaacttttgtagcttttgatgactgttgaagaagtcaacaaaatcaacctctggaaagggttgaagtgcatcataatccccagtgaattcaaccttcatatagagatgtttcaccttacttgccaatctcagcattttgcaaatggcatcccagcaccactggattcctctcatacacagatactccagagctaaaagatttccaaaatcaaccatatacactctccctgaaagcaaataaattgaaaggaaagtaagttaaacttaaaagaaagggacaaacatatatgctttgggtattattctctaataaaaactggagttttcatctcagcattaaagatcagtataggttatcaaaataaaactctaattctaaatcaaataaaatgctaaaaaatatatatatgaatatgtatctaagttttgtccaaaagacaaactctggagattacttgaaaacaaggacacaaaaagagatggacaatgtgattgacctacaatcccaaatattctatctcgaatacaccactcaaggaagagcccttgtgtttgaactgtcaatagaaggcaaggatcaaactctattgtctataccacttagtgtgtttgcttgtgcgtttgtccataatttcaagaataagcaacatgagtccatttttagtggcaccaaaccaaacacgcacttaacttgatccggctctcatacaatgtcatgaacaaacaatcccagaaacttaagtagaggcacaaatgattatctgacagacaacagtcaacaacaaatatataaacacaaaaaccactttaacgagttaactacctgcactgttggatatggaaagattcctcaaatgcttggtttcagggaccctaatccagctacagccttgtacctcaagggtctcaatttggggggaagtcaaagtgagagaacagttccccatcccataaaaatccagcttacactcctccaaacatggcaactcaatagagaccgacctaaccccttcacatgcaagcagcaacaacctggtgagaaccgggcatgagcgaagcaccacactcaacacagggtcctccaaccttgcaccgataatttcaaggttcttgaggttagggaacacatcccatttgggggaacgcaccagcaacacaccccacagtttcagagactccaaattcttagcagcaccaatatagtccaatttggaagggctttcatggaagccctgattgtcagcaaggttgtccattcggagctcaagttgaagaagagtttgccccgccagtgagagccatgatgcaaggccatctggggaaaaggggctatacacaattagctcctctaacttcaccactcttgacaccattcttttgatgatgttgtcagcaccctcagaagaagaagaaggggtgtcaaatgagctgcgaggaaaatagagggttctgatgtagggagtggagtccttccatctcctggaaacacaattgcaagatgacacgtctcgagcattggtgattcgggacaagatgcattggagaatgacatcagggatagaatccatagctgggagcaagaatgaagaatcaaatagataattgttgaagtgtacacagatttaacaccatctttcaaaatcaacaccaagcagtgatgaaaacaagcataacagcaaaagtcttatctcactaggtgagattgaccacatgaatcacaccatgttattcagcttggttacaacaacaacatcaacatagattattcttttatgcagttatgaaagaaaaaaaacacgaatttggtaagcacggaattggaagagtccgtaaatctgaaacaacaatctccctcaaaataaacatccagaaaacccaagacatggattaaacagtaattttaaccaagtttagctgtcggtaacagataagctaaacttgtataaagaatagtaatacccagatggaattgatacatatgtgcaataaaaaaactagatagaaatgaaaatggaaaggatgtgtgaggagagaatgaagggagtgagaattgacgaagcttacctaataatgaaaatggaaagatctggatgggatagccgaaatctctttctctctcttaattggagatagattaaagagagagaagaaggagcgggagttcgagaaagacatctttttatttcggtatttcgaattttgaaaaccataccctcacaatatttaaatattttctctgaataaaaattaaaaaaatacattatacaacaaaagctgctgcgcgtgcgtttcaatgtttcattcacattgagttgaaatccagaaataggatggtcataagtaagaatcaccgtgaattcaaaccgatctaaatagatttaaataatttggattgagtttatttatgtattttggttaaagtcgaattaaatccatctaaatcgttcatatacggattggatcacgaatttaaatttatatatttgttgactcgttaacctgatccgtgaactcataataaaatataaattttattatttatttatatatatatttaaaaactaaaaaaataatttgacaatcaaagtagatgtgatactatattattttctttaatacttttaataaaataataataattgaataagttggactattggggttaaagttttctttagtactttttataaaatattaataattgaataacttgggttgttagtagttaaagtaaacccgtcaaccaccttgatctcgtcactgcatattgaagccaactttctttccttctcttttgttattttattttagggttacaaagttttcctttcttacttgtcggcagacgcatggttttgatagagcaacaccacctcaccacaccaccgcacaacctcgttgccccaagtctgcaaatatgttgtccacaaataaaggtatatactttgtttcgcaatagattttcaagtatttttttcaaattaaatattaaatcaatatgatttgtactttatcattattttgtttcattattaagtactaatttatcatcatctaactcaaaagattgagaagctacagtgctttgcctaacacactcgcaagttgcacctttttccttcaccaacattactcttactaaaaaattaagtgccactgtcatttagattcttaaatatgaagtttttaacaattaaacatactagtattggaactgcaagtgttgggactactagtgttggaacttcttgatgtattactttcaggtatattgttatttgtttcacctttttatcatattttttttaccatgtttataatattaatgaatcatattttgttcatttgtttcactaaatctggttgcaccaaatctgattatagcaaagcttattgcaagaaattattttgtaagaaataattgtgatccaaactattatagtaaatcttgttgaagaatcttttgttttaatttatattattagtctattttagaatattatgttgatggtattaaatgaatcaattttactactttcatacatttgatttaattgtattggatatttgaaagaatcataatataaaatagtagttctaagaaaaaaaattaaatttaaatgggtaatgtgttggtccaaaccaaaccaaaccaaaccgttcatgaatgaattgagtttaaaaataaattgtggaaatcgaactaaaccaaccaaatttgcttggattaaatactaaatttaaccaaaaccgattcgaaccgtctaataaatacccgtagccaaaattatgttgtaacatagcttaacctaatttcatataaattttcatatacggtgaatagtgaattactggtatttaatgaataagttgagactttacactttttttccttcttgattttatttagtaagctttagattaatcttgaaagtcccggccataaaagattaatcttaaaagttacgaagtcaattagtaattaatacttaatgatttaagtagcaatgagttttgtttgtcttaaataaggtattgtatttgagtctttcaaatgaaaaataggtgtaggcctccttccttaagttatgctttacttatattttttttttcttaaagtttattttagctaaattactttttcggtctctttattgttaaaaattttaatatggtcttttaattgccaaaatatatgtaatgtaacttttttttcttaatgatgacgttagcctgattcagtagatcatagacacatcattcctaacttttaaatgttgctcaactgtgatgaccttgagtattatctcctcaatctccacattagcaatctccctattcaacccattcaagaatatcgcaccatataatagccgctctatcttcattcgcattggctccaatatggctatcttcctctctttatagtaatccccctccatgctatggttgcccacggtaagattttgcaatttttggtacaagtctcaacagtaatggttgggcacagaggcagatccagaaaaaaaaataaaagggggcaatagtggcggggttcgaaggcggcgcctccaaattttttttttgtgaagaaaattaaagaaacaaattattataacaaaggtgtaaaaaatgtaaaatttaaaaaagaaaaaattaacaaaattagcatgtgatgggtgctcaaaagtaacaagagtgtagccactgcattcataaaagttacaaacatacatatccacactcactcctttcttatttttcatcttttttattattctttttctatgcttttcaattttttctcttgtacaaatatttaaactatttttttattttactttattttattattatataaaaaaaattattcttgaaatttaaggggggcactgccccccaacttctaacctgcatccgcccatgattgggcacaaatctcctcctcatcaaggcattcattttatcccaatcttaattgtaagttttatatatctccttttgtatacaacaatttggtcctccaagaaactacataatcataaaaaaaactaaactattctaagtttgattttcttgacttgggaataattatgaaactcaaagatgaattcgatctttcttttccatttaaattttaagatatgtcataataatagacttaccttaaaacacgttagtatcttcatttttatgtccctcaagtttttcatcttccttattttcctttcttctattatgttcaaacttcctatgaagacttcccactaaattttctttattatcattatcatagtagtctttgttctcatctctaacaccaacttttcacctccaagaagtatgatgtgagtattcctcaagagttcaatccaaccaatcctcttgtcgaattactcttatcgcccctcaacatgcgcctagtttgagttcatactcaagattgtctcccaccatgttacttgaaaaaagaagttagcaagagagtatgacatcactacactcccttacgtgtttcactcaagcaaatagaattgctcaaaccacccatgtttacattcaagaatttagctttccctctaatgttcttaccactcttgtctttcctctctctttaattctcaaactaagttcatggagaaataatcaaaccaatacatatattaagaattcctgtagtgtccaaaatattaatttttgaaggttaagtacaaggatctaccacgaaatgtgcaaagtatccctaagaaagaaaagatgatccaatattgatacaatgaagtagataaatatacagaatttgaaaattctgaagaagaaaaatgcactcttatataagaattggtgatattgtagccggattgatgttcttgggatcgtcctataattggaattgtaagaaaaccttgatttaatgccaacgagaacaagagtcaaaccaaatgttatggaatactgtgactcgatgctctataatggacataaaatttggtatgacgcgcataatattggattaatgatccacatcctatgattaatccgaaattttggaaaatgaagatactacaatcaattatgaatggtctaaatgataagtttttttttagcatcacggagaaacttgataaactagaatagttcacaaataataaaacataatctctctcactttaatcaacaattaatcaatcatctattcatgaagaaagaattacaatatgtagaaaactagaaatcctagttttagatttgaattaaagactataagttaaatatgaaataaaattctaacaaagataaatcttatacaattaaatatgaacttctaacaaagcctgggatgctctttgttttactcttaaacaccattgctgataacgttttttttttactgtccttaatgggctcttgagatttgtagagaagaaggggcatatggaatgttcttgaacagtccttgagaaagatctcttgcattttcaaagtcaagtttacatcaggctttgttttgtcgttacttgttacatgcccattataattgaacctatagaatctgcatcagaaacatcagggtgagatcaagatgagatcaacaagtacaggaaagaatagtgagacatgaaacttttaaagtggaaatttggaaagaagtacacctaataattactcttaaacttctgcaatcgctatgatccagtttggaaggaagacagagatggtttctttccaacaaaatccatgaaaagaaagtgtcaaagtcatcaaagtatgagaagaaagaaactcccttttgaggaatttagaaagatcaaaatcactaaaaggaaagctcctgccaagttcagtacaagctttgtgataaggctttttttatttttccgtggacattgaatggaccacatatagagccatggcccaaggaaacaaatagatccccggcgtgtacagtttttgaatgctatgctttgctttgagattctatgttctaactggaaaagttcctttccaagataggcatcaccaagggaagacattagacaaggtttgtgctaatgaatcagggccagtcaatttttaaatattgtaatttgttagtttttttttttttttttttcatgtctattctgtgattctgcagcattcactatatatcgttgtgtatcccaagtggcaccattttcccataattttatcgaaacaattgaaaaaggaaaaacatatgtgagattgagaatcgatttttatctgaccaaccaagtgaattaaaacatatccctttatttacattaaaaaaacaaaacaaaacttttgcctcccttttctcaagggtaggacaaatcagtgaataaatagcgtcattgtaaatttgattctaatgaaacaagagaaaaacagaataaataaaaaaatgaaaggtttgtaagatcagtgaaaagtgcgtaaaggtgcagaacatatgtatgaattttaggatatcagtgtgacataagcgggcaaggtattttttgactgattaagcaaggaagcttgttcaggctgtcagtttacacaaactctcttcctcacgtattcttccattgtcctcttcaatcttactcataaataacacaacccatcaccacatcaaatgtcacataactaagagacagagtgagagcattagcagatggctaatccacacattgcactgctgaaactcacctccatcttcattgtaattgcctcaggtaattcattcttttaagctttatttgttgccaaccttagtgaagcaaaatgagcatttagagctgaacaaaacttagaaataattccttaaatgtttttagtgttattttccaatcggaattgaagttttatcaagtaacatatgatgacctttaatatataaaccattattatatgaacttttattatgtgaattatcgaaataaaactccaattctaataagagaataacaaaaagacacgttttgtcttttaaagtcctacatcttttgtttggtttgcataagtgaggctagccctatgtgtagagtttcttccattccaaacttccaattttcctatttggattaatatattaaaaatcaaatttcaactgaatatttttcttggttcatcactaacatagttggtaactagtaatcctctgccattgccatgcatactaaattctcatcatggaattttgaaccaaattttaagttcttaaaataaggagctccttcacttttgaaaaaacactttgcctgagttagatggaaatttacttttatgcttactaatttgacgtgttggttggcagcacctgagctgtgtggaagcagtaaaaatttcactatagtaaattactgcaaggagacaatatggcccggcataactcgcagtgacaaccacagtggcgacggcttcgcattgaaatcaggacaatcaactgtatatactgctcctgatggatggagtgggaggatatgggctagaacaggctgcaactttgacaatggcaatggaaagtgccaaacaggtggctgtggcagcagcataaattgtactggccctggaagccctccagcaacaagtgctgacttcacccttggtgaacctgatttctatgatgttagccttgtggatggcttcaacttgcctatagtagtgaaagctattaatggcaccgggaactgcagcactgttggctgtgatggagatttgaggcagaactgcccttcagagcttgcttctaagtacaatgacaaagttattgcttgccggagcgcgtgtgacgtcttcaatactgatgagtattgctgcagagggacttatggaaaccctgcaacatgtttggcttcaaactactccaaaattttcaaacaagtgtgccctgcagcatatagttttgcacttgatgacccaacaagtctaataacttgttcaaaagcagactttgttgtgatattctgtggatcaaggtgggtttggtctcttaatgggaagacatctataattgagtgcatcatagaattatacatgatatttctcatatcattcaccactgtttcttctgattattcttgttgaatgcaggaatcaaacagcatgttcctatcaagacaagcaggttgtatgtaatcgaccaaataaagcttataaagccataccgcagagctggtgggtcctaatgctcccattgacatacgtgttcaatttaaggatcacaccttagccaattatgcaattgaagaacttctctttgttacatttttttgttgttgaaattctctttgttacaatcattaattcattttaacaacaatggttttctttgagctaaacacaaacagagaagatgcttcttaatgtattttcttctacctaaacacttgagatgaggatttcctcaagcattaacgcatgatgtaaagaattttctgccttggaagttcaatttttttatctgtattgtttttttcaatcctagctaggccagacaatatcatctgagtgggacaactgaaccaatacaactacaaaatattttgtgactcgtgagtgattcatgtttacgttggttgatgagggcgtaacacaatcccctgtcaagaactggaaccaatacaaatggttacaattgatgataatttaatgttaatgttgcacattgcaagttttaggattaagcacatttcttgtaacaatatagaaaaagaagcaactaataacacgatctgtaacagaataatcaagtggacaattgaatgcggttggctacgccaatcagaaaatcttaaacctaacaaagaatctaaaaaaagttcaatttgcatactcatatggatgtatgtgaagctatttgtatacacaaaagaagcatactctagagttaagcttacggaagatacctttctctataaaccagccttcaaaagaaatggaatggaacatcacccatcttttctcatgggacgtgggacctgcaattgcaaagaaaagagagaaaaaggcacggggtggggaagcaacttaatgaaccaagatctgttagcacattttattgtcttccactggggtaacactttcaatatagagcatagttccatttataaccctgatttccttagaaagaatgaacaatgttcaatgttgtttccagcaatagggaagccacaaactgcaaaatgatcccaaaggttgttctctaaccgtacaaaattgctaaaactacctatctctggcattccatgcaagaagaatttaattcgaataagttaatcaatcattgattattatttgttactataataaaaactatcaacttttgtattaattactttaagagtggtattcaaagtgatttctaattgtaacaatataaaaaaaatcactcacaatatcaaaactacaccaatacaacaaagccaaaatataattttaaaagtttatgggagagtttatttaaacttgagaaaaataactttaaaataataattttttatataagtgtttttttaagaagtaaataagaagtataaaattgtttttttaagcagaagacaaacatactaaaaaattaaaaaatgttacttattttattaaataaacatttattttaataaataagtttaaagaaactgatcgtgtttctttacattttacataagctacgccagacaactgtatgtctgtatgtcactgtcttatgtatcgctattctaatttccttagtcctcagattcctttaagaaaacatcccgagattcttcactttcaaactactagctagggtagcatgctaaagctttcttttattcatttctctccataactgcaatacccatgacccatgtgatgtgaaggtcctcgagaagaaagggcaaaatgtagttaaatgaggacgatgattgcagaagataacagcaatcatccctgtgaataaacttctatatatatatatgtgtgtgtgattgctaatatttacactagttggtgtacccttgaagctcaatactaaatcttctttaccaaaaaaattattaattctttagtttttcaaaatttaatgtaaacatatttacatattttatcatttaatttaaaaaaaaatcttttttctcttattttttcacatttttctcttttctttcatctataagcctctctcatatcaaagttattcttctttttttattaaaattattattaattattcatcatcaccactacttaaactattgttataattatcatgattattgtaaccatcactaataataataacaataactacaattaatagtcatcacattgatagaagttgagtcataatgatagaatcaaaatgataaaaatataattgagatattttaagaattgataatttttatataatatttttttaagatttgatgattatatgatatatttattttaaataataaaatacgataatataatctaatgcttctgatgtaactactaaaaaaaagcacgcgactcatcctcttttgtttccgttcagcctcctacgcacaattgaaagaaaaaaaaaaaaaagaggctttgcggcagctattaacgaatggaatcggtaatttttaggacttgtgcctctattgaataaaaatcccttactagcagaaaatatgtaattgctgcgcaacaaggggtgtgaacaaaaaacccatattttgttgtcattatcccaatcaatcgccgaaataataaaaaagagggcactctcaaattggataaaaagaaatatcaaatgctgtgatttcacaattttgaaaatgattatatgaatgaaccactgctatacttgctgcaatgatcccaaaacatgtgcctcttaaatctaaaacccgctttgtgtgttgcgcatgaattacacaaatattgggatcaccatgtacggataaacccaaccctttcctattaatctttgtgcagcaattacacaaattcccagatcctcaaatactcataaaaggatggatgttcatcaatttgaataaaaaattatctaatattgcaatttcacaaattgagttatgattgaaaaaaaggatattgaagtgttatacgatgaatttattaaaatccatcattgttgttattattaactattttaataatataaatgccaagccaatttagttataccccagtaatggcaactggcaattgttaatagctgcttccctaattttctgcaagcacaggcacaggaggtaattgccgcaaagtcttattttgtgtgtgtgcgcaggaccaggaggctcaatgtgaaaccaaggaggaggactcacatggtttttttaagtagttacatggtaggcaggattggaaaaaaaattcaaatatataaaatcaattcatattctattctatttaattcactttaaatctatttaaatggtctaattttatatctatttttttattttaaatctaatccaattaattggatatagattggatatgaattggatatttgtatggatttttaaatccaatataatttttttgaacaatgacaattaggtttttttggtcaactttggtaggagctattttttggtcgacgtcgtttagagttattttagccgacgccaactgatgatgtttttgagctatcattggttaagactatttttcgattaatgtcagtaaggttttttcggccaatgttagttaggactattttttagcggatgtcatccaaagtttttttagccgacatcaatcgaagctattttttggtctacatcagctagagtttttctactgatgtctgtcaagattattttgtggtcaacgttagatagctttttggtagacatcagctagagtttttttttcgacgtcgattaggatttttttggctgacattagctaaaaacatcatcgatcgacacggcaaaaaaaaacctagctgacgtagaccaaaatattctctcaattgacgtcgattgaaaaatcatggttaatgtaaaaaaaaatccttagccaacggcaactaaaagaaatagtcatggctgatgttggccaacaaactctagctgatgccaatagaaaatagtttcaactagcatcagtacaaaaacctagtcaacgtcgatcaaaaaatagttctgactgatgttgacaaaaaaatatcaacaactaacatcataaaaaaaccttaccaatgtccgccatagaaatcctaagcaacgtcgtccaaaaactagtcacagtcgatgcttattgaaaaacccttagtcgatgtcggccaaaaaatattactggtcgacattgactaaaaatcataatcaacctcaaccaaaaaataatctaactaagatcaatccaaaacatccttgaccgatgtcgatcgaaaatgcactaatcgatgtcaaaccaaaaatagtcctaactaaagttggtataaaaatgtctgggtcgatgtcagccaaaattgtcctagttaggtaggccgaaaatatcctaatcaagatcaaccgaaaatagttttgactaaggttagttgaaaatagttcttaaatggacatgtactaagtttttattttttagcgtttaattactaaaatttgtaaaaaaaaatctttataacatttaagtgaatataaattaaacatgaccaaatccatatccaattaaatagattggatgttgaattcaaattattttttttttaaaaaatatagatataaattttagattcaatccatttaagtagatataaattgaatatgaattaaaatctttaaaatctaatccatactcatccttagtcgtaaccattaaattatattagaatcaacgtctaataattaatgtaacacttttaatagtacattaatatattttgttccatatatatatatattaaaaatgtaagttataacaattaacttcttcaaattatagtcaatgagatttaattcaattagttgaaaatgacgtttgaattattataaattttctaatattatttttgattcctatgaatatttttttctttcaaattgcattaatctaccaaacatgctaatattgttatcccaccaactttgattaatagtatacctaatcctcacattcccaaatatttctctctagctttccaaaggctcaaactctaattaatgatcttttgcacaagtctctttagctttcatataccttttatcttcctgtgatatatagtaagaacacaatgagatagtttttttaagcctcttgttaaggataaaacttaatgtattgggaagaattttacttaggcagatgggacaggagcgatgcagttttgaagtagctagcaatattgaattaatgctactagaggggtattaatttgcatactggattggatcgtttaaagaaaaaaaatcattttattcaatcaatttttaatttcttttaatttaccaattaattatttttatttataatttaaatgtgatctaactcgattcaaatatgaaacggttttgaataaatcaatattcaattgtataatgatcataaaaaannnnnnnnnnnnnnnnnnnnnnnnnnnnnnnnnnnnnnnnnnnnnnnnnnnnnnnnnnnnnnnnnnnnnnnnntcattaaatttaatggatgtagttgagtaagagtttgaaagagaaggaatggagtttgatctccatataatacacttttagagaggggatgatgagctaatatatttataaaaatataaaaaattacaccacttaataaatatatttatgcaccttgattaaaatagttaataaaacattatctttaattaaatacatttttcataaaaaagtataatttatgcgataattttataaatataaaagaaacaaaaaataaacatgagtaatataaaaaaattaaaaataaaaacatatgtacatgtataagttttgtttggctggattaaattggattgattttcaaaaatcaaattcaaactgatccaataaaaaaatattttttattttgttttccaaatttttggattgattttttcaattttaattggactgaatatcagattattaatttttttacccctatatacttaaaattggattaattttttattaatgaaatacatcaaaaaattttatttaacacttcattgatatacatcaaaattaatgaaatatatatttaaatattatatatatatntttacccctatatacttaaaattggattaattttttattatcagatagattatatttacaaaatataattaaatcaaaattatttaacacttcattgatatacatcaaaattaatgaaatatatatttaaatattatatatatttaaaaataataattatttacttatattctttatttcttttagttatctaaattacaaaattcgacacaggtaatctttacaattgtgctagattacttgcagatgtgggttcatacttgaaaatcttgttatgcttttaatgaataaaaagattagacgcaaaggcatatgattggtaagaatgggatttttttttaataacaagaatgagaatgtacatgttttacactccataaaagtgtgtagtgattatgatagaaaatgattatttgatatttataaagtaaggaaaaaacaaacttctaataattaaattatggaacagttaatgatcgatattcaaagtaatcttttaaaaatgtgcatgttctttccatgtttattttatataccaaccgctgttttgcttattatgtctagagacattcagttttcaaattaactgaccataatatcgatcattcaagcaagccattaaattgttgtaaatatatagttttcttataggaatatgcacaataaacgtcaaaggttgaactgataaacagtgagttgacaaattaaataattagaaactgagtgggagacatggccagcccattttgcatccacctttagaagcaagtcaaaaagcatagtgaaatcacaatgcaagcaaatagcaacttaacaaccatggtcaaagaaagcctcactatctccaaccacgtgcaagataattagcatcaaagagttgcactctaagggcacaaaagtctttattgcaaataagaagcggatatcattgtcatatacgtacaagccctaaacatatatatatatatatatatatatatatatatatatatatatatatatatgcaaacttctacagacaaaacagagggattgaaagtctttgaaaacaacagaagctagcccccaaggggccaaatattccaataactccatgcacgcttatgcacctttctacaaaagccactcttatttcttcctttagtcaaaacctacccataatctcttcttcaaatctcagccagatcgaatttccaaatttccttatgctttctctttgctctatattgcctctagggtttctcagaggccttattccatagccattttggcattctgtccacctccattaatattaaatgggttgttttagaatcaccccaaaatggtggcagttggaggtggccagtaggccaaacgggctctgtgaatctgtctccgagaaaccccttgtgggctcaattccctttcataagtttcttctcaataattatcttcttccacaccatgcacatgttaattgagttatacatttacgtttatctttaattttggtctgagtctaattggtttttattttgcaggttcctacttatcagaaacacgtcccttttctttgatgatgaaaatactacgtatactaaaggaggcaagaatacttgatgaaaataactatgctttgaaggtacttagttattttattttatttttcctagtaaagaggatcttgagggtggaagtcaatattaactctgacgcgcaacttattgatcatatacctattattttattttgctagcgttaacttaagtcaacctccaaacttgaacttgaaacgtgaataggtaaatacttttactatttaactttcctttttgttagtgtcctaaacttttgtcttggctatgatggtaatgttgcacctttttacaagtctaattaaacctaaagtgttgtggataactgcatgcgtttccacttgttcaaaatccattggctagcagaaatattttatgacccattgtagcggttgcagcattggattcctagaagcattatataattaatttagactttgcaatggtgtctgaggccaccattatgagttgtagacttgtagtgttttcaaatggaaacacaattcctaccctaacttatccacaaaatgcactcgcacgaccatgtatctaacagcaacacccaccaccaccaaccaaggatttttcatgagatggaaaataaaaattatttgtccccgcaatgtttgtgaataaatattagctaataattaattactttgtaaggaatatacatctttcaatgacaaaatattattaatttatttctttaccatataaaaattaatttacatttaattatttaatatgttaaaattaatttattaatatatttttatattttaaaataattttaaattactttaacaaatacatcttaaattaaatttgttttaatttatttatgatataaaccacaggattatttacgggatacaatcttattcaaaattattatgaatgataatgctcgctatactaaaattagtttaaattcaattagttaacggaagatatcatattctattaatatttgtctaatactattagcaagagaaatagtatggaaaattttcttagactaacggtagttggaaacgaatctaagagtgtattaaagggaaggccaatttttttttacataattatttaaatatttttaataaataattattataaataacaaatttttaaaaaattattattattaattttatggataaaattggagaataaactactgcttttttttttagcaaatatcaactccaaaacctattttttatattttattaatattttaattttaattttaattttttctcatatttacacaaaggatctaaagaggggtgagggggctgggagccaaggcttgtccttgcccttccttggatccatccctcacaccaaccacatgtcatgaacaaaattaatattaaatcaaataagttaagagacattcacatatctttgatgtagtaaaaaaaattataaatatataataaatataatgaaattaatttattaaacattttttagcaacataattttaaattactcattgaataacatcataaattaaattagttttaatattttataaaaaaaaatcacaaatatcattcaggaatataattcttaatttatttccttctgttgtaatagtgagagttatattcctgaattaaattaacccatcattgcttttaatagtactagtgagggttattttctataagagaaggaggttaacctcaaatatagaccttaattaattccttttactcgtatatggtactgctacctattaattgaatatcttttcagtgtaatctttagtgcgggatcttgatttattccattctgttgttatcctctaagtaggggtcattgcttttaatagtaataatagtgatagtgaagggtattcttttattaagggaagggggaagtgttggtacctattaattgaatattcccttcccgaagattgtggaacttctgatttcaatgttcaaaggctcatttaaattttcgccaacaatataaagaaaaataaaaatcaacgttaattatttatatatgaatggccattgagaaatttaggctttatttggcatattcaattgaaaaattaactaaaaattgaaaaggtgaaagttgaaaattgaaagtaataattgggtgaattatacgtaccgtaagtgtttagtatatatgtatattgtaagtcatttatactgctattctaatattgtcatggatatataatcccattaattatgtttgcttagtaaaataatatttggtgtatagatcgaacctattgcccaatgacttcgccgttcacccttgaggtccgcaacaaataattttataagaataatttggagtttggacaactttgatgttagtttgagtcatggaagtgaaattagaccttgttttatatttttttttaaagaaaactaatcagcctaaaatattaaaaaccactcattcaaatctatgttttgtttggtttgatttatcaacaaaattgatccttagtaataaaaataagtttccatttgaataaactttttttataagtatttataaaaaggaaaaaaaaattaagtaaattttttctataagttaaaatcagcgtaaggatataggctatttataaaaactctccatcttcaaaagctatttttttaatcttcctttcagaactcaactcttctttttagttgtttctgaagttggttatgtaaacgtcatttgaaaataactacggccaaataacttattggcgagtaaagtacagtaaaaatagacactcttctggacatttttttaaagacagattatattttgataatatttttttaaaaaaatatctaatcaataactctcatcatattacgttacattatcaattaaaacaattaattatctttctttctatctcaaagctgtctataaaacattttcttttttaaataagctaagattatagatattgttgttttccccaccattggccttattatataagaacacaaatccgtgtagagctgtttgcttgactggctttctgttggaaaaaagaaaattttggtcttttgtgaacagtaatgcaccccacagacaatcttttggaattttagtcatgtctaggaaatgctgaatgtgtattttacaattgccaatccgcataaaccattgaattgctcttatgtaacagaaggcaaatgcatgctacatttattttgaagatactttgccttggataatcttttgtaaacaatgggagggaggaatctattagtgtcctttggagctgacacatatcagtcaccatatatcatcttatgatgcaacaattaacgaatcagtgttcaggatttcaaagcggaaataaacagttttaatttctcaatagtgtagctacctctataatgtaatgcaactaacataatgattaaaattttacgaaccctacctagatctttgttcctatgcatgactttaaatttcatataatttaattttgttctggcgggactaacttcagctttcatgcattttgttaggcctgaaagaaattaatggcagcaagttccttatgttaaagtttgaaatgattacttgattatgcaattgccaatttgttctgaaagatattataaattggtcccgcactcggcaggttcacaagttttatattaggtagctagcaatttgcaaatgacctcaaattaaagtccagattcagcttatctttaattagagtcatggatttccttatatatatatatatgtatatatttgatttcatcatttattcttaagaaatgttgaggaatgtctgtttattaattgtcttgcaaagtaggaaaaaaaaatgctcccataatttttctccgttccaaacatcacattaatttattgttacaattcaattacctatgattttgtctcatattggttgttggctggctgtgtttagatttaagaccactttgatttatgttacgcgcgatttcattacggatggactacaactttttgtttgtgtttaattgagtatttctggattcacaaaaaaaaaatagtatttattgatttttttttaatactttttatcatacgagtctaattaattcttgtctaatatttaaatccaatcacacatctcatttaatccttatgtctagctaattaaaaagaatttaatttctatacattattagcaaaaaatattttacattatcaactaattaaaaattatgataaatataatttttttaaataattattataaaagtcaacttaacaaaaatgtcaattattaattgaataatattataaaaaatattttacacaattaatacaaagactgtgttcttttcaaaaatgatatatgattcaaaaacgtttatacttttaaatttcttttttaccatattataagtgcgaattgattattactaattttaaattaagttcctgttgaatctgaacgggaggaccaggatattcacattggccatcgcaagggagtattgaagacattaagaaattattcaagcattgcaagagcatctctatggaattgaaaggcaaggcttcctatagagttcagccacttcaaatgggagcatctctagagaattgaatgagcttgcacaaaaaaagagtatattaagcaaaataaggggagtactgtataattaaaaagagaaatcgtaaatagcaattaccttctttatttgccacataattatttggtcactttgaataatctttagaaataagccaataaatcttgtgggttttctgaataataataactagatcgattttggggctttttttcttcttttccctctaattcgttgtcattctcgttcacatcggtgtatgtattagtcctatatatactatacgatacggtatattaagttgagtttagtttagttagtaatttacaagttgagctaatataataatcatgtacagccaattaaggtcttgggtgattttcgcataacgttaaggtgattaatattggaatgtaggtttaggtattttttttttctttgttgaaagatattttgtttgttgatttttaattgttttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaggagaaataatcacttgttcctgaaaatgtaagaatgtgataatttagtcctaaactatgtatgcatgtttggataatttgctgaatgattttagctccaaaattcactgtggagaattcaaacaaacaaagagttgttttttccataaactttttaaaaaatgatttctgaataatgtattgcgtatccaaatatatgctatatagtattgaaaattgaattcactaacaagttaggacaatgaatcgtaagtaatatataatttccacaaaagactgaataaaatatacttttagtcatgtgccatgttctttcttttatatttaaaaaagaaatgttatttctataataattcatataacaagttgtaccttaacattttttgtgtttatgtctctcatacacattaattaatacatgtcataatgatgcaggaagataaccacaaattaatgttgtgcaaattattgtataaattttcttaggtatatcacatctcaaatttaaatggctaaaatatatttttggttctcgtattttttataattaataatagttcatctattttaaaattgaaaaatttagtctttttattttaaaaaaattagtaattttgatcccaccatccaaatatagtcgttaacccttaagaattaacgttaacctataccgactcgtgttacgattgaggaaattacccgtcaaccctttcacaccatccttatcagttctcactgcacattagtcattacccttctcaaaccttgataacacgactgctatatccaaacatatctccaacgaagtcattaccatcattgttatcatctccaatgaaggtgattggtctgtaccctagttatcttcctccataaaagcaccatgagcacccctgtccctcaacctcttatttatttatcaaccctttattccaccccttcctctcccttcaccaagcaccatggcactaccagagacaatacacaaaaggctatttgcatttgtgtaagcatcatcgccttctttggctcatgcttccatatcggtattttggatcccaatgatatttaacaaaccttctctaggattcacaacatttcaatttattgttgaggtctagaatcttaatcaacacaagatgatttgatttattaataagcttttatgctaactcgattgatatgtatgttttgcttgaattagatggagtgtttaataggtggaacttttctacctgcttcaactcaacaccaactttgtgttagtgaaaattagatgagagctcagaaaatgcttcactttttttaatctttgaacaattttcttttcctttgatatttgtagatcatagttggtaattgcaaaaagatgtaattaattaaacaacttaaagtgaattagaagaaaaaaaaataataaaagcaagcaattagcacactagatagaagatgctagatctgttggagagattcaatcgataaaggtggagataggttgttgagaaagtgattggttttgtctacttctaattgagttaatgtttgcccatgaaacagtcaatgttataaaactaatagtcaatgtctaatttaaacagtgagatcaaaattactaatttttttaaataccaactaaatgtctcaattttaaattagaagaactaaaattattaattgtaaaaaatagggggaccaaaaatacattttagccaatttaaaattataaaacaatagttaaacttctctaactcccaagcaaaggcccatagatgaaaataaagttacaaaccatagatcaaatttgtaattctggctcattgtgcctcaccttcagcctagatttcttgtttcttacactaatcttttgaaccttgtttttaaaatgaataaaaaataaaagaaaatatccaaagatactaaacaagtgcatcactaaccaagggctattgcatcctatattctcattattgtattctgcacctcctattacattctgaaaagtccatttaatggacttttcagaatattaataaaaaataaaaaatacaataatggaagtgcaagaatcaaatatcactccaaagcattttccttgtggtcaacccatattgttaaaggttcaaccatttgcataaaaaagaatatttcttaatgcacatcattatatactttggtgcaccccaagtgcatgtccaaagcaaataataagacttgttaaataattacccataaaaaaatgacgactcaaggccaattgtaatggggatggttggagagtgctggggcactactgcctcaaaaatgatgactcaaggccatggattgggccagagtcataatgcttttgatttagggacaaaaatattacagcccggccctatagtcataatgcttttaattcagttatcattaaagttagatatacgaactttaattcacaacttgattgtataaatttgaaaaattgtgggtttgagtctaaaaaacagtgtttcatttaattgagagtttatgtgagttgatttatataacttttaagttaaatgagttgaattggtgggcttgttgggttaaattattagcccacaaaagtttaaaatatatatttcatttgaatttaattataagtaatattaattgtaattaaaactaattaataaaattatttaatatcatttaactttactaatcatattaaaaaaaataattatttcctaaagtattctttattaaaacttgatataaagaagaattgtttttttttttattgaaaatagaatctcaattaattaaataatattttttannnnnnnnnngcttgttgggttaaattattagcccacaaaagtttaaaatatatatttcatttgaatttaattgtaagtaatattaattgtaattacactaattaataaaattatttaatatcatttaactctactaatcatatttaaaaaataattatttcctaaaacattctttattaaaacttgatataaagaagaattattttttattgaaaatagaatctcaattaattaaataatattttttagatgatatcattaagtagtatgaaagtagtcaaaatttatttatatttaagtataatctttttatgttgcttataattaagactatagtagtattttttgaaatatttttactatcattttaatatataaaaacaaagaaaatataagtaaaaggtttatcttttttatttatttataaagaaacgtatctcgtacatcattctcctatatcatttaacatgaaacggtcagaattcttttttcaagctattttttttatcaattaagtttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgctagtgacactctctttgtgattgtttgaaaatttttaaaattatcaattttggtagatatcatctaaatcaagagagacaaacattgaatgataagtgagacccaccaaaattgatattttttttaacaaattttagccaatcataaggaaagtgttaaaaagagagtattagaaaaagtgtgactaacatttatctattaattaataacaaatttttatatatgataagttttaatttttataataattatatatgatattatgattatttttacataagacatatatgacacttaaacatcaataatggttgacataagtagtaatgacttatgtttcttaatcaagtggtctaggattcaaatctttattgattcttaaatatgaattttttttgtaaaaaatactcatcttattaataaattttgttagaagatattattcatcttatgtatactcacattttcaaatgaagattagttactacttttaatggagataagtgagaaaaaaattatataacacttatactctctatctaatgtatctaagaaaaatgatataattatataatcgttaaaatattaccaaataattcaataattatatttatttaagtatatgaaaatgaaagtggcctaagcaagatttagtttgtattttactaaaagttataagttctgaagcaaagacctacactttagagtagagagatagatatcacatactgccgacatttattcttaatagataagtgacatttatagaatagcacacatacacacctatatctatccgcttatttaaaggagctaacttccccctaaagggtgcactttttgcattacaatacaatatgtatgagtagagagaagttaacaagttaacttcaggcgccagcgttgacggcaattttcatcccagactcgcaatgaccaacataattgcagatgaagtagttcagtcccttgccaagtttgatctgatccgcccctgactgatacactttggctcctcttggagtcgtgcagctatcaaatccagccttgttcacgaccaccacattgtgagccccagggctatacttaaaagctgcaccccatacacaaaaatgtatcgatttcatgctttcaaaagttagctagataaaagaattatcaaaaaggaaacttcttccatgtgttatatactgtatggaagacattgtaacaagctcttaacatatttaagagacttgtattaatttcacctaataatataaattaagcaacacactcttcacttgtttatatgtgacttttaattattataaaaaatttattacactcatgtaatcaatttagtcacacgtgacaaactattaaatgctatgtcacatcagtatttatcacgtcagttaaaattaatattgttcatatgtaatctgacaaaaaagatcagtttagtctaataaaaatactttaataaccaaaataattttttttaacttaacaagttaaattaaaacaaaatatattttagctatttattaattagaatcagatttgaggtataaatttctttaaaacaaatgaggtattaatttgtcggtggttaaaaatgaaaaattaaattgagaaattaaagtagttattaaaagaacttaaggctttgtttgagagttaggaggagagaaaaaggaaagagattcaaggggaaaggaggagaaggaaaggaggagaaggaaagggaagaaaataagggaagtttctttctccttgtttgagagttaaaaatatattaagagaggaaaatagaaagttaataagaaatttttacaatttttttcttatttaaaaaattaatacattatatattttacactgattaggatatgatagtaattttattaacactgactggtatagtaataattttagttacttttccttctaaaaattcctcgaataaggggaacaataattttaaagctttggaagatttcagaggagttttaaaaatcctcaaatcctttctctcaaaaattaaaactcacaaacaaagaaatctctctacataaacttttttcttcccttctttcctctccaaaatctctctctcaaaagaaagactaagaggaatttatctaatagtaaatcttatacagatagaataattggaactgaccaagtgtgtcattagcacgaaaacgttttcctttgggccaggaaacagtgttaaaggtccaaccagcagaatctccaactgtgtaggtggcagcacgagccatctcagagtgaagcagcaagaagcaaagtagtagaactactgcactgcctcttcccagagccatttccttcagttgagtttaactaagttaaagaaggagatttgctttggaggtgagtgcattcggtgactaagaaccaagcttttataatggaggagtcagggaaggcccacacatttaatgggtggttggttattaattactaaataccatggctggactcgttgtccgagaaattgtgaccaagccacatgcgtctgccaattaagggtcattactttttatctatagacttacttcttttactaaaatatcagtatgaaatatttattggtataaataataattagtttttatttagaataataagtgtataaaaaatatatatttttctattaaatataatttattttatattcatgtgcatgatttaaattagattttaattaaaaataaattattatcatttatgttaattaatattagtctttataaactatgaatactctaaaaaagataattttatttaaactaaaatgacattataagtaataaatttatttataaataatgtaatttttaattccttattaatgtatatgatttttagaattatcatgatgaatgtaaagtatttactaattttattaacaaataatttttatggaagaatttaactagttattttataaatttttctttttaaacacattattttttatttatagaacttaaacatgtgagaccttatttaaaaaattaattccaattttactcgaatcaataatcgaatcaataatatgtaatgaaaatgagagaagaagaaaattgaaatttaattggaaagcactttctgcccaatcaaacaaagaaaacaaatataattattcatattttcttttctttcattttcatactttccctaatgaaccatgcatcttatgtggaggattaaaaattaaatatgccaatttattaactgttttggagcaaaatctgaataaatattttataggcatcaaacacaaaatcatgatatatttataataaaagaacatatttaaccctgaaacatctaataaaccttttttttttcattttaatgtttcacaacgacaaaataaacaaatcttaagttcagtatgtcaagaattatattgttgttttctcattaaaattggagtttgattttggtaatcaccatcaacctttaatactatcttttattgtatgcctattaaaaaaaactatcttaaatatattgtatgatttatcgaggtaaagttctatttctaacagattttccatcataaaagaaccaggatcatatcacaaagggcagaaactgatgaagtctcctacacgatgcgtagtagtactggatgtacgtgttttccgccttaattcaagttgttaaggattcttcataacttgtcacttgtgctgtaatttgacattaaatattataatttgtaacataattgataacataattgatagataattttatctcttaaatatatgatcatgagtttgattcctgttacatgtacatacaacaaatatatgctgggataactcattcttttaaatgaatatcagcatcttaaaagaattgatttttagcttttgactgaaaaatatcttattcatctaatttcttatattaaatgtcacatataaatatatatatatatatatatatagagagagagagagagagagagagagagagaggttaaagttaaactccaccatacaaagttccaaattgtaagaaagtggattgacttcgttttgttttaaacttatatcttttggcatgccatgaaattttgagtgctgcgatgcctaacgcatttcctactaagacagaataccaaacattttgtgccaacctcccaccatgttcatcttcccacccttttcctttaaaatgttctaccattaatcaatgataattgaccacgaccaaattcttgctacttgttgcaatttacagtccataatttcggcggaatttcatgtcacatttactactctgggaccaaaagacctcaagaaaaaataaagaagaaattaaagtctcaagtttcttaggaaaacgataagcataatatggcccatggaacggggagacgaattttacaatggttcagttcaatcctgcaaaaattcaacaacttacaaccatttaaaaaaaatattatttatatctttgagtgaattttacccaaacgatagatctaatggaaggtgagagaagtacacacgcacggcagtttaggtgctgattgtatgaggcttaaagtttataattgtttgtgattgttcaaaacacgatctgtgcttgttttgcaatctcgatttttgtttttttcattcgaattagtcttagatttcagggtaatgtatagaaaggatgtcagtatatatttttcaaaaattaaaaggagttagtataggggtagaaaaaagtaattaaggaatgtttgtgtaatttcatgaaatctcaatgataattagtataatttactaaaatctgtgttacagcctttttctttaaaaaaaatgaagatagttcttcctattgtgctgaattgaatttattattcgggatgtttatgttgggtgtttcataagatattttgttttgcattctattggctgtgttaatacacacattgctggttgcactaattgttttgcttgaattttttacttggttaagagctagcggctggaaaatcagcagctgtaagagtcacaaatgtattttaatattttgaatctcacgatcttggatcaggctaattgtaaccgtgagatctgaattgatatgtaattggtaaataaacaagtttaagcttttcaaatttctcaaacaataaattaagaatagtatccatactgtttcatcaatgaaatctgaaacaccccaaacccatttttcatttaaagtatctacttattcaccattagctagagtctagagagcactgtccatgccatgattcttgatagaattaggatttttcctttggacaatgcttggccaaattcattcaagaatctccccttctccttttagttttaagaaatgcagcattagagagtatataatccataaagcattagagttatgtactagctcgttaggcttctttagcctaaaaggccgcatttatggggatatagtcattgaaacccattcctccctttcgtttgctattagtttaacactcataataagaaatgggctgcatgttcaaactcaatccacatctcacaagaataggcaattgctatatacactctccttgtttgcttattcaattttttggaaaacaaattgaaaaaagaaatgaataaacaaagaagggaagtggatatagcaactgcctaaaaatattgtaaccctcaactatttggtacatttggataaaataaataaataaaatgctacatggaattgatatgaaataagatcaaattcaattcaagtgatataccttcgtgatgaaaaaagatggattataaatttcatatagaatattcatttttttaataaattattaatgaaacgttattgccaaaatattaatatgtgagaaaaaaattgccaggtgtacaaatgttttaaataaaatacttcgtatatatttatgaaaacttcttgatataattacattctatctcactattttatcttttataatatttaaaatatttttaacattattattctgtattttttttacaaaaatatttataattaagttagctaaaggataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttttacgaagacaaaaggagaaatttaaagaatataggaactgtctttcaaaaatgatagagtcaccatcataccactaacaagatcaatagcgagtgttcatttatgaaataaagtataggtattaacctatacataatttataaatcatcattttaaagtgcatcacgtgatgtggatacgtaagtaattttaaatataatggaaaatgattacaatataattacatattttttagaattttattatgtttatataaacgtatgctcatttttaannnnnnnnnntattcgatgcaagtttatattaattttatatattgtattatttgtcttgtttataatacttagcattttatctacgcttctatagttgctaatgatactgtagatacacgtttaatattttctgtgggcacctaattggttgcaaacaaatatattactgacaatttttatttgttcaagaattctttaattttaaatttttaactgacttatgtgtagggtgaaggggatttttttttcgtttccaaaacctttatggaatatcacaaattatgatttatgataaacaacccatgttcttgagaattactgtgccatgtacggaaagacatgtattatgaatctgaaacaaatagacagatattagtacttcggacatatttgttcattttaaatatggacacgatattaaaaatcatattaatatgtcttttatttaattcaaaataatatatactaattaagaatatatcatgtatatgtgtttttcttacaaattattattattattattagcatttggattaatatacaaagtgagtcataccaagaaatttgtttaattagttgaacatgtatttaaattattgtccattcaattgttgcaccttaacacatttcgggaagaacataggtttgagtggcatttcaccttaaccacgactcattcgattcttcaacatcagttcgaccgttcggaccttcacttagtttcatccaaacttcaggtcataaatagatcatccaggttcgaatccatatacagtgacaattatcctatgaagactcactttcgctatggctccgatgatttctcttgaccaaaccactgcctatgagtcatcaactcattcttcgacgtcgataaaaaaaccctaaaaactattgcatctctggaaaattatgtctataaaactaagatacttcatgttggtgcaaattagtggcgatgactctacaacaataacgaaatatttaagaaaaaatcattgatgatgataatccttaagatttaatttattcctaccaatctctataaataaagattaattggatgcaataaggtttactcgcaattccctccaggattcaatatagttccttgatatgatttgcaaattcaaatcaagcatcacatcaatggtaatttacaaaataatagtttattttattctctttatgcataaaggaagaaagaaattgatttgaatgatatggatttgttctttatttatgagaaaattagtgatttttcatttatttcggactttatttattttccatttattccacaaggggccacgatggttttttatggaatcgcgggtctctttagtagtttttatttagggttgattattttttgggatattctcattgtttatctttgtgcacatttatggacaattttatgtttttgatgaagggatgtaaccttttgcagagattcatctcatgagtcgtatgttttaacttttagtgaaaaatcacatctaataacttttgataaaaagaaacatattttaatgaaataagacaattttttatgaaaggatacaacctttcatactcgtatcttttcatgagttgtcatatctttttatgaaaaaatatacatattcataaaagaatataactttacttgcatatacccttttgtaaatagacacatattttcattaaatgatacaaccttttattcatttcgaatatctctcacactttaaaacaatcatgtatatataaatatataggctcatgtgttgcccttaagaagaatacgcattttacagaatttaatctgtccaaaacatcttcccaattgtttgagtcagtcaccattgtggcgtaatcaactatggatgaagttgttatcgtgatacctctcctcccaaaaactgacccctcgtatcttctgtgttcttgaacatgtatcaagcacaagattacaagaaaacaattaagcatcatggaaagggagtaacaattggactaataaagttttctttatctcgtacaaaattctgcacaatatacccatctccaaattaaacgagcttgatgaaaaaagaaaacaatccaaagccgattcattctctcataataattttctatccattattgatgataagtaatatatagcttacaaaatacaacttgattcaaaggaagactagtagtatgaattaaaaataattaattttttttattaatcttgatgatttgtcctatatttattatatctaggaccggagcctggaggtagaattattttgtcatggtccctccaaagccttttctttttccttgttatataacttttttccttgttatataactgtttttaacctcatgtgataaaaatgctatttgaaggtataattttttaatcgtttaatttctaatacaatataactttatatataaaattagtaaatgccatataaactttatcaacaaaagcttaaatgtcgtttgcttagggaaattgttaattatactntcatgcatatgagctgaatcaattaaacccaatactaaataataaaaaaaacaactcaatttacttagatactacttcagtcttcagtaatgtgaagataagatcttaattattaaataaaaggctagagaaaaataattaaatacatacgaattgaaaagaagaacaagtcatcattattttggttgaccgttaaaagtcatttatctgttagtacaactttttatttgctttggagataaaaaaatttagcacgagattatggattgaaaactattttagtttttcataggttaaatattaattttagtcttttatattttagtatttttttttatattttggcttattaaattttaaaaatttttattttatcttttatattttttaattgttttatttttcttttctttaattttttgtaaacaatattagtttttcattaactttaaaattttaaaataatggtgattaaattttttcactatgtgttattaatacaatagtagtcctcagatccccacaacatagaatccccttaaccaattgtccagaaccagcctcaaatgagcttggtctactacatttttgaataactattaatttttttagtatttcataagatataatcataatttgttattattaaatatttaattttaagatttattagcatttaataatcaataaattaaatactaatatattaatacttatgtagtaataataattaaatatcaatacatataaatttttatatataatattaaaattaataataatttaagattaaagctaaaataagtttttgtaaagaaggaatttaactcggttggttaaatatggtatatgagttaaaatttcccatatttgtcttcaattcttgtggtaaaaaaagaaagaattttcggtctctataaattaggatgctttttaattttagtcatttaataaaagtagtccattaaagatttattttgttggttttagtctcttctatgaaataataaccttaattataacataatagtgacattgagaattcattgtatcatggagttacatataattttttttgtaaactttattttaaaatctttcatcaattagtcagacaccattaacatgatgatctaaagtcacaatttatcaaaaaagttaannnnnnnnnnattattattattgttacatatttattagtctattaatgtaattaacattttttgaagaaaatatttaatatttaatttagtaaatattaaattctaaaaaatcttaaattaaatattaaatactaacaaattattaattatatcctatgaaatactaaaaatgaaatattattaaatactaataattactaatttataatattaatattaaatactaatgcatataaattgataaatatatgcacatacttgaacacacatatgcatatctattaatttaacactaaaaggatataactgattgagaattatgcataagttggtataaaaaaattattcttacagatanttgttttattcatttaacaagttatacgtttaatatacatatattaacattacatttattaaattcaatcaatatattatatttaatgtatataaaaattaataatattattgaaatttatttattaatttaatacatataacatttaataatattattacaatttattatattatatttaatatatatgtaatatttaataataatgttaaatgtttttagagctgtaatcctctaccacctttctttctctcctttatattacaatattttcttttaatctagtattaaagttcatgtgtattgtcaaaggtaacggtttcatcgttttggacctatatgatgatgcagataagcatttacagggcatgtaagcaacttgtcgctctctcttcatgcgaatttaaatttcagtaagcacggttcaattgcataagaacaaaacaattgaagataggagagaaaattaaatagaaacaagtatcacctaattaaacataaaagaaagacaaaaagaaagagtaaagaatgtatgtaatttaacttactgaagttttgttctcttcgtcccattgtccttacaacttgaattttgcaacaatttttttttacttgttaactaattaaaatttctatttgtaagacaaaaggaaattcactgatatggcgaaaaggaatggtccatgcttccattgcggcattgattgtaagtcctcttcttgttcttagaatttttgttcttttcattgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatataactcaattagttcaaactcgttagttttgtttttggaatcaatgaaccaacctgatccatgatacataactaaatttattattattattattattaagttaagaaatacaaattaaagcatgcactaaagatgcctctaccttacacaattttatagagtcaaaatctcacacgaaagtagcaaatttcaataattacatccttatttataattaagatacctatatatacttagactaaagtctactattcacgttttaatttatatatataatataagttattttctaattgtaaagcattataaataaaattattttatttagttaaattagttaattaatgtactagtatcaaactgtgtgataatgtgatccgttttgcactccatatatgtgatgtaaaaatctagaaaaaaacaaaattctaaataattctcatttttataaaataaaaataataattttaaatatttagatccaattaatttaagctaaatcagttttttttatgattggattgatttggtttgaatttgataataaaattatagaaacctgaaccaattaatagtagaattttggtctgattggggaaagagtttagtccaacgtataaatagagttattacagctctcgaagaaagcctatgatctgccaatgctaaatctaacaatgcaatcatgttaattaaatgtatgatttaaaaccttatgatttcactttccttttttttactaaaccattccctatacagatcttccataattaacatgattgccattccagctagcggattagggcaaacccatgttccctcgtcaaatttgtctcccctccaccttaggcagtcgccaatagtgtgacttccttcatcttctgttgcgcacaactacttatcacatgaccatatagattgcaacatttgcaaattaattgagtgcaatccttaatattcaatattaaaccatctgttatgaaaccataaatatcccactattagatggctcaaatccatttccatactcaccatggcaaacttccctctaactgtgtcaatgatggctcaaatccatctgatatgtacacttacactgaccgacctagccaatgctaacaaaacactcatcatagtatttcttgcataaacaggaaaaacactatctagacttggttgttattgatcttcatcttggatgctatgaagtcggacatccatgaccaatgagatagtgatcgataaaaaaaaaaatcattcaaggatcattaccataacattttctctatcctcagctaaatcaaagttgaccataaaaaaaacatcaagcctaatgtcaactacatctacacccccaataaggtttccaaattgtcttcagatgatcacgttgtaagaaagttaatattcttccctaggtgtttgacaatcacaacatccttctatggcaaccatagttcctactactatcatcatcaatgtagaaatttggctccatggctatcaccatcttctagctcaactaaagagttttgcctaatcaaatctgtatgctcatgtcatgatagagaattttgtgatcctaatagcttctccaaaaaaaaaaataataatcttggaatgcatactcttacctctgccaggggcttcgaaggtgaaggaaaatatgttgtgaaccactattattcatgactaggggaaaaagtaacactctgcctctataatttttgaaaaataaaaataatgaaaaagataataaagttaaataacagtggatagttttcaagatgtaagtggagtgtgtcttgattgaagagaatagttatatggataaaaaagatatttaaaaagataattataggggtaaaaggaaaaaagaaatatgtactccaaaatattttcctttatatatctatagatatagattaagagagaattcctctcttattttgtataaaaatattaattttatatgttttattatatatccttcttttgtttataattcttttaaaatatatcctatgtgttttctaccttctatgtttgctagtgagtagtgtaaacacacgtttaatgaattttctgtaggcacccaaattaaaagaaacatataattgatttttttatctattatttaagaattattttgaatttttaattgatttatgggtagggtacgtgtgcagttcttggtttcccaaaatataactattcagataaatacgccatgttttacatcactaattacaaatcataacgtacatgtcatgttctagtctatatatgaataaatagacatatgtnnnnnnnnnnatggataaaaaagatatttaaaaagataattataggggtaaaaggaaaaaagaaatatgtactccaaaatattttcctttatatatctatagatatagattaagagagaattcctctcttattttgtataaaaatattaattttatatgttttattatatatccttcttttgtttataattcttttaaaatatatcctatgtgttttctaccttctatgtttgctagtgagtagtgtaaacacacgtttaatgaattttctgtaggcacccaaattaaaagaaacatataattgatttttttatctattatttaagaattattttgaatttttaattgatttatgggtagggtacgtgtgcagttcttggtttcccaaaatataactattcagataaatacgccatgttttacatcactaattacaaatcataacgtacatgtcatgttctagtctatatatgaataaatagacatatgtttttagaattattgcggcccaatgaaaaaaacatacgttattaacttgaaataaatagacatatattattgcaaacatgtttgttcatttaaatatatggacaattcaaaaccatattaacatgtattataattcaaaataattaggtaaccttaagaatcacgtacatgtgtttattttgtttcttttatgtgaatcaacatacaaagcgcaactaaaaatagttgtctctacagaaagttatttatgataaattaagacacttcaaaactatcatgtctctatagactataactataggcgcatgtagcccttaagaatgaacaaacaaaataactattcctattttatataaattattttgttcaaaacattttctcaaatgtttgagccagtcaccaacatatatatatggtttcatcagcttcgccacattggcgtagaggaccagaagacaagtcagtgttgtgcaacgcatgtggaataagatacaccaaatggggaagcattggccttcagaactattttcccaacaattttaaacctgagtaccttgataaccttaaaaatctagagggtagaaacaaggttctccatggttcaggctatgctacaaattcaagtaatgatactagtaaatatgtaagttaacttctttgaatattttgttgtgtgaatgcttcttatatataaattagtatttttgttaggtggaaaaaatccatgtatgtggaatccttatgttccatcaaggaaacgttcacacttagtacagatggagacatcaatccaaaggtttcatgaacaacttctcaagacgtggaaaaatgaagagaactcaaatgagtcattccaagaatcagaagaggtcttattaattgataacgtcaataacttcatacctagtaacgaaatagggcttggatgcattctccttaaaccagaagatgcttctgcatagaaggattcatttatgtatatccttcatgaatatgtatgagaatctttaagtttctctaaacatggcatattgcttttgaatattgaactttttgaattaaacttttttatgagcctttctcaagacttaaattctgtctctacactaggtgtttgtgtttcatgagatgattagaagtcatgtatgatctgataagtactatatatagatcaatatgaaatcggcatactttggaataatgattgtcttatgtcaactttgaactgaaggatgtgtgagttagggcctgtttgatcctattctcaatttctagttttaaaaactgttttataaacaattccacactattataagaaactggtttcgcatccaattaaaatccattaaattttaaaaactgtttctaaaacaagcgttttaaaaaccaaagacaaaaagattacaaatgttttccttttctgtattatatatttttgcaatgcaaatatatctgtatgacaaaaatattgcaattcaaaattaggaatttaagcgatcgaaaagagaagttgaaggatcctttgtagatgggaagcactggaaatttcttccagacaatgctgcactgcatacgggtctgtttctatttttttttatcattttttattttttatcatccaaagaaaaatatatatattaactagggtacaagggtacccaaccttattacagaaaaagtccaaccctgcaagcataacattacactttagaattgaaatatacattactatattaattacatatcatttgcaaaccattccatttctcccctcttttttgctaaaaattccaacgtcaactcaaaacatcaaccttcaattttgttttccatcttaccagccagtaaaagaagtatcattcaaaatatccaattgatcttagactttttcttaaccacttatcctcatacctgttccaagtcccaacaagagtaaactctcttacatgatcttttgatacctttccctagcatatactgtactacaacatgccaccaccaccagggctggagcttagttgtggttgaagccttgaatggggccatgccccaaattttttaagaaaacatattatacacacactaaaaatatttatatttttggccatgattaataagattttttataatctttgatagtattcattccttagttattaacgaatttaagtgttgaaaaatataaagaaggtgatttttaattattattactattaacaaggtgccaaagaaagttttgaagatccttgctgggatacaaagacagttcttgtggaatggagtggcagagacccaaaagattaactgggtaagttgggacagagtttgccttgcaaaagaagatggaggtctaggagttaaaactctggagatgtttaatgttagcttgctctcaaagtggaagtggagaaatctcaatgataaggagtttctgtggtatcctttattgtgttataaatacggcaaagcagatgttttttctttatctagaagaagctggccaaatgcatcacattaatggtggagggacattcagaatacaagttacaggtttgaaggtgtatatggatggttcgaggatctttttcagaggaaggttgggagtggtaaacaaaccgcgttttggagccacaaaggacttgataatctgtgtcttaaggatatgtaacctagattgtttcaagttaccacaaataaaggagcgactactggagatatgcttgctgataccaattccagaaacacatggaagcggacatggtttaaacatttgttttcgtgggaagaggagcttttggagtacccttgttgaactaacaaagaaatacatattaaaattttcctaatatcaaaaatgtgatagactccatctaaaacaagaaaattctctaaagatagctatagcttcacttgaccttctcctaacacatgtgccatactcccattcccatgctcacaataagttgcttgactctgtcagatgagaaatcagaggcagcaccaatgctaacaacattaggatgaggtttagggacgaaagacgtaggttggcaatggcgttgaaaatagttcttcatcaaatgattagctcgcccacaaacaaagcaaaaaatttcattccccatatttttattagtaggcttattgttgttattaaaagtatttttatttttagaaaaagaaagctttctatcaaacttatttttgttcaacccatgcttcttgaaggactcagagaaaggcttattagagctctcaacaagataggccttagaacgagaatcagattttgcaaataccttttggaaaaaatgatgtttattttgaacgcggagacaaacaggcaaatcatcaaatgtgaaactttcatctttatgtttcagatttcgagcaaaatcaatctaccaagaagacaattttgaaattatgaaagtcacaagcataatgtcatcaagaaaaacaattcctttcaatttcatgtcataaacaatgttttcaaattcatggatttgatatgaaatagattttccatcaacccctattgaacccttagaagccaacctgcaggaaaaaaaacataacaaaccaaaattacttgtaaagttactaaaagtaaaaagcaaaatcctaaaagataggaattctagttttatgtaacagattctaaaaaaaattatttttataaaaacaaaattgatataagtaatatatttttataaattataaattataaaataaatatttactaaaacttctgtcatcttcaggtagaaaacatatcacatctatttctgtcttgtttgataacttcaagaatatggtgtgaagtgtttaaatggatggggatcgaaaatgtttcccctcaggaggtttcccagtcacactctcagtttgggttttgcatgagagggaggaaaagccgtagatgtaaacattttatatggcacattacttgctggtgtgcatatggaaccatagaaatagtatagcttttaagggtaaagactgtgatctagggggtattttggctgccataaagcacatctcatggcaatggctaatgtacaaaggcggcaacaaaccaggaacttttttctcttcctagtgtttggagccattgcagtgcttcaaatgttgttgatgttcagagaagttaactatggcatttttgggacagaaagttaactttaggagaaatgattttttgatgtatgtaatacctgtacctcttgtacagattgggattggggtgtgtatttgcatccttatcatatcaatgctataccttttgcctttaaagaaaataattttatgttaatattacattttaagtttttatatttcttataatattagttcatatggagatgatttggattaatttagtctttccaaaacaatgattattttttacttcgagacacaaatatgaaattattttttactaatgtaaaatttgtttcactaaattcacttgtataaaaattatggaactaaattgatgtttgaactaaaaagaactataaaatgatataaatcaggtgaaaagcgagtctcataaaacacagtaaaaaatgatattaattttttttttttgattattcatttgactatttttcatgagattattactatgtttatgatctttttttgttcaaacatgcactagttggattttatagttttcatgtaagcaaatctaatgagacaagttttatgttttgaattaatcactatttcaaaaattatgtcttaaaatcgaagccatcattatttaagaaagaccaaattgatccaaatttaaaagataaaagatcaaaataaattatttaaaaatgaatcttaaaataagataaaggatcaaaagtataatttagtagtacatttttatatagatcaacaaaaattaataattaagtaaataaaagagtgtaacaactttataaaattaaccgattttttttttttagaaatgatgaagcataacaacaacgttctaaaaatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaaataacttttattttaaaacttattttttcttcttacataatacttattatgggggcaaagagagttcacatatacaagagtacaattcattaaactcactatgtttttagtattaaatggactttctaattcaacaaacaaccaaacaatctaataatttttttacagttttaatcctgtagagtcaaccccacctttaattgttcttctcctttatattaatttttttaatggcttattaaagttcatgtgcgttgcataacgactgcatatttttgtccctatatgatgatatagatggacattcacagagcatggagctacttgccatcctttccatgatgaaatggtaaaaaaacccaaggtagccttgtcaaacatatgaatttgaataacttataatgtaagcacggctcaattgcataaaaaaaaaaaaaacttgaagagaagagagtagaaaaaataaatggaatcttatgcttttatgttattaattaaagttgactgaagatttgttctgtttcttccggtagtcctacaacttgaattttgtaacataattttgtagtttgttctttaagttgatttcttttcaaggcttttgtggtgttgcttttctgataactataatttctatttgtcagataaaaggaaacattacagatatggggagaaagcatggtccatgcttccattgcaaaattcattgtaagtcctcttgtggttaattagaacttttgttttccgttagattgaacatggtgactgtatatggtattcaaaaaagatgaatattttatcttacaaattcaagacattcaaaatcagtcaaatgattcaattaaattggtcaaaaagtattggcatcaagaagttaatattattgaccttttaaaaattattttagtgttctaacttatacaattatataatctaattagttaaatatttatgatgtataagcccttaatcttttttctccttgtctaagcttatgcttggacaagcattcaattgcaccaaagttcaaactcacctttgattttttcaagtgtaatttcatgaaaatattgaagtttggttatttttaaccaacattacaaaactaagcatgttaaactagaaaaagaaaagaaaattctacattagtatgatattttatgctaaattttattattttttctttaaaataaaagtttttaaatataaattatttacttctaaatcaaattaacctttcatgaaattaaattttttaaatacttgaaagaaaacttaatttattcttgatagtaatcttatttaattcaagcatgactatctttatttatattttcattttttgtgtttaccgtaattttataaaaaggttaccttatttttaatatttttcttgttttcaaatatttgtatagccaacactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaatttaatgagcttttaagtttggaccattaatgcatatattaaattctaattgcattaaaaaaaagggggtgtgtcatttatgatgagatgatatgactttttaaaaaaataaaaattgaagaaaacataaatttaaaagcaattataattggtttgaaatcttgggtataaagaccaagtaattattgtttcactgaagaccaagttaggatagtaattgatgtttttcattaaataataccgaatttgtctaatattacctttaaatcattttcatcgaaatttttatttaaatagtaattcaggtgttagcctacctaatgaataatgatatgaagaaattgtaatctatgtattttgattctatcaaatctcaagtaggctaatacctttttagctagctagaagtactataattaattgtatactgggccaggaggactaattattctatgaaaaataatattcatgtacatccgccttttcttgtgctgcacacattttcaataaaattcttttagcctttcaatacacacacacaaagcaaaccctagaaattgtttctacaaaaagttatgtatctaaaactaagacacttcaaaactatcatgtctctatgaatataggcacagataacccttaagaacaagcaagcaaaaccattcttattttatgcaaattattttgtccaaaatatctacttccaaattattcgagtagtgaccaacatatatatggctccatgatcaggtactccactttggcgtaatggacctgaagacaagccagtattgtgcaatgcatgtgggtcaagatacaggaaatgtggaagtcttgagaactatcttcccaaccattttcaaccagagtaccctgataaccttaaaaagctgaagcgtagaaaaactctgaagggtagaaaacatttaaagggtagaaaaaatctccttgtttcaagctatgttacaggtcatgataatagtaaataagttatctttttctttgaaaaacattgttgtgtgacttcatttattatatttctgacaattagtaatttttgctaggtggaaaaagtcgacgtttatggagccctaagattcctacaagaaaacgttcaccattggtacgcaaaaagataacaccaatgaagaggttttatatgcaacttcaaaatatgtgggaagattacgggaactcgaatgagtcctcctcagaagaggtcttaattttcaataacgtcaatagcttcatacctagtaatgaaataggccttggatgtattcctcttaaactagatgatgcttctgcatagaagggttcattttatgtatcctttatgaatatgttaaaaatgtgcttgagaatctgcatatggttttctaaatgtggtatgtcatttttgaatattgaaatttttgaacttaaaccttaatttgtatgagacttgaagaagctttaaattatgtcttccatgggatgatttgaaaattgttgctgcaaattgcctctcctttggctgcaacacattctttgctactgacttatgattatatataggcttatggtgttacagcgcaatccatatggttgtagacttacggggttacagacttattatggctacagactatgttatagacttatggtgttacagatttataacatcttatccatataatagcaaaataaaaagtggtcaaatacctcctcgtgcataaaatttagtaatacacttgtaaatattaaagcactggtagctaatcaatatctcatacaaatgaaattaaggataaaggttgatagctagagcatgatcattacatgaatttgatcattaattgcttgaaagtataaattaaatctttacatgactattaaattggcatgaaatatgttataacacataaaagggaggcaaacaaaaatggaattagatttactcttaaacatgaaaatttagacccttcacaacatttccttaatgcaaaaagtaaattaattttaacatttttgtgcattaatatgatgaagattcctaacttgtatagagaatgttcagaatgaatgaacctccaaccaaaatgctaagttttcatagttttttttctccttaaggccaaagataatattatattccaaaaaattacaaatatgtttggcaaaacgggcctggcccgccaggccagcccgcttagccagtaaaaaaatgcgggctgggttgataatatcaactcgctaataaaaaatgggacgagccagtccgacccgcaaattatgggccaaacgcggggcggggcggactagcccgctgggccaacattatttaaaatattaaatattaaaattaaatagatatatttaacatattttgaaataggtaattcttttaatttatactcttttgcactttcataattaacttataagttttaatatttaaatatttatgataatgatactttcaaatagtctttcattactaatatattacactttgtacagtttacatccataaattctatttgcaaatggtgtaattttgtgaattatcacataacattatttatttatgattaattttaaattatttactttttatttaactgtgtttttttaattatcatatttttattttaatataatttttctgtatttttttaaattaacttatttatttttttaaaattttttaagctggctggcccgcattaaagcgaggcgggctagcatttccagcccactttgcaaaagcgggctaggccagcccgccccatttttttgcgggccgatccgtttgtcatccctaagtacaaagatagaaatcacatttaaaacataacaagctcccgaagagcaccatattcaatgaagcaaatcaatatccaatgacccaaaagcaataaaagttacagcaacactatatcaactagccaaggacaatgaggaaggacagtaccaatgtgccacgttctaaataaaaaattttcacaatgtcacgtcaacaataaatattactagactacaacgtgggctatttcgtcccacaggccagcgaaatatgtgtgctaacgtggtgtcattttgttggtcatgtatttcgctacatgaaccagcgaaataggggatcaaagtgttagtgaccgggcagacaagggcaggacacgtggcagcgcaaggtatttcgctgggggccaagcaaaatatgtagcaatgggaaaaaaaagtcattgggaacatgtgtcatgtaactaattaaaaatagcattaaattaactaattaaagaattaaaaaactagaaaaacaagtaaatttttggatgattgaatcctaaatcctaattttgacctacttagagacattttttggaaaaaatagttgaccaaatccccttcggcaatttgcttaggatttcttatgttaatttcgagcgttttgacatatcgaacgcctcaatcaaacatttttatcaaaagttataaccatttaaagtttatataatcaatatcaccaccaattcctatagtgaaatcatacatcagtgacacgtgtcccaacatatttcgcttgactccctagcgaaatactttatgtctgtcacctgtcctgcccgttattgaccatgtatttcgttggctcatgtagcaaaatacgtggccaacagaatgatgccacattagcacacatatttcgctggattgtgggccgaaatagcccgcgtgacagtctggtaatgtaacaccccgtgtatacccggtgtattatcattgtataatcatcagattagcgcttaaactcagttaattaaaacctttttaaaacaagtttattttgcggaagcataaaaccgaaaaccatattttctcgatagcaatatgtatggaaacgcaacccacatcaagcatcaacacatgcccctgcttaaccagatcatacactcaaaacataggcagataacacagatatctcgaagatataaacatacaggaggaaaccacatcatatatatatataaccgagttatatatatacaacaactggcacccgaggtgcatatacaagatgataagcgtccgagcgctttctgatcccgaggacccttcctcacatgagggcatacaaatatacaggagtatacaagacaactacatgcgcaacgcatgtcttccctcacaggggtatacaacataaacaaaacaacatgctgagccgagctccaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctcccgggtgaatactgaactggcccttgtgagcctcagctaggacgatgtccaccaactcacccttaggcaccacaatccgatcctgatacatcaccaggtcgtaatcctcccaggaaacatcctgttggccaatcatagctctcacatccttatcttgcttctgtgcctctcggatcctccgaatcagatcattggacaccttggtcctgctcaactcaagaccatgggcacctacagccacattcaggtgcatgtctctgaattgctcaaccaacttgcaatcagagatcatcatgcaggctgcactcacatgctttctactcaaagcatcagcaaccacatttgccttgcccggatggtatctcaactcaaaatcatagtctttgagaaactccatccatcgtctctgtctcatattcagctctttctggtcaaagaggtacttgagactcttgtggtcactgaacaccaccagcttagcaccatacagatagtgcctccaaatctttagagcaaacaccacggctgcaagctctaaatcatgagtaggataagattcctcatgaggcttcagttgcctggaagcataggcaacagccttcttatcctgcatcagcacacatccaagtccccgcttggacgcatcacaatacacctcaaagcttccttcagggtcaggaagggtcaacaccggagctgtggtcaacctttccttcaactcctgaaagcactgctcgcactcatgggtccaaacaaacggaacccccttccgggtgagtcgagtcaaaggtatcactatctgggagaacccctgaataaacctccggtagtatccggccaagccaaggaaactccgaacctcagatacatccttaggtctctcccaagacatcaccgcctctattttgctaggatcaactgataccccagctgctgagatcacatggccaaggaacttcacctcggataaccagaattcacacttggtcaacttggcatacaactgatcattcctcaaggtttgaagaacaatcttaagatgctcagcatgctccctttccgtctgggagtagatcagaatatcgtcaataaacaccaccacaaactgatccaagaaaggcctgaacaccctgttcatacaatccatgaacactgcaggggcattcgtcagaccaaagggaataacctgatactcaaagtgaccatacctagaccggaaggctgtctttggtatgtcagcaggctttatccgaatctggtgatatccggacctcaggtcaatcttagaaaacaccgtagctcccctcaactggtctagcagatcatctatacgaggcaaaggatacttattcttgatagtaaccttattcaactgtctgtaatccacacagagcctcatgctgccatccttcttcttcacgaagatcaccggtgctccccacggcgagacactcggtctgatgaactgcttagacagcaagtcctccaactgcaccttaagctccctcaactccagaggagccatgcgataaggcgctacagatatcggtcccacaccaggaaccagatcaatggagaactcgatctccctctcaggtggtagctgagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccgcgccaactgggaaattcagggtggttctggcgccaccggcgccgacctggcgcccagagcgccaaccaccagaggccatggcacttggagcgccgttcccgcgcccacagcgccaacaagcagagaccctggcgccaagggcgccaacctggcgccgtcagcgccacaccttttggccacggcgccatccgcgccacacctggcgctggccgcgccagattatgcagaagcaattctgcagagtgttttctgcataatccaaaccaaaaggcctcagactcgcgccacacgcgtcctaattcgcgccaaacgcgctgggactaagggatattacaggtaatatttactgttggcatgacattgtggaaattttttatttggaatgtggcacattggtcattgttcccaatgaggatgacaagttacagtaaaagttttcatagttcttgaacttagcttttttagagcatcttcaatgggagcatttaaaatggatttctttatcacctttttgtgtttctcgcattactttttgtggtctctatgtcactcatgaggaactcaaacaaaattttgcttcaatacaagaaaatcacaagaaatcgcaagaaactccaaaaaatccacacatttatatttttttattaaaacttaacatttttttagtttttataaatacaaataaaaagtatgaataattgaagaaaaatgaaatataaattaaaaataatcaaagaaaaagtataatttatctcttgctaatgactctttatgcacttggaaatgtttttatttgcaatttcgagtttataaaaacatatgatagctgagttttacaccaccacagcgaaaatgaaatatatattttattacttccatttcaaccttctacattcttccattgactctctatgcattttttttaaataaacaaccttctaaattcttccataccacatgcatttttccattttcctttcctctttcttttctttctctcttatgtcactacaagaaaagcgatgttttccgatgcaccctttcctacccactaacttccgtcggaatattaacatttttccatgtatatttattacattagaaattggatttttcccaaaacaaaaaatagctgaaccctagccttgactatctcttcaatcccttaccactctcctactcttaccttcgttttaagcgtctcttcccatccctaagccaaggatggcatcggccatggctacaccggtgacaccgcgagatccattccggtcatcgtgcgtgaagggcagccgcaggtttccctctaatatgggtccttttaaaacataggtaggcagaagagcttccattgcagatttcgtttcatttgtgaaaagacgaacctaaaagagagagaatcagagcaagaagaaaaagatgatctatcggaagtggagtctcctcaccggcccggtcaccatcctcgacggcgtagtcatcgccatcgccgccgcaaatgttatcttcgtcaagaatgtaagctcctttcttccactctccaaatcccatcactccctttctgcactcaatccaaccccttggttttctccaaagttgcgattttgattgatttttctggatttgggtgccgatttatgatctgggtcttcagtaatttattgaaattcttgctactttttttttgcgatttgcttctgtaatgtcgctagtctctgatgtgtttatctctcgttagctaattgtgttcatttgattcatttttacgccgaggacgatggcggtactcacgcacacaccgaggaccacccagaattcggggtgaatgatgatgtgttccaagtgttcgacgaaatgtgagtatggctttctgaacttgttgtttttcataatgaatgttatgctatagttataatctttttttagctgttctcggattctcatgaagttatttcctcctttaggttgatccaaaagtatcaaataagtcacgttttgcacaagagcttatctcaactattttgatcactgtagctgtggggttggtctggtatgagtccctagtttccctttctccctctcttttccatgtagaaacatccactctctgatttttatatacttgtattgctactacacatcctttcaggtttattggtgctgctgcacttcaaaaatacattggaagcttgggtgggattggaccttcaggagttggatcaagttcttcctatgccccaaagatgctaaataaggaagtgatgcctgaaaaggttaacttgttaatctgttcttagttctcacttctcagatatctatttctgtatctcttgaatgtttctgtgattgaatagcttcaatttggataagctagaattttgatggatagtgaatatttgaatgagaagattctaggtggaataggctaatgaacaatggcatgatatatactatacctccataatcatttcctttctttatcttaataaaataatcctagctaattatgcctttacttgcaattttgtggaccagttgacgaaaaagttggaaagtcttaccaccccgtaatttctgaaagacatctgacattataatttcaagtttccttatttgttgtattagccttgtgtgtagaatatacagtaaaccaaaagttattctatgccttatgtgttctcttttcttaatctttctctatcacactttctttccttgcagaatgtaaaaacctttaaggatgtgaaaggtgtgatgatgcaaagcaagaacttgaggaagttgtggagtacctaaaaaatccatctaagtttacacgccttggaggaaagttgccaaaggtttgaagaggttaatttgtcattttttttcttttttttttcctgatagctttttttgtcaatttgcttgtcttataataaggtatcatacttttttgtgtgtattggttatgttttgttcatcaagtgtggctaaagtgttcctcttttcaggggattcttttgacaggagcacctggaactggaaaaactctactagccaaggtcagttagtttctgtcttgtcagacacatttttacagtgtttacgaagttattgtattatacaatttagaacctattggtcttcttccatatgctttttaggattcgttatcatttttagtatgccacactacactgttatatgctatattctattaggaagttcaaggaaggacataaatggactttggttcttgtctctcactttgatatttccttacactttgcataagtgttttgatctgtgactgtaactaaaatcctacattattgacatcaaccttttgagttaacctattgaaaattatcattgtaatgatctaatagtgtttgctttatctgggaccttgaaggctattgctggagaagctggtgtcccatttttctatcgagcaggctctgaatttgaggagatgtaagtcttctttcactttttatgttttcaatatcttaaatttttagcattgaacgcatttatatacagtctcttgagatcagaaacaagatattgcacagtcacagctgtaatgtaatgtgggtaaattataattcattagttgttttgaaaataataacatacaaagaatgcttttatattgcaaccttgataatgaaaatacagtagttgtcaattgtaatacagaatatgtttatgcttttctgttattgattactaaatgtattttattatcgttattctaatgggaacatactcttaccaactttagggctcaatctgtaacgcccggccacttgcaggatcaacgactatccctacataccaacacaagacttttcagtgtgctttgtcctcactcacacacttcctgagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaggtgagagtagctgaaatgaggagatatttatgacattgattgaggaaaaaagatggcagaaaattggttaaaggtagtttggacatgtacaaagaagtcacgtgattgctaaatgataatcactgactaagataaagacaaaactgaatttagcgcttccatcttaccaatataagaaatttgtaactgtaacagcatggggaggttaccaactgcaacaaattacaaagaagaaagaaacatgaggcagcatccctgttttccattcttctatacatcattccagtccagccctaattgggacttaggagatgatcaaaacaatgaatttgctgctagttcaaggttgtcaccagcattttggtgccaagcattagaccattagtggacaccttgttttggtggtccaatccaatgtatgacccactctagtttagaaatggccaaagacaaccagataatcttgagctaaacctgacacactcacgtttttagcaggtcaactactttactaggtttgaccaaccatcatattctatgctagtatataatatatatatatatatatatatatatatatatatatatgctgggcacaatttgttgggtgagtattcagtataggtgcaaagttggggtcagtttatgaatgtcacaaccttgcctataggtatcttaatctcattcgaatttcatgatatattgttagactttacatattggtgacatttattttgttgttgctactggtccacagttaatcttgtgatgactgatgtgttgcaaacacatcttgtttttagtctagttttaggttagaatttgattaaatacttaggtaaatagcttagaattagttgagtttaatattttattatttaaatctaatttcaataccaattgtgcaatttcaggtcaaaagaggagaataaaagaagcaagatctggaacatcacgcgtgtcgcgccactacccacgcgagacacttggaagaccagaggaaatcacgcgagaagcaccgttagtcaagtgagtcgcgtgggaacttcaagatctaagcttttcaactctgtcccttcacgcgatacacttggtaattcacgcgagtcgcgtgaagactcaaagaaataaggaattctcttctgcacatccacgcgaggcacttcacaacccacgcgacacgcgtcattcctttctgccagtccacgcgactcgcgtggtatcgcgcgcgggtcgcgtgaggttgatgctgtttccttatttaaattatatattttcagatttgatattatattaggattagttgccttaattaagtgattctataaatatatttagattccttaattaagaagatttgatttagatttggaacagaaaataggctttgttaccttaattagatctatctataaataaaggcctctggggggagttctagacatctcatatccattatctcttaccacagacactgatacctctctactcttcctttcttttctctaaacctttggaggtcaagaatcaaggcaaggtcaccaagaatgtattatttgacagcctttggtttcttgaagcttatggcaagctgaacttgtattgtgggaaggccatgaactgatgtaactcctctgtaacttgaattggtattgattctaatgctgttttgattattttattctattctgtgctatttaatgttttactcttaattggaattggccattctatttaagtattgagggttaggattcgcaatggacacgttgggattttaatttctgacctgtttagaataatagtcgtttttcgcctagacatagggatgcgtggctacggactttataatatgttctttgtatgcttaatttgatagatttcaccaagacattgggttttcgattcaggttaaagggttaattcactaaggaattagggattaactaacttaggaaagacttattctccgaataatcttaacaagatcacatgagatatattctttgaatacttagtttgacagattcactaagggtttaggtttctcgatcgaattaaagggttaaatcgttggttatgctcttaagagtctaggatttacgaatttaggaaagatttatcaagtgtgtgacctaagataataaaccaatcaagtgaaggaggtagaaacaaaagggattgcgcctgaccacaattgtttcttccattggtaatttcttttattttattgcatttatttaatttctgtttttattcaaacatcaatttatccaacaattacttctttgttctttattatttctgtttttattttccaatcatatataattaattttattgtaaaaattaccccaatccctgtggagacgataactctacttacctacttttattacttgttaacgatcggtgcacttgccgtattcacacaaatcgcacaacaatgactgttgtatttcttgtgctagtgcagctacagctcaagcctttaatggaccaactcagtcgggtaaaagacttgtctgtccctaaatttggcagtcttcaagcatgggaagctagagctagtgctgctgtccgtgcagctaatggagatatcaatgctggtgattctaaaatttcgcagccaggatataatggagttccttatagtagagacactaaggtaacattatcctgtttaagggtgttattatttctggcatgtgcatagatttgacaaccatggtactttttttctccccaattttattagtttaatccctccttgttgtgaatgtattattctcttcaaatagtgctgatatctcaactttgaaaaaagatggagctgattgtttttatttatcactttggatgaatttgaatctctgggttnnnnnnnnnnggaagaaagtgaaaagaaagaaaaataaaatatgagatgatctttagattatttggtacgagaaaaatgaaaagtaagaaagatgattttttgtttagttttataaaagtaagaaaaagaaaaaaaaagtgagaaaatctttagattgtttagtatgagagaaaataaaagaaaaataatttataactaaaatatgtcaaacaaaatttaataaaagaataatttttttaaaataattaaaaataaattatatgataataaatgaaaaaattgtaaaataaaataaaatcaaactaaatctttgaagattgattcagatttaatattatatttaaattgaatcaaatcatatcatcaacatccttagctatgcatccatccaacatcttcctttaaatatagttatattttgtgagtcatatagcactactaatcaatatcatcagtaatggatataaaattattatgagagaatgaatcaacttcggatnnnnnnnnnnttatttatcactttggatgaatttgaatctctgggttgcatctcatagcatgcacctttttttttggggggggggtgtttaaaataagaaatattgttagaaggaagaaagaatgaaagaggatagtaccttacttaacaaggagtcaaggactctgcaagaagaaacaaagagaaatcagataaacatgttagtaagataacaaataaagcattttggtgtctttacatatctgtcagctacctctcttaaaaaccatttgccaagcacctaagagaggcctgaaaaatatagttgaagataaaaataagattgatttctagtgaatgttcttgaatggtcaatacacagttacacacactcagttaaatagtatatatatatatatatatatatatatatatatatatagtgtgtgtgtgtgtaagcattgtgtagcatatgtggtgagtggttttaataatattaaggttttctttttttattcgcaacttttcaaggattatgcaaaaaaagtttgttgaatttgttattctaagacggttctgcaaaacaccgccttagaatgatctattttatttttttaaaaataacattctaagacggttactttaaaaaccgtcttagaaggtatcgactttccaggacaccattatcaaagacggctttaataaccgacgtagaaagcgcttctcatagagtattttcgacagaaaagtccgtcggaaatttcccacgagctattaccgatggaaataaaatccgtcgcctaacatttcctacgcccctttttccgacggatttttatccgtcggaaattccgtcgctaaatcggttttcccacggattttggttgttaccgacggattttttccgtctgaaatttcattttttttttgtagtgtgtgctttccactcacgcgccttcttccttacgcgacggcttacttgggcggcaacttcctctgtgcacgacctcttccttcgtgtcgcctccacctcgcgcggcgcaccaacctcttcctccatgtgcactgcctcttttgatgtagaccactgtcgcaacctcttccttcatgcgctcgacctcaggtttgttatttttcctctgttttttttacaggtagttgatatcgataatattattttattcataagtttcagttccttatataaggaccgcgtttcattcttgatgatacgattctgtcacgcaagccaactccaacgcaaaaaaaaattcaaggaacgattccttcaagtgaaggaacttggaagcactctagttgaagatgctcttagttatttgcaaaaggttcaattatatttgcactccctcccctaccttccaaaaagaggtgcggcatggtgtcaaatgatcattattcttgtcttttctttccccttatgctttggttagttttatggaagaaagtgaaaagaaagaaaaataaaatatgagatgatctttagattatttggtacgagaaaaatgaaaagtaagaaagatgattttttgtttagttttataaaagtaagaaaaagaaaaaaaaagtgagaaaatctttagattgtttagtatgagagaaaataaaagaaaaataatttataactaaaatatgtcaaacaaaatttaataaaagaataatttttttaaaataattaaaaataaattatatgataataaatgaaaaaattgtaaaataaaataaaatcaaactaaatctttgaagattgattcagatttaatattatatttaaattgaatcaaatcatatcatcaacatccttagctatgcatccatccaacatcttcctttaaatatagttatattttgtgagtcatatagcactactaatcaatatcatcagtaatggatataaaattattatgagagaatgaatcaacttcggatggttattatcgtttctttttccattaagctcgtttggagatggggtattgaatagtttattatcaattatagttactccctttccatgagaaagcctaattgtttttttttttaatgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacattacattattatcactctatatctcaatgttcataaacattacactaacactctttatatattatattaacatcccttacaaaaaagattcttgtaatagttaaaaaaaaaacaaaaaaatgtttatataatttcacaaacctcatagataatcaaccgtttgaatccccgatccattgaaagaggtactaacatttaatgtcttcataacatttcaaatactttatatacacctttttaaaacttaattcctgtcctgccccttagctaagtactgagcttgtgaagaaaatgccatcataaggttcgtaagtaatagctagaagtatctcatagattataagttaaacctctagtgcagctctatatcagcaatcactaaataatcaacgcatattagctcatgtctagcaagtaaaagaaaaaaagaattacattcaagaacatcaggacttcatcgtaataaatctagaagtgatgacggagagtttttagttatatcaaccgataatgtggagtcaaatctctaacaatccattttcatgttgaggagtagacattatttatttatttattccagaggatcagatattttaagtatgcagtttttttttttaaatgtaagtaagcaatttgtaagattggatatttacaaatagtctgataataataaaatctaatcatgggtgattcaatagatccaaggccggtcttgatattttatgagcatgggatgaaataataaaataagatcttatatataagtattttaaaatataaacataaatcatactaaaaagcagggcatataatttaattaaaaattatgtattttattaattaagtgaataacaacattttaacaaatttaaatatgatgaattacattaatcattcaatttactccttgctatctctagtcattggcaaaaatatcattgtctcatattaaacttacatgcactttttatgttaatttattaatttacttattttaaattttaactagtattttagtttgtgtgttacatcagataaataattatttttatataattattattatgattataattcataataaatatatttgttaaaatataaattaaatggtagattcataataaatactttaaattgtggcataattttatttttaaattggaacgagtagatgattaagaaacttaatataatttaaaaaaaaaagcataaatagagagtaaattgagattattaattgagatgttttttgtccaattatagagaatgtgtgggaaatgaacttgcatggaggaaagaaagtgctacaaatttctagttgagatagtaaggctaggagagttaaagttttattatccaaatttgggattttaatttatagtataaaaatagactcttttataatttgagttatagtttgtgttttttttcccttttgataaatcaaacacttcatttcaatatattattatatctccattacatttgaattgttgacatgttacactaagataaaaattcatttaacatatataaacttatagacataacattgaaaaaaactaacaactaaaatattaatactttataatcacatgctatactttaattcagatatgaaaaaataggtgataaaaaatatttttaatttgtttataaaactaatacaaaataacattaaaaaatcacaatataactatatgtattttttaatttattttttggaatccttcttttctgtgcgttcttggggatcttacccatttatcactcctacctaggatccgtctttaataggtccaacaataattattataataaattttaatatggtctttgaatttaaattatgacttagataagttctaaaagttaattcttataataaaaaatctcttttacttatatatattattttaatcccataatacattatgtgaaatttcaacactaaattatagtctttataagagaaagttgtaatttttagtctatgtatatgtacgtaacggttaatttttagatcttggtgatgagttctttattcatttcctttaaaaaaattattacaaaagttaatgactggtgttaaaaaaaattacacagataatcgaagatattgttttctcgtacagatattaaaactttaaaataaaaaagttacaggaatgaggaatcaaataaaataactagtataacgaatattacttatatagggactagtttgcaattttaataaaatagtgactccatttggttattacacaagggtaaagcatatttggtcacggtgtgtaagaaggggacccgcacagaataagtgtgcgtttggatagcttgaacaatcataaaatgaatcaattttagttttaagcaaattttatatatttaaattatttttataattatcataaaattaattatgatgtataaaaattatgataaaattgaaataaataaaagtaatttttacttcaatcaaaatcaattttatgataattaatcatgagagagtccaagtccaagagaaggtgtcttttattgattggtagtagaagtaattttgtttaagtgcttaagtcaatagtgagagagagagagacgcagcataagcatatagcaagaagaagagtagtaatagttgaaaaggaagaaagatgagcgacgaggaaaggaagaagcaaatagcggagctgagcaaaagcctgaaagaaggagagaggatcgtgggcccaacgagacggcccgacggaaccctccgcaagcccattcgaatccgcgccggctacacccctcaagacgaagtcgccatttaccaacccaaaggagcactcgtccgttccctaatttcttcttcttattcttattattccatttctctttctctcactcttgttctctgcagttgaaaaaggagatgggctcggctgggcctcccgggtacgaccccgacgccgattccaagcccaagaccaagtccgtcaagaggaacgagagaaagaaggaaaagcgcattcaggtatgtatgctaatgccgatgctgatatatataaaattagtgttctactttactttgtttaattgataaattttgatcaatgcgaattatataatgtgttatttcaggctgcgcttgaaaaggaaaagaatgtgagtgaagtcgaagagagtgggaagcaggaatctgtggaggcattgacctcgcaagtaaatgagctcgctgtgcaagattcccaagctcaagatattgataaaagaattcgagctctcaaaaagaaggtgcaccgtttatgctttgatgattcatacccttttctgttgacgccccactctttaacaatattatgcctttcgtgagagatattaatttcatgtgtttacattggaaaattatctccccgatcagactcacacacagacctaagaattctacaaatgtagttatttgccaatcataccacgtcatgtatgttagttggatcttttattcatatttcttaagatttcagttttttttttttttttcccatgtctcttgcatatttgagcagcattgtgttaggatccaattgcaaggtatgagacttggaatcccacattggaagtatgggattttagtgtggggtttgtaaggccttgggctctccaactacaatagttaacttttgtggtgtggttctctcaaggttcttatcaattggtatcagagccttccaccatgacttccagttgcaaacaagcggcgcggatggtgacaccgacattgcaatgttcgctcaggactaatgaaagggctagtgcacagccagcccgcgtgggcgccagagctacggagcgtggtgggatgttagggtccaattgcaaggtatgggacttggagtcccacattggaagtatgggattctagtgtggggtttataaggccttgggctctccaactacaatagctagcttttgtggtgtggttctctcaaggttcttatcacattgacacactcaatttctctttatctctcaggcaattcctttttcttaaatggtgtaagatgaacaaagatttccatttggcaaaaatgtcctaaaaatgtagcaagcatccctgccctttagttccttggtgattcagtgtgctgtgacttatcctgctaatgtgtccctcaattatttattgcgaagaaaatgaaggttcttaacatgtttcttgttgcaacatgaaatagtagagttaagaattttactaaaacaaatatttaaatttatgattgatgtgatatatgcttgtcatagtgggaattggatcctctagaattctgatataagcgcagggtcaggcaatttcatctttggcagtttaaaattgtataaatttgtattttgcctttattgcttaatgtatagaaacaaaattggaagagaatggtacagtggaaactgttatgtgtgtctgttgtcctgtattttgtctccatgtcatatctagtgtttgggttgtgcttcataggttatggtgctgctgtctatctagtattgtttatgtatgagccatgaggagtattagacttaatttcatgggtataggttggcatggtttgcccatattttcaagggtgtctgattaccttatgtgataggatttgttttgtgtctgctattcacttctgtctcgagggaatttataaccaatatgctgctagattggagagctaccttgctctctctctctatctcttttatttattgaataaaagatgagttttgctgcattttgtagcctctgcagctttctgtttacattttccttttttatatgatcccttatctctcctttctttctattaatgttcttaatatccgttaaaaaatgaaggaaagaagatattcaagtaatgttgttccatgaacttttaaatctttttggctcggcagactcaagatatataagaaagaacactcaaatataagaaggaactttacttgtttctcggatgtaaatgacaatgagaaaagctctccatatactaatgatcctacaaggctatttttggccaaaaagaagctgaaaattgtggaaaaattatgtcaacaagggattacaagggaatcttattaattactatggtgcatcaatgggttgtttgtaattcctataacagtttaccattattcatgatattcatggctgatcgaggtcgaactcggccaaattaatacggtttaaatgtagtactaggaagtgactcctaggtcgtctctcaaggatctcaattgtctgcgttagggattgaaacgtgtattgggggggtttttggcagaatgcgaaaatctaaattaaacagaaataacaattaattgcagtgattagaaacaagtcagacccttagaacatattgcgcctctaatttccttggttcacgaaagataatctgttctacttaatccttatcagtccagattaattaactaagcgaagattaacctaaaacttcattacacgaattaagcaaacgtgaacctcgttagggcaaactctcagaattaagtaaactgagattactgaatcaatcaatatcagaatcattaagcatgactctaattcgaaaaatacagaacagaaaccccaacaagaacgaaccaagcagaaacgaaattcaaaaacagagaacctccattaaagggtttgcaatctgtcctagggtccaaccctaggtttagccttccattaattcagaaataacaacagaaacacgaattgaatcgaaatgaaacattaaacgaaattaaaagcagaacgaaattaaaagcagaaacaaaattgaacagaaacgaaatagcagaaaacgaaactaaaaacagagaaacgaaattcgaaattgagaagatgaagcagaaaacgaaaacaatactgaaactgaacgcaaacgtattctgaaccgaaaattcaaacagggaacataaaccctagaaacaaagaaaactgcagagaacgaaatttactaaaaccctaaaggagaactgaacgaaaataatgttggctggtctgcatgggcacagtttcccaaatatatagagtgacggacctaaacgaaaatgggcttttcctaacaattttggcccaaaaacgaaaataaaataaaataaaataaaacgaaaataaaatgctctgaaaataatgctgacgtggcatcacaatcttcaagtccatgaattaattccaagcccaattaattattaaactgccctgaaaatcaaattggaataattaaacttaaaataatccaaattaattaaaatctgaattatcggtccaattaaatcctatatgagaaatagtgcaaatgtgaacgattaaacacaattcagggattaaaatgagtacagaaagatgagtaaatagtgataaatagtgactcatcaatcccttcttagttaccaccattacggttcatgacttctcatcatcctgtattacttatgctactcaagatctaatacaacttacagaatattgaccgtttagtttaaaagaggagaaggaaatgggaggcaaatagtggaggggagggacttttgcccactcattttctctcctctcccttccaaacctttgaatcaaacaaggatttttatcaaaatccctcccctccctttcatttctttctctaccaaatacaatgttagtgatgcaaaggtttcactagtcccatttttaggtagcttcggttttttgaccataaggatggatccttgctatcatctctcttgttgtaagttgcagtatgatactgagatgaatcttgatcaagacatataggagatattcaattttgtagttgatggtgtggttcaggagaaaatattgctataggtaggttgctggaaaagtgaatgttgtattgttgttcctaatgaattctttggaatctgtttgttcttttggagcattggatatgtttccaattttccatatgttgttaccattataaaatctagtaggtttatgattttatgtggctaatattttagctagtctagttgaagaattctcagaacatggatccacatcaacgcaatccttctgggaagcactggggactttgcatgacttgtctcattaaacaaatgtgtgtgtgtccttattaatgacaaatgtactgaacatcaaataattatatcaactttaccaaggagattgtgtcagagcgaattggaggctttataaacaaaatgattgtgattagagaaatgaatattagaattagaaagtataatactatgataggctaagcaacttagttcaataattaaaggtaaaattgttttggccattgtctagagaatttgaatgcatgacatggtggatgtgtttttattctcggtcttgctaaagaactatctcaaatagtgttttcatattttcctagcctaatattttgactgttaaattcagattcgacttacagaagcattggagcagaaaagtacagagcaaaatctgaagccagagcagttggaaaagctagcaaaattagaagattggcgtagggagttaaagctattggaagatgagaagggtgaaacaaccgtatcatgaacaaagtattcgaaattgcatgacaaaaatgtgtagttttatccatgtcttgaaagatatattccatggaaacaggtttaccaaagattttccattaatcgccatcttttgtgtgcaacttgtcagataaagtcaggctgaatttggatgaacttttcaacaagttataggaaaggaaaatttagaagtaaaatcaattttctcaaaagttgaaaaatatatatatcttgattttaacttgtaaaaggattgattgattttacctgtgtttgcatcccagtttatttaaactagactttaatcttcatttgttttaaaaaacaagttgcaatctgtatttaatattgactttaaagattgcacgagctctgattcgttgccattaaatatccattaggaagcttgtagaaattttaaaaacttaatagtgtttcggtaagtaaaatggaggctgctattgtaaatttctgagggcctaacttctaatagaacccctccatcttttcctttctcattctttcacctgtaatagtctcccatattcttcccccaaagctcccttcgaccctccttgaatcggtgagtttgcttcctttgctcacaaaattttaaccatttctcacttatacatttctctctatctgccagctgcaagaaatgtcgtgagtgcagtttgagacccaaaaagggccctacattctagctaatcatttctcacttgtacatttcctgattaatataattttctgaaaattattacctccatgggccacgtaattttcctaagctcataattatttgctgtaaaactttgttgggctatccactctgaagcctgaattagtatgagtggaggaagttgcggcttcatgtggtaatcttaacggtgtttgatttcttgattgagtacatttggtttatggaaatgacctttttaattgccctcgactgagattatgctgtgctcttgacactttattttattctattttatgttgattttgctgttggttcatcaaattaattgttgatttgggataaatttattggagtggcgatgtgagaagttgtaattgatggaatgtttaccatcccccgtgtatgttgttgcctgaccaaaggaaagtgttggggttgttgtcttggaattttcgtgcttcttacctctgcgaaggagtgaaagtttttggtataattgcatggcgtatgcttccaacatgaggcatttttttaatacacctaacatgaaaagtgtactttcaaaaatatcctttacattattaaggttacggatttcgtaaccttacgaattcgccaattgctatgagtttttttttttttgtttatggattgcctagtccgtaatctgtaagaggctttttttttacggatggtgcaatccataagtttttttttgtaagttaaaatatattttacaaaataatgacgtacgaccttcacattattaacacgatgctccaattagaagcaaacctacgtttcccttaaattttcaagtatccactggggcacaagcagaacttgcttaggctcatcaactttgtgtagtcttgaccctttggaaggtcctcgtgaacttgcaatactttatctttgtttttccaacgcttgtgtagttttttccgaatcttaccatgggctccaccagcaaaaaatgctaatattttgcggttattagggtgttggcccatattaggtgagcctagctttccataaggcaaatacacttctggaatggacatgtctctgttgggcagtaatcctttgaagtagtggcattgcaaagtgccctaatgaagtacttgaagagttcgggatttgcatctgaaattcttggaccctgaatcatcaagcaaagttcatgccctttttatttgaatttactaaaatcaaaagcaacatggcagtatttttcaatcagaattggagttttgccttattaatatgtataataaagatttggataaaagatcaccataaaacataaaggcgaaatttttaattctctttttattaaaaaaagaaactatattaaagttttgtatctagtaaaaacaatttgatcgattgtttttattattctattcaatccaaaatagtaatttgatctgactatttgtttgttcttttatattatgatttataataatttgttcctttaaatattctttacaaaaaaaaaaaatcgaaagcactgtccccaaactcccatcactaatgcccttccttaattatttttgtggatccgtcctctactccaatcaattaagctaatagatcaattatgctaaaaaataattaatgttgatacatatggactaatatacaatctaacccaaaaaaaaaaagtgagagttgggaaagttgatccgacggattcaactcacagtatgcatattaaagtaaagtaggttcaaaggcaaaaaaaacatgcatgtggggcaaagtgagttgtctcttaactacacacggttctcttaattggtctctctgtgcttttgaatttcacaccgtgtttggtggaaagcttgatattaaaaattcaaagtccacctaatttgacaaggaaagcaccaggtagcgtttcatctaatgttttctccatatagttgactatttacccaagttcatgatgatgtcaacaatgcaagttgtacaactaaacttcttccttgtgcaataaaatgccatctattacgaaggatgttttactgtcacaaaaaggatgtatttggtacgacaacattcagaaaatttataagtttatttgactaatttacaaaataatttgatcaaataaattttatttgatacgagcttattttaatagtttatcatgtattattaagtggtctaaaataaataatcagaatcacctaatattgtttttacatgagcgaggttggatttaacaaaaattatatcaaaatcatttatgcgtgactatttcacttcacttgcttgcaaaacatcaaaggaatttagtttagttgaataaatagaatatacgagtgttataaattttttaataccattttagattcctgtgagaaaaaattgactgtcaaaacttgacaacttgaaaggtactttagtttcatatgattgagaatgaggcaccaaccttcttgtgataatattaaattttctttaactttttttgaagtaaaggatacttgattagaagattactaataagtgaatacttaacatataagaaggaggtggagaaagtgtaagtttgtaaccgaccacaaaaaaaagtactaataatctaatatgaatataggatgaagagatccatcacagattggacggtgggggaccaatggcacacaaaaattcccatcctatgttttggagtaattaatgaaccagtagcaattatataagaagtctgtatctgtcatatatatatatatatatatatatatatatatatatatattctgcatcagttttgttaaaataaaaaactctgtaaattaattggccatgtgttattttttgcacatgaatttgaaaaaaggtgggaaagcgtgatacttttagctgtccagaaaataaagtaaagattaaaaaatttgaatgtgccttgcacgtgggatactttattttttttcaaagaggatactttaaaaattataagccacaccttattgtttacttaaatcggagaaaaataacaaaatcgtttatatgttaatttatttcgctttatatgtctatacagtagtaatataaagttcccgtaaaaaaatagtaatataaagtccacatttctcattaatcccattgatctttccttttgtagaatctcgttaattttattaactaatctttcaaataaatgtttgtgggaatggaacaaacgttgaagtacaaacaaacaggaagaaaaacaacacacacacacacatatatatatatatatatatatgttataatcatcattaaaattctaatctaaaactccatggttactaccaaaaaatttcaccttcagttaggctgtaaattttctttgatgtacagatatctttcttcgtccaaacttccgtggacaagtttttttccccgtagaggttcatttaacagagatactaataccataagggatttgttaattaatatctttaagatattagtttaaatttttttaaaaaatatttattgtgtaaattatagaaaatataaaaaaatataaataatataattttttattttaataaaaataatttattttaaatttcttaattaacgcattgaatgcatttattagcatttgtcataccataatcaagatagtaataactaacataatcaatacaaaagttaacaaaaaagcaaacattatatttgaagaatagtcataaacattaatatatcatcattaatcattgattaatctgaaatgaacaaagatgggcgatgcaatggaaagaaaccggtggttatagaaagttcagtttcatgggacacgtaggtcccaaagtagaaaaacaatgtcccatatgaatgatgatgatatgatgccatgcagatagtacgcaacaagtgctaccacataattggatgctcaaaaagctgttgcaatttcgagtttttgtgaaattctataattgattcaattaagctaataaatcaaaagaattaatttgatcttatatattaaaaatttaaaattatatgtatatattataaataagtatatgattaatattatttgagtagaaaaatttattgatattttaagatctaaaatacaaattaataataatctaaaattaatttttttaaaaaaaattcaaaattttaatttgaaataaaaaaattaaccaaatcagatttgttcaaatatgatccaaggacctacatagttggatttagtctagttatcttggatcaattgtatgatcaatttaattaaacaactaaattttgattcaaccgatcagaccaatctgaattaaataacacttaattatacattattttatatatttattttaaaaaattatatataaaataattatcacttaattttttaatgaaaatttctatacaaataatattaaaattaaaaacttttgaaagagtaagtaacttatatatgatcaatataaatgatccaatcacattttctacgcaatgatgatcaaacataggtttatattaatactcaaacccttcactattaactaagatttaacggatataattcaattagttaaacttatgtttaagttattatagataatttctgtttgatttttaccaattaagaaaccttcactttttaaccaattctaatagttttctattatgtataacaaatttattatactactaattatcttacaaatcatacttagcgtaaattttaattaattaattacctgtaaaatttctacaattaaactctattaatttaaaaacaaatatacttaaagaaattaagaaaaaaacaaaaacaaaaaagaagtcctatgatttgttgttcctttgatacagggtcgggtcactctctcttctctctccctctaacgtttcgaccacatggactgcacgcacagaactctccgccactctctctcttctctttctctatctctctctctctcttcatccatattcaaggctctcaggactatccttcaattttggacccttcaatattcgtgtgcaactctctttccattttctacatctttccattttccattattctctccaccgtcttctcttctggtacacatttttctcctcttctttgcagctctgcaaatttctctctctctttttctattaagatcttgtgggtaactgtgaaagctcgtgtctttatttttttcattgtttttcctttgaggtaattatgattgcggctttgggtctggttctgatgaaggacttcgtttttgttatttaagcttagaataattcgtttttgttttctgggaattttgtgtgctccagaattactatatgttgggttgttttgaagtgtggttgagctgaaacggttaatgatgggtttttgttcgcttttgtcatgtgttggatcttaaaactgtggagtcttctgggtttgttcaaaatttgcagctttttttcattgagttgttaaatgggaatgtggtcctcttggggggttcgttttttcccctgtttccttattcgcgtttcatgctctgagaaacgatttggtttgcatgtcttttgttagtgtcatgaataatgagttatgcagagcctaacttttagctttgtgtgtgtgttttaaattttttattggttcgttcttgtactgtttaatgtggatcttggaattcttgatgtcttctctatggttgaccatatttcagttttgaatttatttgtgaattgcagtggcttaatttcatttggctaaaatgttgtggttatttgaattctatgttttttcattggcttaatttgcccccttcctttttgctatttttgctttaatgtttatcctttttacttattttactttactgtgttttctggggtcaaccctttgcttgttttttaaattttttgtttggtggcttttcatttttgacttctttgggttgtttcacattttagaggagaaaatatctcatgtggtgtgattttaactgcaggatgtctctcaagatctgtctggggagtgaagcttaatttgattgttggtattaaggaataagatctcattcaacacactaaacaataaggattttgcaaatgctaaattttggcaggtccagaaatcagtcaagggcagccagagctacaacaatgggaggtattattctgtcctaaaatttgatcatgaatggtagtatgatcaactttcttattttttttctcctttgaatgaagtttggttgcttaaagtattaatcaatttgaaaatgggattagattattggaaaactttactttttttaacacttgactataggatagactgggtgcagatatatgaattgacaacataaggtgttggtgaattcattaattgtcaatgtcctgtaatttgttttgtgtttgttgttatttcccccccacttatcatgtaattggtgtattaaaatgtagtttctgtttttctgtcctttaggcatggattatgcagatccaaaaaggaaggggaattttgttgggaaagtatttcttgctgcggtattaacaacactatgcataatcatgatcaagcggtctccatctttgaattcccctagtccggtaatccctataccattgatacaattaaaatgccatacaccattaccatggtcaacctacatatgttagtgcatgtgttatgtttgttgtatgacgtgtatctgtagattagattatattgtttattgtagttgatgttataatacatttgtacctaacaattagacttgggagatttaggtataaatcctgttacacatgaatacaatgttttcgcttgacagctataatctttcatattttatttcattgtgaatttgtgtgttcatcaaagagactggagacatttattaggccattgaaatttgcgagacctactgcatagtggttttcagttataattctcttctttctctcgctcaatctttttgcgtaataagtcaactgtactgttttctcttttattcatctagctatttctaattcgtttttttccttctgtttctcccccctttttcagtttgcagttcacgaacctggagtcactcatgttttagtaacagggggtgcaggatatattggttcacatgctactctacgacttctgaaggagaattatcgtgtcaccatagtagtatgtcaattcataaagatgattctgttaaagctaaatgcactgatcagtgtggttgctacatacataacatttttttttctggcaggacaatctgtcacgaggaaatttgggggccatcaaggttcttcaagacttatttccagaacctggaaggcttcaatttatttatgctgacttgggagatccaatatctgtatgcttacacactttgttacaagaaatactttggtgtcacttctttttttattattttaatggcatatatggggaaggccattgaaagatagtttattcgactggttatcaggttaataaaatatttttggagaacaaatttgatgccgtgatgcacttcgctgctgttgcatatgtgggagaaagcactgttgatcctcttaagtaagcacttctagattttgtttgtcacatttatctcagctgaaaaagttgtggaagtggcacttatgttcagtttctaacacttctagattttgttcgtcacatttatctcagctgaaaaagttgtggaagtggcacttgtgttcagtttctaattttcaccatctatatcttagtaccacaaatcacattttcttttagatacacattgacattttaaacattatttgaactggcacagagatttctattatggtcttggctttgccaattaagtcacgcattgagtcccacaaactgtgatgcaagataatatatttttctatttactgttcaatattatggataagaacttcaaagacaaaccatagttgttcttattgacataatgtttacaatgcataccagactaataacagaaaagttggaccatttgaaaatcatctttatctagaggatatttttggtttgagtgtacctatatttgcaattgctactctatgaattgcattatgctattgctattgccattctttgtaattagatatgattttgttgagagttgaacaaattgttgttatgagaatgattatttagtgttggattgatcaactttggttttactttatagatttaatttatttctaattcgcatgtttgccaggtattatcacaatattacatcaaacactttgttggtattggagtctatggctaaacatgatgtgaagacattgatatattccagtacatgtgcaacatacggggaacctgagaagatgcccattacagaagaaacaaagcaggtgggaatctaaggatagttgaattatgggggttggttgagaatattttgtttttcattgcatcctgatttgactgtactgcttgaggagatttagtgttaaaattgatgttctatttctatatatcaggtcccaataaatccatatgggaaagccaagaagatggcagaagatattattcttgatttttctaaaaactctgaaatggcaataatgattctgaggtttgtattttggatttgcatttcccttcattttaaatagatttttatatcttatttttattccatttgccctttgttgcaaaagctgtaagtgattcttactatatctgaaatatatggaaaccttgcaaaatgatccatttaatcaatgcatagttgggaaaaattatggagcttctgacacgttcctttatgtgtggaaaacaatcaaaaagaaaaaacgacattattgtatttggattcgttggctttacaaaactgtctaccccatgttgtttggacaattgattcatgtacagtttgaggtttgactgtggatgaaatatagccaatcattggaagttgatgatgtttcagaattatctatgctggtaattattggtaacttttctttgggaaaccaccagatacttcaatgtgattggatcagaccctgagggaagattgggtgaggctcctaggcctgaactgcgagagcaaggtcgaatatcgggtgcctgctttgatgctgctcgtggtattgtacctggtttaaaggtatgcccattccatttatgcttatggctaaaaaggaattctcaatagaagtcaggctatgtttggatatttaatgataagtgaaatagaatggaatggagcgaaatgggcttaaaaagttcacacttcatcgtttagactttagatatcttggaatgggggaaaaagtaagccctagttcctcccacatgacacctccccttccccccaaattagagggtaagaaacaggagtattggatggaatggattcaaatgcattcattcaagttccattccatcccattctatttcaaataccaaacaatagaacctagtatcattctatttcattacttcatttcaaaaatcggaaattgctcttcttaaggagattacagtgcatcatatattatgcattttcagaggaattgaaccaatatgaggcaactagcttaggcgtaatatttttcagagccatcaaactcttgataaatcttctaattttcttttccatacatttagtctagaatataagtttttaactgaattttccaacatcagaataatgttcatattttcttgctagtgaaaaactcgagctgttgtgtatttaatttgaatttgcttagtattcatataagatattgacttagtcctacgtttcctgccaatcacgttgaagaatactacatctatggctttttaaccgttagaggttgttgcaattgcatttcatttatgctgaaaacttggtagaaaaaaggtttgtaagctcctatacaaaatctgaaaagaatttggtcatacaagtcctggaaatggtttgtaagcttaaacgtttaattttatggtacatggaaatctttgagcgtcaataataacttatttcttatacttattatttacaacttgctcaaatggtctagatgattatgtcatgaacttgtccaattttatcaaattcatttcatgtagtacttgcaggtgtgctcattgtgtgctgccactttgcaggtaagaggaacagactataagacggctgatggaacttgtgtacgagattatattgatgtaactgacctggttgatgctcatgtgaaagctctggaaaaggcgcaacctagtaaagtcgggttctacaatgttggcactggaaagggtaggttaaaacactttgatcatgaatatagcactttaggggtcgtttaattttgaaaaaaaaaaaaaatttcacttatttcctgcttcttgatatttatacaggaaaaagtgaaaatattgaagggccaaacttgccatcttgttttaaatctgtttcctgtttttaaagatttgtacaggaggtaaataaaaaaaaaagttattctgtgtttcctgtacaaatctttgaaaacagattaaaaacaaggtgtgttttttataattaacaatgaaaacagcaaatgaagacaagaaataaaagcacaagtaaacgccccctaaaacaacaaaacatttttttcactgttttctgtattaacatctgaaaacaagagataaagtaaaaacggaaaatagaactggaaaatgttcttaaaccattgtacatttctttgtagtaaaatagtttagctcataccttagttgtgtcaagattctcacgggtgttatgtttatcaggtagttcagtgaaggagtttgtggaagcttgtaaaaaggccacaggggttgacattaaagtagactaccttccacgtcgtcctggcgattatgctgaggtgtacagtgacccgacaaagatcaaacatgaattgaattggattgctaagcacactgatcttcaacagagtttgaaggttgcatggagatggcaaaaatctcatcgtgatggttacggggtttcaaatgcagtactttgaattacttagaattctaacatagcagaagactagaagaaaccccgacagcatccatttcagctgcccttctatatcttagaataggggttgatattatttttttcttcttttactccagtgatttggcactggggaattttttcttaggtagcatgtagtccattcgttacatgttacatgtattcaccgtataatgattcaataatataatgcagaggctctattataaattttgtctacaatgatatttatatcacattactttcatatctttcatttctctctctctctctctctctctctctctctcactttttcccatcccttatttctcttcagtcttacaccacaaaatacatatggtttttcatctttgaattctttccttgtcaagggcgtggtgtagtaattgttgtgcctgaatagaatcaacaggtggggggtccttttggtattttttggtcaattggacattacggagaactgaccataattccccaagtggaagcattcattgaggttagatgggacgcccgtgggttcttgcactactttgcctaagcgttagcacaggctaaggagtgtttatggaccatcgtttcttcttgattagatccatgcccttcacacatggccttcacaaatgttaactttttagtagcatttttaaatataatacacatgcacaattataaattacccttataatttgaaatataggaaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatataatttttataataataataataagtattcacttaacacgtctttaaaaacaaattattggttcgagtgatatttgactcatacttcttatgtaagattttgagttcaaatttagtgaattaaaaaatgcgatttgaaaaaaagactccactaataataattagtcaagtttcttgatagatattagtcactagcaaaattgataaatatttcacatcaatgttatggtgacaaaaaagcgtgtatagaatgagattaagtaatctaatcattgaattgaaatattttataaaataaatttagtttataaaatttcatgtaaactaaaaattaattgatatttaattgttctattttattgcgatagatatgttatttaaaatatcaatcaatatccattattagatatatatcaacaaatgtctaaattatatcaattttaatattaaataatttaataactaaattacttaatttcatattatacaaagagttattaataaatgtagcttggttctttcttctttacatgttttaaagttattaagacataattttatgacaccctacaaaatgtgtgtgcacgcgcttgtggtccttgtgtcatgcatgcatggcctaagacttttgaggggttgtcttaggtgttgtgtgttgtcgcttttggtttatgaatttgtggtccagtatctcggtgtattcatgaatgaatgtaattattatttgagtgctaatcacgctgctttcagtaacaattaaattcagataggtctggattaatcgaacaattaattgatattaaaaactcttatattaggtacgaaggactacgacttaattgcatttttttcatcataattttcctttcgagctatacatgcatttgaagtgaatttgggatagaagaagagattgataggaagtaaaaaagaaaaggttgaaagagaaactgaaaaatatagtaataagtaatgtgataagtaaagaagagataaaagaaaaaaaaatgaaaaaaagaatataattacttatataatatatattattaattattctaaagttaatgtaatgttttttctccttctttacaatgacaagaacacattgagaatattcttaaaatttaattcaatcatgactactttataatttgttacggcgataataatatatccaaattaaattcattctatcttattatttattgtcttaactacagatgattgtatgccgaattttacattgttatacactcaaggatgcatgtttttcaaatgcttcatgtccacaatatatttactcaccaaaacttaaggttccatttggtaaaaaaaatatgatagaataagatacagatttaggacttaaagtcaattggaatatattgttttttagaaaaatatatttattatcacatatatgaaaatgaaatataaaacatgataaaacatatttttggttcttctaaaattttaaagttcagttttaaatttnggaatatattgttttttagaaaaatatatttattatcacatatatgaaaatgaaatataaaacatgataaaatatatttttggttcttctaaaattttaaagttcagttttaaattttctatttattttccattttttgtccttctatttttgaaatgcaccattttttatcctcaaagtgttatctaaatcactttccatctttttataaagaaatggaaaaaaaaaatttgaggtccgacttagaaaaaatttaatgaactagtaacatattttatcatataaattataataaatggtccaatcaaataaagtataaaatgagcaaaatataaaaaagaaattagtcaataataaatatagggagcacaaatataataacagtatatatatatctttatgcttttttacaactgttaattatcctattttgttgtaattaattatttgatacaccattaaatgatttgtcaatccttagtatatatacaatagataaaatacaatagataagaatagttgaattattctctctctctctcaccacaatcatcagtccaacaaccccaccattttctataatgccaatcattatcattatcaaccttaaagttattactatatcattgtcactatcattattaacatctatcattaccatattgttatcaaatataagacaagatataacacaataattaaataggattaaaatttattatactcttattatcatatctaactgccaaatgagtggtaagaataattctttctgtcagagcattctcgtccttgtcatcatgcatgcatggtctaggactttcggggtatcctacgtgttgttcgttgtcgcttttggtttatgaatttgtggtccagtatctcgttgtccaatgaatttcgattattagttgaatatactaatcacgctgctttcaataacaaatcaaattcaggtgggttgggaccatattgattgatatgaatatctcttttattaataggattttgcacgtacggatggaccatgacttattgttaaatgataatagctacttaacatcactttttttccctctaaaaaatgactagaatacattgagaatattcttattacattatcatcatcacattacatttagacatataatcgtataaccaactttacattttaattgtttggggcatttgtcacctttattatgatattgatcatattctccatttaatctgcactgatagataaactatacacccaaagattttcttcaaacttcacaatatatgcactcatgaaaacttagtagtggtgaagacgtataggaattccctctgctgggataggtatcgaagaacctgaaaccttctcatcaggaagtataacttcccacttgaacttggttatgagaatgtgaatgaaattgaggaccacaaaccgtgtgtagtcttttccagggcaagttcttggtccagctccaaagggtatcaaagtgtatggaacaggaacattcccttcaaaccttgagggatcaaaaccttcaggttcatgaaagtaatttggattcttatttgttccaataaatgcccaaaagatctgtgaaaataaatgcaaataaagaagttagtgacaaatttaatttacatgtttcaattaatatcttaacaatctttctttatcaaggtaccttccacccctttggaatagtgaaaccttcatagtttatatctgttattgcctctctgaatgcacctggtgcagttgggtagagtctcatggtctcttgtgcaacagcccatgtgtatttcaatttctgtatgctgttccaatctagtgcagtaccggatcctttggattttgtaatatcagcatgctctgattcaaataaaagtaagcaagatatatagccttttttagaaaggaaaattaagcatacataattctgttgggccttatttgtgtctgccacttatatttggctatgtggtatgtcaaccttattttgtttcagatcttgcattttgagtccaaaaagaaaagccaaaaacaaaaactgtactctcctggcttaaacccaaaatcatattttatctcataccaccttaaaatagctacaatattttacagacaaaacttagatgcagtttcttagctatttctggtattgttttctgattaaaattagactttcacctcagcaatttgcatgataaagatttaggtaaaaagttactataagttattaacgtggaactccaattctgattagagagctgcactaaaagtagctaagaagctgaatttaaattttgtcatgttatatacaattagtatcttaaattaccggataagattttttggtagatatcaggcctctgtccaatgtgtttgatcatgaaagccagagtaatagctattggtatgtggccggaattcatcaaccccatgatgatgttgcttatttcaagtcttggcacatattttccaccctgctcagcaccgactacgtgtgctattaggtcatccacaacttgccccttggacaaagcgtcaatcttctctttgatcagaaattggatctctttccttatagcagctgcagccttcagtgccttatggtatgtggagcctggaaaattcacaggaacagaatagatcccaaaatacaagttctcaaactcactggcaaattttggtccatcaattcctaagaagaattggcacacaagtgtaagggtaaaggccttcaccaaagggtacaccttcacttctttttttccttcccagtgtgtcatgaaatgttggtgcatggtggattcaatcttgttccccatgtacctagatattccctcaggtttcagaatccccaagatcttcacaggagcagcagatgcagcttcttgtgttggttttgtcttaggtgcatgtgtttgatcaggaatgttgaagaacctgcgctgagtcttcatgtacgaaaccttgacaagctttgtctcattggtggagacaaatttgtttgctccagggccacaaagaaccactgttgactctcctagaatgtgtgtgtggaagatctctgaggagtgcttttgaaccctctcttgaaggaaatgttcaatcttgttgaacaaaaattggtaggtttcacccactaggggccacccaaagctacctgggggcaagcttttagtgccacctagtactagtagtcttcttcttttctgcaaaacaaagatagatgcaaccaaggtgagcaaagtaagtaacaaagattgcatgaaaaaacccatttcaagctacaaagtttctatgtagatggtagtctagaaatgttgattgttgaacactctttataaagaagtcaccgagccagtcaatatttctctctccaactgatcatagtttgttttggataataattcatgacacccatgacctaacattagatgacacttggacatagaaaaaagaaaatgtagatataatatatgatatgatatgataaaaaaaacagatattgataaaatatttaatatatacgagtattcatacatcattatgaatccattttctttgaaaaatgagacaaagtttaaagaataaagaattgtttgtgataatgattatatcgttgtcattgtaaaaataaataaaaagaactgcttctgtttctctctctatacagcagatattataatgtaacgatattgttttactacaattttttaacgcatgctattgcactagtgatttttaatatttttcttaaattttatctatatatattgtatatgtgcatgcaatacacattattaagctaaattgttaagttgggctccgctgggttacagatataatcgtaaattactctcgaaatgaataaaaagaagagcagtgaaagatttatttcctgcatttttttttaagttttcaactgaggaaattttgatttaaggtcttcaacggaacgataccttattctacattcaacacattggactaattgttaaacaaattttatttttttaaaacttaaaagaggctatagaatagaaagaaagagagataacaaaaattgatagagttcactcactagaagccacccaaaagtaagtggaggcaaccttttactgccacctagtcttcgtccttgcaaaacacatgcagtcaaggtgattaattataattagtataataaatttgcaagaaaattacatttcaaactacacaagttatagatgatagtgcatgttgaagtgcttttatatataggtcgccaaataatgtctttggtggttttttttttaaaaatttctaaagctttcctatattaggggtttgaataggttttggtcaaaattaggatccaatctaatcaaattcgatcgattcggtttagttcgattttcaaatttttttttgaaacctaacccaactcgttcatgaacggttcggttcagttcggaccaacgggttatccatttaaatttttttcttaaaactactattttatataatgattctttcaaatatccactacaattaacacaatattatcaaatgtatgaaaatagtaaaaatgatttatttaataccatcaacataatgttctaaaatagacttataatataaattaaaacaatagattcttgaacaagatttactataatagcctgaatacaactattttttacaaattaatttcttgcaataagttttactataaccaaaaattcaagtcaacactcaacaacgaaggttatttcttttcttctcatccctgtttccatcaaaatctcaatgaatacaaaccagaaaaatcacgggaagttaaaaagcttcggaaaagaaaaagaaagcgcaaaggaaaacttgatgcttgatcgatctgatgagatgagatgagatgagaaagaacagagaaggagctggtgtagaactgcaaagaagaagatgaaatgagagagaacagaagcaatgaagcacaaagaagaatatgagataagacagaacacagaagtgcaaaagaaaaagaaacataaacccgtgacatttataatacagcaccttcaaagcaagaatgagatgagatgattataggctgacccttcattcggccccacacctttttttattgtcaaaataattttttagtttttaaattttaatatatatatatatatataaataaataataaaatttatatttttattacgagttgacagatcggatcaacggatctataaatctagacttgtaactcaattcgtatatgaacaatttcaatcaaaaatacataaataacctaacttaaattattcatattaattcagattcacacttaacccatactcatgaacatccctacccaaatcatgatttagtcaaagattatacaaaacaaacttttccacacatagcgacttttctaactacatgcaattgtctattgtacctatctatctctctacttggcatcatgtatataatttatttatatttcttgctggttattatcttttctctcaccctacgtataaaacaatgggcgtagagttgacttttgacaaatgtccattggtaaatgtcatcattaggcacatgacatgttattaaaatcttgaaaatttatgtatggtttgatcgttcaaaattattctcttttttgttttttgtttaatgagaggtattcaagattttttatttgacatccaactaattatctctcctcttctggacccattttaaaataaaatgatacttttagttgtgactctatattcaaaccaaagatcaaatcttaaaccttaattaaggaaactaagtgttaaaccatttatatcaacaatttctaagaaaactactttttttactcttaaaaaaccgactcttgtcagacacattccctatatatatatatgtgtgtgatttttttattgtaagaaataagtgttataaattgactgttagatcatatttaaataatctagattaaaacacacacattaacaccttaaaattttcataacagtgatttgttccaatcattattgacggacttacatgcaaaaattttcttaaaaaaggtagattaaagaggatttttatataacctataatttatattataatttttgaatttttaaaataaaaaatctataattattcttcatttaattttttttttcattttaggatatatatcacgaagttttatatcaaatcaacttagtattttttcactaattaagttattcaatcaaaagagattttcagttctcgtgattatttttgtaagttaataatgagttaagtctacattctcgctattacctaccagatcgtattggtcaagatgtatgatttagttgatggaataggatgtataaattattgtaatttttttgatattattttatattcttatctatctaaaaatatcagaccgtatcattacttgataacctgccgccaatgaagaaaggatcaaagttatggcttttaaaattatgaatagacaaaactcataatcaatgacattaatttgtactctacctttttaattgaagattaactaggaatttatacacactataaaaaggaaatctgctagtagtttagtactgtcgtcaggtcactatagtcttgcccattaaaaaaagtacaagtacgcataaagacaactgattattaatcaaaatgtatgaagcagcataagagtataaaataaaaacaaacatcagcataaaaaatgaaaaaaattataaacttgacaaaatatctcaaactatattttagttgtatcgatatatattccaagcaatttaattctttttaatacagcaataatcatactatagttgttacccgattcttagttttccctcggcatcacttttctcatagtacattatctttccattattaatgttgtgccaagtcatttgaattgttttgtttgtctccattgttagttttagatggatgctctttgtggtcctgtatctggtccttcttcactatcaccggacattcatacatattgccattaattggagatttaattttccatagcctccccactgtaatataaataaaagtcataatagttgcttttaagttttatataactctttaaaaaaaggtattatgtaagagctatacgtgcttgcaaaagtcaagtatccattaaaataattagacccaaatctaatgagtattcattaaaactatctacaatacataaataataattcatttatgtgggtctctctatttatacaagaggataataaaaataagtttggatcatataatcatagataaatacaatgacgaacttacataataaataaaaaaatcactggtatataaatgtatttcctgaatttaataaaattacaagtaaaaatatagctaagattcacacatcttattctctcataataaaagtcttcttacttgatatgccacgtgtgtgtattgagaaaattaattgagctagatgtcatatccataattaatgttttattaattcattacaattagttccaatattgaaatggcatatttgtcttacttgtaaaaaagaaggaattaaaatatttcattaaaatggcaatgtctttagtttatcaacacactctatataatcaatatttataataagagagtcttaataaatactaataacacttctcttatactctctctatcatattataattattatctaggttcttttatatataagaaaaaaattaataaaaaaataaaaaataaataatttttttataaaattaatctttatcatggttaactcatttttcttgttttgggtgtgtgatacaaagaaaaccatcaagaagcgggatgagctatatacaccattattttttcttatacaccattcatgaacagtgtctttccaaaattacccttcgcttttttaacgcttttatacacggatacataatattgatacttacggattcttcaatccgtaagaattttttttacatgtacggattgggcaatccgtaagcccaatccgtttatttttttttatatacggattgggcaatccgtaaatccaaaccgtaaacccaatccgtatataaaaaaaataaactgattgggcttacggattgcccaatccgtacatgtaaaaaaaaaattcttacggattgacgaatccgtaagtatcaatattacgtatccatgtataaaagcgttaaaaaagcgaagggtaattttggaaaggcattattcatgaatggtgtataagaaaaaataatggtgtatgtagctcatccctcaagaagctaggccagcccacctaaggcagggaggcccgtctagcagtagaacaaggcctaaaaccctacccatgtgggctatcgggtttgacgacccagatcaatccgcaagtaggagcaaataggatttgtttgttcacttgttccaataaaaagaacgtcagtaacgcgattatggcctgagaagaacgttggaagtgataagtgataacataaaacagagtttcgttgaatctgcactaaaaccctacgcagacatcttggtgtaagtccaatcgatatagcagcaatgtctacgctcgaaattgaagctcgggagtaagtagtttcatttgcgagctcttgaaaataggaatttaattttcttcatttactgaatcacatgtttcaattttgtttgacgtctaattgaagctcgtttaatggttctttcgcacaatagatctcttttttcttttaaatttatgtgtaattttcaatttttgtttgccccttcgcagtgtcatcaaaattgtgcttcagttttgcaaagaaaattcgttgcatcagacttttcagatgctgcagaacgaatgccaggtttctcttaacactgttgacagcattgaaacctttgttgctgatattaatagtggaagatgggatgcgatattgcctcaagtttctcaactcaagcttcccaggaataagttggaggatttgtatgagcaggtattttgtgctgcgtgtgactcactttggtttatggcttgtcactgtttagtgtatgttcactcaatcacaaacttcaatgctgggtatggactttttgatggcttttaaaccctgtcatttatatgaacagctttaaattttaatttggcaatgaggttgggtggagttatcgagatttggtaggataggctgaaatgttgaaatagaggctggtgagggtcaaaatagtgatgcagttggcataggaaatgctgaatgctgttgctaatcaatcttcctagatgaatgttgttgttaatcaatctgcctaacctaaactcagttgctggttagtgttagcaagtagtagctactggcatggtgccctttcagatattgagttgttgattctcattttcttgacatgtgctttttgtgtagctggttcactagcttttaagtgcataatcattttttttttaattatgtgctgttcaaattttaggggagttgtaatattttctgtgctatataagtagtttaataatttttaacnnnnnnnnnnnnnnnnnnnnnnnnnnnnccccccccccaattggctaaaatacaacgtgttaattacttatttcaaaaaagagagaatcttaaggacttcaataactgatttaagttattaattccactctccgcatgggtggaataaaaggtgtttaattttggtagaaattgatgctgaaagaatttattttggaacaatttaggttaaaaaaatattatttgtatttgcaagtgatattttaagagtgagttgagaagaaacaattttgttagatggcgaagtataataatttttgaactatagatataaataattatttgtgccccacatctggattcaattcttgtcaatggagtaagttaaaaaatttcacttgtctttgagaatgcttgatagttgccaaatgaggtaggctactgggaatcaatttttcccacttcactttgaaagtgatgctaacaaattaggctaaaagagtattgagctgagccaatacaaataaagtgatattcaggaattgttgttcagcagtgtttgactgtttgctattcataaacgcttgtcttgtagtctgtaacacttgatctgtataacactctaataatgttgtctgtttcagtcaagttagtgatgtttcaaatagatttgtattttaacatgattgcagattgtattagaaatgattgaacttcgagaactggatactgcacgtgctattttaaggcaaacacaggtgatgggtgtaatgaaacaagagcagcctgaaagatatttgcgtcttgaacatctcctagttagaacttattttgatccaaatgaggttagaaatacattctataattttatttttttttcaatttcatgttgtgattgttgtctaaattaagcaacttgttacttgtttcccttttttctattttgtttctgcactctgttacaattgtttgatcattcagctttaactctgatggaaaattttcaaggactaaaaaaatcattaacacttattattatctgttcttggaataatgagtattatagaatgaattatgacttttgtagttttatttctagccatgtcctcaggattgatatttattggacttcattttgtttctttgcacaagggtttatgatttatgtcctatgtgacaggcttatcaagactcaacaaaagagaagcgacgtgctcaaatagcccaaggtttctgtcttttacttttgtagtagttactatctaattgtgatactattttttttttctttttattttaatgaacaactgtttcttgattggaaatgaaagttttcttcttccattgctagggatacagacaaacagtttgttatttatcttttttttgggggttttactttaataacttctctttcattgcattttcagctcttgcagcagaagttactgtagtgccaccatcccgattgatggctttaattggtcaggctttgaagtggcagcagcatcaaggtaattgcatggtaacatgttgatgccacaataaattactttcatggtcaacttttatatgaaaattaagatttatcatcactgtggtcatctgcttacaagttcttttgttgtgtttcttatgcaattcactgtgttatttattttttgttcttttggctcgggagccaggacaaagcctttacttcatttctgcaacttatagatgctagaaatgaatatttcagttatatgcatgcatgatgcatctttcatttctctaataataagcagaaaagaaacttcttgttggcaagccgctttaattatggtcgctctaagcctgccttcattgaagcctccaacaccttctttgtggcgtgagcggctgtgtttagtcatgcatcacttagtgatatggcataactgcctaagtagtgcttataaggcatgtttggttgtattggaaaaaaatccaagttccacatcagctagagatcaggccaagatagaatatataagtggtgggcaaccctcaccccatgagctagcttttggggttgagttaggcccaaatccaaattctaagatggtatcaaagcctatcctagatccatcaaacgggccacccaccatgtcatccacgcaccaagcccaaaagtgtctgggcatgaggggatgtattggaaaaaaacccaagtcccacatcgactaaagataaggccaaaatagacctaaacccacattctaagaggttgtcatgatgctatttgtaggaaaatttatatctttacatcttgattgagctgattgagctatgctttcctttgggctttctcagggttacttcctccaggaacgcagtttgatttgtttcgtggaacagctgctatgaaacaagatgtggatgacatgtatccaacgactctttctcacacgataaaggtatgttttctatattcatttaggcattgtttcacagtttgattagttttattctgccaaatcacattgaaggttgcataatctgaccatttatctatttttctttcatatgacatttgttattcatcattattttccctgtcttattatttttaaaggcttgcataatctgacccttatgttttgtgtctgcttgtttagtttgggacaaaaagtcatgcagaatgtgcttgcttttcaccggatgggcagtttcttgtatcatgctcagttgatgggtttattgaggtatacataatttgagtttaaagtttcattttcaacagttttcttcctgatttttgggacatatttctaggtgtgggattacataagtggaaagctgaagaaagatctacaataccaagctgatgtgagtgagtttttatttgaatggctttactgccaagaataaataaatgtcttgtatgtgatagttgatgatgaatttggaaatagatatttggctgatatatttccttggtaagattcacttagccccaaggttaccaaacacttttgttactctggtacctttacgtttataactgcattaaaagctgtagaaaagatatttcactcagatctctgttgtcattttaggaactatttcaactttgactgtaacattaagtacagtttggtggttctgtaatatatataaatataaatttatgcacagattactccttttactcatgtgattgtattttctttcatgatacgatgtcttgttttgatgatttgtctcttcctcactttgtgttcagtaagtgtatgaagttgtgaacatatctgcttgatttatgctgtctaagaattttaatactatcgatttaaaggaaatttcttatagtttaccaaaagtctttgccttagacattttctgattctatgaacttgcaggaagtgttcatgatgcatgatgatgctgtgctttgtgtagactttagcagagattcagaaatgcttgcatctgggtctcaagatggaaagattaaagtgagtaatacttgtctgcatttaaggctgcatgagctaacctttagaagaaattcttgtattcttgattttgtagatttttatattttcaaggtgtgcactgcacatattttttttttgatcagcaaagataatatatatatatatatatatatatatataaaacagtacaaggagtactgctgaagatacaaaacagcgggatctacacagaactttgatggctttataccaaagccgacgaagttctgacagatcgcgcaaaaagaaaaaaccaaagacgaaatacatgtaaattaacccctccccaaaggtacaaaacactctctcaagttgctagaccaataatggaaaggggtatcaaaaccattctctaggttcctcagccaagaccagcaaaagaaaatggcatcttccaaaagtttgtggccattaaaggattcattatgaaaaaggatctggtttctaagattccaagtacaccatgttaaggctgtccaccaagttagccacctagataaagctttcccacgtagatggcaaaaagaggattgtctaaaatgctcctttggagtgcactgcacatataacttcgctatttctgtgaaatagaactgagctaccaaacaaaattcatttggtgaaatttagattgtatgactgaagcatgggttaatagtgaatagtgtcaaattgtgcaacaatagtatagtgatgatgtggggaagattggcctctggtagctttaatttgtgcttgcattgtgtttttgctttgcactgattgcaatctagatggtggtattttatggacaaaattgtaaagtggctgcaacattaggcagtggcgaaatcatgtattttgcccaccctccacccttttacggcattggccactcatttttgtagggatatttttgtgattttacactattttttgcaacagtaggattttaggattagtatcccttcatccatacagaaaacccagccaccgcaccctgtatttacacctccctattcttccctcatcttttctggctaccatgtaccacccagcaacctgagtgttttctggccattggccaaacctgtacttttttttggcagccagagcttatgtactcaggtctttgctctgtcacctctattttgcatagcttagtcagtcccaccttcctgtcttgcatgccttttttttacgtgggtgataatctgcgctgtctttttcttcccttatgcttgactgttgttattgacttataaattaagtcttagattagtggtaattgtgtctaggctgatttttattttttaacgatgaatatgtctttattggttttctttcttttttttttatttttttatttttaaaaaagagcatttatatgaatgcggtataaattatttattgtgcatgttgggccatcttgcattccatttcactctatgatttgtgtttataacttcttatggtcctactttgtctcattatcttgtggttccttgaatttttgctgtcttcagttcttgtcgatgttgtagttgctgacttgctgtttttggaaatgttaatatgtaaaacttaaaactgtatatttcacatatcattttaggtctggcgtatcaggactggtcagtgcttacggcgtcttgaacgtgctcattctcaaggtgtcacaagtgtttccttctcccgtgatggaagccagttattaagcacttcatttgacagcacagcaaggtttttcatttaattttacttatttaacgttgttttgttagagataaccatttataagccattagctcacctgacataaaatttaggcttgaaattaacaagcagagcatgaatgatctagtgattagaagttggcattattatagtagatagtagcaagcctaaaatccaccatacaaatgttgggttgacattgcggccaatggaggaaagcatggtggttgctggttgcaatatatttttcttttcaaatgctaaaataaatctaccaaatataattgtcatgtactaactatctggaaaggttaagttgcgctgaaaggacacgaatggtcctccttttcctctatataatcatcatttcattgtcttcaagtgagagatatcctttttcttgtacttgcgattcttcatagcctcctcttcattcttcttccaaacagtggcgctagagcttgtgagaggattcttattagagatattggagaaatggaaatgaaattactcatttatgtgctgctctttattctttaatttagagcacaactccttgttcaaatctttaatgctttattactgcagtatattttatatcttaacgataaaatgctagcaactgttaagtgaaaatgttcccctttttgtaatacagaattcatggcctcaaatctggaaagatgttgaaagagttccgtggccatacatcttatgtgaatgatgcaatttttacaaatgatgggagtcgtgttattactgcctcaagtgactgtacaatcaaggtctgttacttggcattgtacttgaagttccttgtttatctggtgttcataagagatgtatttttttctccatattgtaggtctgggatgtgaagactacagactgcatacaaacttttaagccacctcctcctttaagagtgtgtcttcaaaaatttactattatgggttttgctattcaattttctgatgtcatcccagcaaatttgttcatttttctaatttctgatttctttggaatgttagggaggtgatgcttctgtcaattctgttcacattttccccaagaatactgatcacattgttgtttgtaacaaaacgtcatccatatatatcatgacacttcaaggacaggtatacataaaagagtggatgactggaagttattttgtttatacttatttcattagtgtctttatattagaattattgatgttggcattgtctttcttaatgaattgtctgcaaggataagtatatatgtaattctgcatattcatgctgcctgaatgtggatatttacttacgtgcggtttggagaaccttgggctatacttgttctcatttcttttcatcagtttttacaatgaagtgttgtagcagcatgttaggatctaattgcaaggtatgaaaattgagttcatcattatttctctgtcaattgataggttgtgaagagcttctcatctggtaaaagagaaggtggagactttgttgcagcctgtgtttcccctaaaggagaatggatttactgtgttggtgaagacaggtatcctatttatgtataatatgacacagctccttcgtttaatccagtagacaaagattttaagtacatgttgtaaactgcttcatcacatacgctttatgattgatattttcccatattccttgagcacaataacttggcctaattttgcagtaccataagttagtttgatgacattttccaaatcagtaattttttttttttgtcgaaataatatctctaattcaccaattatctttccaaaaattgttatattcttcatggattcgtttaatccagtagacaaagattttaagtacattttgtaaactgcttcatcacatatgctttatgattgatattttcccatattccttaagcacaataacttagcctaattttgcagtaccataagtgagtttgatgacattttccaaatcaataattttttttttgtcgaaataatatctctaattcaccaattatctttccaaaaattgttatattcttcatggaactgtaaattgaatgcaggaatatgtactgcttcagctatcaatctggcaaattggagcatctaatgaaggtatgtgtaattttatatgtagttagtcagagattagatctataaatttgtttcaaattggtctcaattcccatcgatattgtaatactgtttttatatatatattatcgtattacatgttttgaattagtgtctttctttggtatttttatgtcaccgagaaaagttatttgtccaaaaatttataaaacaatttgtatgactaagagagagagaaagacagaaatatgaaatgtataaatgatataatggagacagatagacaaaaaaaaaagtgtacatattgttatttgagttatataaataacaactctttaccaccttcatcttgttgcatcttttgttaaaaatggggaaccatgtaaattatgtaaaaactaactagaactggaatcagcccgcttggtggttttttatgccttgaagctcatttctttagataatacgttgtgcattctctgttgatcaaccctctctgccttgcgtatggttaaatgggattttattttctcgtattctgttccgagacaatatgcttatttttctactgaggttgttatcttgatatatgaatttatttatgatataatgaatttctctctggctaacggcaggtccatgagaaggaagttataggtgtcactcatcatccccataggaatcttgttgcaacatttagtgaagactgcacaatgaagttgtggaagccatgaatcttgtctgctttaagtctatttctattctatcttgttaacataattgaacatctgtgtagtttgtgcaatgtatatattcaggagtttaattttaatgtattgttggtaaaattattttatattgttgacgaatgatatgttgctagaaagccgatgctgaggtggagttattgacagattgaaaattcaaaatgtctatttacaatttttacttcagtttttattttatttttaaatctatccttattttctgaaacgtcataattatataaactgtttcatgtactatatgcaatactaaacacaattaattttttaataatgtatttgtaatgtacttgaaactgtatactatatattttgatttacatggaggaatgatataagtatatatttccaatactgtgaatagatccctaagaggattggatctgaacaatctaatgaaacccggaaacaaatcaaagaatagatatgaaagaaaagcaactagaatatacactcttatattaacacgatcaacactacctcatatatatcatgtatatactacttaagcatgttgttagggttagatttttggtcaagtaaatgattttttttgttagtagagacaaaatttattttgatgaactttatgtatggaaagaaattaaatttcaattattggttagagatatctttatctttaatgtatataaaaattaaagatgtatttttttttttaatgagcaagtacttatgaatttgttatctttttaacgagtagacaaagtcttatgtaatcctgaatgcaacattaaacatatattatgacatgatttcataaccattttttcccgtgtaaaatgaaaataagacttttttcacgtacaaacatctttttttgttctttttgctgtgaaaagaaatactttctttcgctgtaaaatgtttcgtgcaagggaacctaagtcaaacacatgaaaatggcactttggttatacatggaagaaaaacagtattcattagatattgtatacaatatttaatgaatactagagataatacaatcaaattcatgtcctagtaagaaatttataccataaccaaaactaaaggagcaactatagccttgttctctcattttcttgctcattttaccttgttactccttttcctccctcttgagccacataaccttttgattggtgtatcatcagcagccactttaagcatcaccacagacagagaagccttgatgtcattcaagtctcaactgagtaatgagactcttagccccttatcttcttggaaccataattcatctccttgcaattggactggtgttctatgtgacaggcttggccaaagagtaactggcttgaatctttcaggctttggactctcaggtcacttaagtccttatattggtaacctttcctcccttcagtccctccaattgcagaataaccaactcagaggagtgattcctgaccaaattggcaacctattcagtattaaagttctaatatgagctctaacatgttagaaggaaagtgttaggtactggtacagaatatagagagaacaaaaatgctttattcaactcacaaacacaattcttgattacacagtgacttcgagggtcacaacctccaattcccccctattttcctctccgagctcccctcttatacatttctctctaaaactgttagttataactaactcatcttagttatactaactattaaattgctatctaaacccccttgcataagtttgaccccacctcctatcaataccctccccttgaagctggaccttgtccccaaggtccattttaggaaacatcctctgtaattcttcagccaactcccagctattctcacctgtaattcttcagccaactcccagctattctcatggtgaggtaactctctccatttaatcaacacttcttgtttcccagttgcatttgtcctctgtttaagaatcctttctgactgcatgtgaagctcccactgctcatctaacattgctggcaatggctgaggtacaacagttgctttgactgattttttaagcaatgaaatgtgaaaaactggatgaattttactgtctgctggcagttctaacttgtaagccacttcacccaatttctgtattattttgtagggtccataaaacctgggacttaatttttcattcacttttctggccaaagacttcattctatatggttgtatctttaagtagacccaatctcccacttcaaaactcacttccctcctacgtttattagcatgcttcctcatatgatcctgggattttagcaaattactccttaactcctgtaacaacacatctctatcaatacaaagcttctctacttcttctagtttagaaggaatatcactgttttttacccacaaaggaggtgcttgtccatataatgcctgaaaaggggacattttggcagatatgttgtaattagtattgaaccaaaattcagcccaagctagctgactaggccaattcctaggttttgttcctgtcatacacctcaagtaagcctccaagcacctatttacaacttctgtctgcccatctgtttgtgggtgataggcagaactaaacttcagctgtgttccagcccttctaaataattctttccaaaatgaactcatgaataatctgtccctatctgagactattgaagcaggaaatccatgtaatctaaccacctcttgaatgaacacttcagccacttcctttgctgtaaaaggatgacacaatgccaaaaaatgagcatatttagtcaatctgtccactattactaatatggtatccttcccttgagctttaggcaaccctccaataaagtccatagatatatcagtccagaccttgcttggaatgggtaagggttgtaataatcaagctggagacaatgtactggccttatttttttgacaagtttcacactcagccacataattccttatatctttcttcatgccctgccaataaaccacatcagctattcttttataggttctgaaaaaaccagaatgtcctccaatagatgaatcatgaaattccttcaacattaaaggaattctagcagaattttttggtaacactaatctgtttttgttatacagcttccctccttgcactacatacccaggtttctccattgtcttggtgatgataccttgataaatctcatatagtggctggtctactcttaattcttcctcccattcaacccaatcattctcctggaccatagaaactgctgcaaaagcaaattgccttgacaaagcatcagctacacattctccttccctggtctgtactggatttcaaaattatacccaatcaacttaatagcccacttaagttgttcctcagttaacaacttttgttcatttaaaaatttcaaactctgctggtcagtttttatgataaatcttcctcctaacagataatgtttccatttctttacagccaatactactgccattaattctctttcataaactgacttcaactgtcctctctcagataaagccttgctccaaaaggctaagggtctgccttcttgtgatagtacagcccctaatcctgatcctgaagcatcagtctccaacacaaaggttttagaaaaatcaggtacccctagcacaggaagattactcattaattccttcaatttctcaaatgctttatcagcttcattattccaatgaaaagcatcctttttcagtaaagcattcaatggttgagcccattttccatagttcttcacaaaccttctgtaatatccagtcaaaccaaggaatcctctcagcccttttatgtccttaggtactggccatttactcatggcttccagcttgctaggatctgcttctaccccttctccagaaatcaaatggcccaaatactccaattccttctgaccaaaaatacatttttttctatttacatataattcctgctgttgcagtttctgtaaaactgctttcaaatgctcttgatgctcctttaagttcttgctgtacaccaatatatcatcaaagaaaaccaacacaaatctccttaaaaatggtctgaaaacttcattcattagtgattgaaaagtggaaggagcattggtcaacccaaaaggcatgaccaagaactcataatgcccttcatgagttctaaaagctgttttggccacatcctcttccttcattctaatctgatgatagccagaccttaagtccaacttagaaaaccattgtgcacctccaatctcatccaataactcctctatgacaggtataggaaacctatcaggcactgtaattttgttaagcctcatataatccacacaaaacctccagcttccatcttttttcttaaccaaaataacagggctagcaaaagggctattgcttggcctaataataccagccatcaacatctctctaactaatctttcaatctcatctttttgataatgagggtacttataaggtctaatattaggaattttagtaccttgttgcaaagtaatagtgtgatccttctctctttgaggaggcaacccttgaggttctttaaaaactccttcaaacatcttcagtacttgttctaccttatcaggtatccattctgctccttgtttctgttctgcagttttaacttccaacataaacctctgctcatcctcttctatacctccttttatcagtttcatactaacaaccgatttaagcaattcaggttcagccttaagcacaacctttctattctgaaccttaacaatcaaagtgagcttatcaaaattagccttcacttctcccaacccagccaaccactccacacctaaaaccacatcagcccctcctaaatcaaataagtaacaattttgcaccacatgcagcccttgtaactccatttgcaatgaattacacaccccttgacagcttattttatgtccatctcctacctccacataataagttttggtaggagtgacttccaattttaattcctgcaccaatttcatagaaataaaattgtgagttgccccacaatcaatcaagaccactaccttcttatctttgattcttccccatagcttgagtgatcttttagaagtaaatccctcaatgctatgcaatgacagctgatgtattttccccacctcctcttcttcacagcctccatgattctccatttcatcttcactctcatcctcctccaaaatcatcacccttagctgtttgtttttacatacgtgtgtgggatggtatttttcattgcaagtaaagcattctcccttacgcatcttctcattcacttccaaaggagacaatctttgaaaagttttctttttgtttgggccctcaccacttgttttagccccgctactaacttccactgcccttccacccccttgctgccaatcttttccattcctggacccagtaaaattagatttggccacaggaggtatccactttgttgatctaggtaccctctcccatactctgtttttctcttcaatttgtctggccttcagcatagtatccatcaaggttttaggttcatgtaacctaacctcagtcccaatttcttctctcaatcctttcacaaatacttccattaaaaaattctcacccaaacctttaccagcacctacatgtttctcaaaaagcccaatgtattcttgaacagattcctcttgctttaaagataacaaaacctggaagggatttcccaaattggagctttgaaatctttgtatcacagctgttttgaaatcttcccatgactgatgcgcactccaattctcccaccattgataccaagccaaggcctctccctccatagctaccaatatcgcctctaacttctcttcttcactcacatgttgtaacaggaaaaaccgttctactcgcgccacccaacctatcgggtcttcccctgaaaaaattggcatctcaatctgccgccactgtcgcgcctctagctcctctctctcgcgattcttggttcttgcttctccggcttgcctacgctcttccctcgtcggtggttccagagtcgcagccaacctttgcaatattctttcgattccgtctaaccgggtttccatcttgacccggttagcctctgttgcgacccgataagcctccatggcctcgcgatcaatctccctagcctcgcgcgtctcttctagcgctctctccatcacgtcaattctggcatccatcttgttgttgtttttcgtacccattcacctcacaggctccaggagtggagctctgataccagtgttaggtactggtacagaatatagagagaacaaaaatgctttattcaactcacaagcacaattcttgattacacagtggcttcaagggtcacaacctccaattcccccctcttttcctctccgagctcccctcttatacatttctctctaaaactgttatttataactaactcagcttagttatactaactattaaattgctatctaaacccccttgcataagtttgaccccacctcctatcagaaagcttccttcaaacatcacccacttgaatcagcttcaggttcttgatttatcctcaaacaagattgtcagcaagattcctgagacatcagcagcttgaaaaagctcgaggttttgaaactgggaaggaatagcctctatggtgcaataccagcatctctagggaacatttcttctctcaaaagtatgagttggggcaccaactttctcagtgaccggattcccagtgaattgggtaggctccatgggacggttccacccgctatatacaacttatcttcccttgttaactttgccttagcttcaaacactttgtgtggggagagattcctcaagatgttggtcaaaaacttccaaaactcatagtattccgtatctgcttcaattatttcacaggtggaattccaagatctttgcacaacctcaccaacattcaggtcattcgcatgtcttccaaccatttggatggaacagtgccacctggtttgggaaatctcccatttcttcgcacgtataatattcggtataacaggatagtgagttcaggtgttagtggtttagacttcattagttctttgacaaacagcactcacctgaaatttctggcaattgatggcaatatgctggaaggtgtgattcctgaaaccattgacaatctctccaaggatctcacaaaattatacatgggagagaatcgtttcaatggaagcataccctcctccatcggtcatctaagtggcttgaagttgttaagctacaattcaatctccggagaagttccacaagagctaggccagttagaggaactacaagcgctatctctggctggaaatgagatatcaggaggtattcctaacatacttggtaatctcctgaagttaaacctagttgatttgtcaagaaacaaacttgcgggaagaatacctatcagttttgggaatttgcataacctgctttacatggacttatcaagaaaccaacttaacagaagcatacctatggaaatcctcaatctcccaactttgagcaatgtttggaacatgtcaatgaacttattgagtggaccaatacctcaagttggcagattgagtagtgtggcctccgttgacttttctaacaaccaattgtatggtggaatccccagctcattcagcaattgtctcagcttggaaaaattatctttggccaggaatcagctttcaggtcccattccaaaggctcttggagatgtgagaggcttggaaactttggacctatcctccaaccaactctctggaaccattcctattgaaattcaaaagttacttgggcttaagctattgaacctctcgtacaatgatatagatgtagccattcctagtggtggagttttccaaaatctctttgcggtccatttagaaggaaatagaaaactctgcttgcatttctcatgcatgcctcacggccaaggaagaaaaaatgtaagactttacataatggtagccatcgtgttaacattgatactatgtctcactattggcttaatactatatatagagaacaaaaaggtgaaggtagcaccagtagcataatttgaacagctaaaacctcctgcaccaatggtctcttatgatgagctttgtttggcaactgaggagttcagccaggaaaacctattaggagttgaaagctttggctcagtttatgaaggccatctaagtcatggaactactgttgcagtgaaagttcttgacactctaagaactggctctttaaagagtttctttgcagaatgtcctatgaagaactcaaggcatcgaaatttggttaagctgatcacatcatgctgtagtattgactttaaaaaaatgattttctggctctggtctatgagtacctgtgcaatggtagcttggaagattggatcaatgggaggagaaagcatgcaaagggaagtgggttgaaccttatggagagactgaacatagctatagatgttgctagtgcattgcactacccgcacaatgatagtgaaattccagttgtgcactgtgattagaactcttctctggtaaaagcccaacagatgagtgtttcacaggaggcctaagcataagaagatgggtgcaatcaatattaaaaaacaagacagtgcaagtcattttcatgatgacccttcagagggaccaaatgtacaactcaattgtgtggatgcaactgtaggggttggcatatcttgcactgcagacaacacagatgaacgcattggtatcagagtagctgttcgtcaactaaaagctgctagagactctcttttgaatcagtctgatgacgtgagtcttacagaaacattgaccgtactgccacggtcaagaaaaaaaaataccaaaatgccacgcctacagtaaattttaccagactgccacgcggcctatttcgctggcataagtagcgaaataggtgggctgacgtggcgccccagcagtggctacatatttcgctggtcagaccagcgaaataggtagtcaaagcgccagactgacatggcagagcagttatgtcacgtgtcctatttcgctagcctccccagcgaaataggcacgcagttattgaacggttacgccacttggcctatttcgctactgcctccagcgaaataggcctcatttactgacccgttacagcaacgtggcacctatttcgctaccatgcccagcgaaataggccacgtggtccccctataaaatcccccctcccccctttcattttcactctttcccttttctctcattttcgaattttcttctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgtaattaatttaaataaatttattgtgttaatttataggtattaggtcataaactttagattagaggaggattagagtatagttagtttttaggttttaaacattaggttagagcaaaataaatatgtatgtcttttgaaacattaggttagaagaattatatttgagaagttttgaacattaggttagaggatcatatatacttgttatgtttgcaatattaggttagatgataatatatacttgttatgtttattatattaggatacaggatcaataattaaaaattagagttgataatgtataggatagagannnnnnnnnnctcattttgcatatactctcaaacacatatagctttctcactttgcacaagaattggacagcttcaatacgctggggtgggagtttaaatagggggggtgctgtagtaatccgctacatgggctagcaaaataggtaacctatttcgctaggcctgacagcgaaataggtaaaagctgccacgtgtgcttaattcgctatcacgcccagcgaaataggttacctatttcgcttgtcagggcagcgaaatactcccagccagccacgtggcgtgtctgctctgccatgtcagtctggcgctttgactacctatttcgctggtctgaccagcgaaatatgtagccactgctggggcgccacgtcagccaacctatttcgctactgatgccagcgaaataggccgtgtggcagtctggtaaaatttactgttggcgtggcattttggtgtttttttttcttgaccgtgacagtacggtcaatgtttcgagtcttacacctactagtactagagataccaagtcttgcgtccatgtttcagcaaagtgaactgttccgagataggaaagagtcagatagatggttggcaccgtacggtcctttacactttgcagccatgtttgacaaatactagtagtgcacaagttgaaacgttcgggttgaaataagcgcaaagaataatatataatataataatacttttgttgaccatgtaatgatcaaatactttactattttaggccaattaatcgctctagtcatgaatggtagaaattgagacacatttctgccgccaaccttgtcaattataaaacttatgtaaagaagaatggtggttgatggcatataatttgttcaaaatgtaacatcttttcctttttgtattgtgataattattagtactttttatccttgcaattattaatggattttttcttcttcacattaaaacaaaaatttattttagttaattttgaaaaaaaaacttacaacttaaatataatttaagtcttgacttattaaatatattatttgtcttcttgaaatttagtgctatgttttagaaaatccaattttttttttatataggaaattaagagcaaacagccctcttagaaaggttataattagaaaacttgtaatttaagctgtacagattttttatatgactttgaaatagatttccaaaatttataccaattacggttctacgtctctgggtattactttattttacattacatctattcaggctaccaaaggccaaaagtgtcttaacctagtcttacgtgtaagttattataaaccttaagttacttggtttgattcctttcgatcaaaaaaatttaagccccttttctttctctcttgaagctaacatgagtttgatgaagcactgaaaccgttactcttgtcctttttctgcgaatcttttgaacctatttcagttttcactctttatttgttaatttccttttattttcccgctagcccaatgcacgttttctatcattaatttaattttgtttcataattttttttctattctcggtgacgccatattgcttggccgagacagaagattgtttaaaacttcgttgcgtcagagtgtgacaatcagaactgcatgtacatgtagttccaaaaaatgtcagtgttgtggctagagagaaaatttcatttgaaggatggtagctgtgcttctgggctaggcgcgcgcaacaactctaggtatattctttttcttcttccaagcagccatgcatgcacgttggattaaggattggtctatcacaaaactaaatcaagattacaagagaaaaatatatataaccgatattaatatgaaaataatgtagcagtggtaattagaatatttgtattcatcattagtgtttcttggactcagatgaataaaataataaccaaaacaatgatagtaattaataaaaaagtaacaacaaactaatattacattttttaaaactaaagtcagatctcttaatcaaggtgttagattcaagtgatgaaaaaatatatcgagagaaaaaattctatcaaaaatagttagtcgagtttttttatcaatattatttatcaacagaatttatagtataatataacaataaaaggaacaacattactaatattattaattattccaaaaataatagtaataataaaaagttagacttccttgctaaaagaattagtttctactctcttgtcaatagagagatatcctggtgtaaataaataatgttattgtaaatcaaaataaactacttaactaacaaaaaacttaattaaaaatgcttgaattaactgataaaaaaaaattgcttgaattaatatataagcagtgccaataatcatctttttcgcacaaagtgtgatccaccattcttctttatagtcataagtaagttttacaagagatagagttacacataaacataaacacaattgttatttatttaattaataccctatttaaaggttggtggtcgaaatgcttctatttcaaccatacatgactagagtctagggttcactttattgaaacatggaagtaacgcttggtatctcttgtaggactctcatcagacagtttcaaaagagagtctctagcagcttttagttggcgaacagcatctctaatgccaatgcgttcatctgggttgtctgcagtgcaagatatgccaactcctacagttgcatccaaatatttgagttgcagatttggtccctcagaagggtcatcatggaaagtgaaggacagcaacttagggtcaatgacttgcactgtcttgttttttatggctgattgcacccatcttcttatacttaggcctcctgtgaaacactcatctgttgggcttttaccagagaagagctctagtaacacaataccaaaactgtatacatctccagctgcagatggtttctctccccatccatactctgcattgggcaagtaacaatactaattatttatcatgtttcacaatttgtaatggaattaattaaaaggttgataaagaaaaagttgtaaggattctaacctggaggtatgtaaccaattgagcccctaaggacatgagtggagctaatggaaacttgattagttgagttttgaatcagcgacctagccaatccaaagtctccaacctttgatgtcatgtcttcatccaatagaatgttgctaggcttcaaatcacagtgcacaactgggatttcactatcattgtgcaggtaatccaatgcacaagcaacatctatagctatgtttagtctctccataaggttcaacccatttccgtttgcatgatttctcctccccttgatccaatcttccaagctaccattgcacaggtactcatacaccagagccagaaaatcattgtttttgaagtcaacactagagcatgatgtgatcagcttaaccaaatttcgatgccttgagttcttcatagcctcacattctgcaaagaaactcttcaaagagccagttcttatggtgtcgagaactttcactgcaacagtagctccttgacttagatggcctttataaactgagccaaagcttccaactcctaataggttttcctggctgaactcctcagttgccagacgaagttcatcataagagaccattggtgcatgaggtttcagctgttcagatgttgctgccgctgctgttaccttcacccttttgttctttatatacagtagcaagccaattgtgagacatagtattaatgttaccacgatggctatgatgatgtaaagtcttgcatttcttccatggccatgaggcatgcatgggaagtacaagcagagttttctattgccttctaaatggacatcagagagattttggaaaactccaccactaggaattgctccttctaaatcattgtacgagaggtttaagaacttaaggacatgtagattttgtagttcaataggtaaggctccagagagttggttggaggacaagtccaaagtttccaagcctttcaaatctccaagagcctttgggatgggacctgaaagctgattccgggccaaaaacaaattttctaagctgagacaattgctgaatgagctggggatgccaccaaacaattggttgctagaaaagtcaatggaggcaacagtaatcaatctccctatttgaggtattggtccactcaaaaagttcatagacaggttcaaaacattgctcaaagttgggagattgagtatttccataggtatgcttccatcgagtttgttgctggataagtccatgtaaagcaggttttgcaaattcccaaaactggtaggtattctccccacaagtttgttttttgacaaatcaatctggtttaactttaggagattaccaagggagtttggaattcctcctgatatctcatttccagccagagatagctcttgtagttcctctaactggcctaactcatttgggatatctccaaagattgaattgtagcttaagtttaacaacttcaagccacttagacgaccaatggaggagggtatgcttccattgaaacgattctgtcccatgtataatattgtgagatccttggagagattgccaatgctttcaggaattacaccttccagcatgttaccatcaatagccagaaagttcaggtgagtgctgtttgtcaaagaagtgatgaagtctagacctctcacacctgaactcactatcctgttatagccaatattatacatgcgaagaaatgggagatttcccaaaccaggtggcactgttccttccaaaaggttggaagccatgcgaataacccgaatgttggtgaggttgtgcaatgagcctggaattccacctgtgaatttattgaagcagaaattgaacactaggagttttggaagtttttgaccaacatcctggggaatctcaccccacagagagtttgcagctaaggccaagttgacaagggaagataagttgtatataacaggtggaacagtcccagtgagattgttgagagtgagatcaagctcaatcaagttgtggagcctacccaagtcactgggaatccagccagtgagaaagttggtgccaaaacttatatttttaagagaagaaatgttccctatggacgctggtattgcaccatagaggctattccttcccagtttcaaagcctgaagcttttgcaagctgctgatgtcctcaggaatcttgctggcaatcttgtttgaggataaatcaagaatctggagctgtttcaggtgggtggtgtttgaaggaagctttccttctaacatgttagtgctcaaatttagaactctcagattgaataggttgccaatttggtcaggaatcagtcctatgagttggttattctgcaattggagggactgaagagaagagaggttaccaatataagggcttaagtgacctgagagtcccaagcctgaaagatcaaggcctgtcactctttggccatgcttgtcacacaggacaccagtccagttgcagggggatgaattatggttccaagaagataaagggctaagagtgtcattactcagttgagatttgaatgagatcaaggcttctctgtcagaggtgatgcttaaagtggctgatgatacaccaagcaaaaggttgtgtagatcaagaaagaggaaaaagagtaataaggcaaaatgaacaggtaattgagaaaacaaagccatactttgctgtttgcttcttaggtttgtttatgatattaatttcttactaagatgtgtatttataatagttcggctgcagctggcatgcaatgcattgcttagcttttctctttactagatatttacccgcccgttacgcgtacgcttaaatatttgacaaatagtgtatatagttatgactcatgagtaatgatcactaatgatataagtagtgatattttcacatatcaatatttcattaacaatttttttttaatcacattatttcatctatcatatttatatttttctctttttttttttctttttcactgggtgtctgcaaatattttggtatcaaattatatttttcctaatgatatatgggtacccatttatcttttagccaaaaaaaatggatactcatatttaatacctatttgacactttcttttcctctatttctctttttttatatcaaattatattatttgtcataatttatacctgtactttttctattgtttctctttatatattattatccaatacttatactttaaagtagttttatattattatcaaatgatataagtttaatgactcttctaataactattttataagttatacttgtactaatttatgattagttaattatataaaattttactttaaccatgcatagtcattaaattcaagatatttttcttttaatattataattgttacgctaaagtaatatgtaatttaaaattatgttttgataataatttaaatttaaaacagtgtccttaatatatatattttttctttatcctaacatttttttgttgttgatacttggtgctttgatctcatgtagacaatgaagcagactaattccattatataaataggttattcaggaagaaaacgtcagtaacttacattcaaaagagtaattgaaatatcataatgaaagaaatgtaataaattatacattaagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatattataaataaatagataagtatatttatttaagagtaaatcatatataaactaatcgatggtaaaagatttttatattatacaaattgtcgatatatgatatatatatgataattttgttgaatttaacaataaataaatatatgcttgtactattgcacaatttttacaaaaataaaaaagagaggaaaaaagtgaaatgacaattaagaaaattctgaaaatttatttagccaacacgtggagataagtggagagtttttataatattattgattatcataaaagtcatatttattatttttttattgcttgagtgtgtcattttttttttacattgacatgcatagaaattaaactttgttttgattatagattcttttaaaaatatatatatttgcacaaaattgtatatattttaataaaaaaaattgaagtgcgaagtaaaataattaatataattgaaaaagattaaaataatattataaaaaagtatatgaataatatagttctatcatttacatgtaaagccctgnnnnnnnnnngattatcataaaagtcatatttattattttttttattggttgagtgtgtcatttttttttacattgacatgcatagaaattaaattttgttttgattatagattcttttaaatatatatatatatttgcacaaaattgtatatatttttataataaaaaattgaagtgcgaagtaaaataattaatataattgaaaaagataaaaataatattataaaaaagtatatgaataatatagttctatcatttacatgtaaagccctgttatatataatttttttttaattttaacctttgttttatctattatgggacatatatcttacaattttctctctcatcttcttgtggccttttctagtataaaaatcgaactgaattggccgatcagaccaaaaaactggtgaattgatcttatgaccggttcaaataatcaataaaatcaacttgaagaaaaactggttagaatcggagaaaaccagtcaataatcagcaagaaagaatgctgcagagtgggtccagaaaaattgaattttaattcttaattaaggccaagaagatattatcttttactttttaataaaaaaatattatcttttattttttatatataaaatcccgaggtagtatctttttctccagtagaaaaagtcttatgtaatagttaatgcaacaggtttttggacagcatagtcaatgcaacattaaacataaataaaaacatattttaataacaggtgtacttttaacatatgtcacataaatttgcatatatttaatgttaatataaagtaactagtaagctactaagatccaatggtttatatataataaagagaaatataacctcaaattttgttttcaacactgtttttggaattgattttaaaaaaaaaaatcaattttgatgaatcttatatttaaattatgaaataaaatcatcaaataataaatatgactcataaaatttaataattttaataaatttaaattaaattttagttgatcacattaataataaaaataatatcgttaacatttctcctaataaaatgcgttgtcctcttagcggtaaaacatcatacataatagaattagtttcttaattctaacaattaaaaatgataacgcctaatgttggatatgcctctgattatttgtaatattttacttttattactagtttgggctagaacccatgaatagttactgttagggtttcttttaatcttatttatattccctttgtaaaccgtgtgatttgtaacgagtggcggtgaggtgattatagtacagacaagttggacgtagcctacattgggtgaaccaggataaatcactgtgtcatatctctcttccttattctctttttattttttcgatttgtgtgtgattgtcgatttccaacacctgaatggtaaactactcagaatttttagagattacttaaagaatatatgatgtgaaacttgtctaacctttacctcacgaattttttttgagtaaaatcataaatactacgtgtcactatactattattttttcaatatgacattaaacacctaacttatttatatattatattttgttcttaatttttttatctttggttactgttaatattaaagttttccctttatgaaatattcatattatattctgcgcatccttgaaaatctgagggtttttggactgctattgaaaatctcttctctgtccctatctcttctttattagtgtgctcaaattcattcaatcattggtaaaaaaaattatagcaaaatccttatacttatttttaccatagcaactctcaatttatccttaaaaaattctctcaaattacaattattattttccaagtcattaaccatcaagcttccaaatgcactaaaattttcactgtctttttttttaactacatgactggtcctacatcgcgtctatatttttcttcttggggctctaattatgcatattctagggtcaatgcacattttttgaggaaaaaaaaaaaaacaggagcgaatgttatagctagaaaaacgtcattggtcaaactgacacatatgagtaaatttggaggcgtgtagaacacttaacctactacatttgtgtttgacattgttagttgattaagaaggtgacaattggattaacttgtgaaccacgattttcaattttagaaattgtttttaaattttgataattgtaggaactaaattaacgtacgaattttatgaattttagaaatcctacaatttcatgctatattaaaatgataatattttatgactaggctatcatgtgtcaggcaacatggttgtgtcacattagcatgtctaatgttagttgattagaaacgattattagacatttacattttagacgattaatttcatcaacaatgtacaatatatttccgaaattattttgaaaatttaataattttacagacctaattatcttaaaatttgcaactaaaatgataattttgataaattaatggtttttgcttaatgtatagttcttccgacttagtgaagatatagtccagcagatttactcaagtatattgttttctaacatgttgaagtaactcccacgctaacgcacctcaccagtctattcaggttgggagataattccgattgatatctaaatgattggttatccgtttgttttatactaaatgttgggttatgcattcattcactacttgtctacttttagtttatatttttatcgattaatttcaaaagaataccaatattttcaaaaatgcatttatatttaagatgatgttaaaacaagtttaaaacaaaaaaatactttaaataatagcaagtataaatatcttgaaaatataaatatgttttttcaaaaaaaaatctcatttaaaattaattctattttttttatcatattattgacttaaatcaaaaacttgtttaagagaccgagttcatttctcagattagtcatttgttggttaaaaataaattatattagttatgaaaataattttttaaattctatctaaaataattctactcaaattaaaaaaaaaaagttttgagaactcaaaaagataatctgaagaatccaatttattggccgaaataattggcaaacaccaaacaatgaagttattggattataaaaatagcaattgaaaagccaccgaaaattaaggtaaggtaaatgctcctagttaagagcgtcaggcaaaacgccaagttgttgagaaaaatataaagaaaccaaaagtctgggtcaaggattgtgttgcattccacaatgcaaggtcaaggtgatagtgacagtgaaagaatttggattctctgcagtctctccacggctagccatttatctatctctctatgtttcctttacctttcaatatgaaaagattaatgtaataaaatatattttaaaatatttatatatgagaattactaacacactgacacttcttttccagttagagtagattagtaatctacaccaaaatttgttttacaaaaaaaatcaatccttccactactttaataaatatagttaataactcaaatttgtttgtttaaaatattatttctctctcttagtcgcattcaacaaactcaggtgtgagcggttcttttggtgtgcaaatgagaattgttgatggaagagtgtggaccgatgacaaatttggagtaagaagatgcatgcaaagtttgaaactttgggttagaccaacgtgagggatggaaccgagagacaggagagaatgatcagtggagaaaagagaaaaatattatttctaacaaacatatttcaattactataatacccttaaactacatttttttaagtagtggaagtgattgggtttttttgtcaaacaaatttgtatattactatatcactcttattcgttctcatttgaattctcctctacctcttatcaagtgtgtatttaacgcacgtagcatgcatatgatacttttaatatcaagaacgagttaagtatttaattgttcctaaatatcaaaaactaatttcatatttatatcttacaatacactttttaacatgcattcgatattatagtatctcttatgctttttacatcaattgaataatttagctaaacattttatcttttttcaatctattatttttaatatatttaattctaactttaatttcaatatttttaaaataatatttttataattaaaaacaataatatatcataatataaattatttttcataaatctaaaatataatttatatgtaaaaaaattatttattacatattttaattataatatattttatatattttaaattatttatttatttattatcaattttaatcatatgaaataaatattttatcatatgtaatgtgctgcctaaaatgccagtttagttataattttccttgtatcctctccgtcccaataacgtcatgaaaaaggccttgttgacaaaaacataaaagccaaaagtcagggtcaagattgtgttgcattatataatgggaggtgataatgttatgaaaaggtcaatgcaaaatataatttttggaatatttatattaaataacaaaattagttataattttcctaacatcctgatttcttcttttaggtaaatttctagaaacacagggaaaaaatcatagttttaaatttatatatatatatatatatatgtgtgtgtgagagagagagagagagagagagagattaaaatcagtttttgaagaagttaatatgagaaattaaagcttctataaaaaaaattatgaataaactaattttaatataagaataaaaaatttccttattttttcacctagaagttcttatagataaacttatccaaatatcctcttactaatgactaaaatttatttcgctgacaaaaacaaaacctcttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagagaaactttaaaaatgactgtttatacataaattaatttaatttttgaaaaaaatatttttcttcttctcataataagtgtttatggaaaaattatccaaattaatttaaacatgaccattggagctcaaatatcttttggctctttgtgagagaaattagagaaaaattaacaggagaactttctttcatacataaacaaaattgttttattacttaagattttgagttgtcacatagtaaattgttacaaatattttgaaataattaaaatccaactgttatttcaacacagaacagatttttaacgtcaaggatgaaaaaagaaaactgaagtaaatattggaaattaaaattgtttaatttaaaaaaattaaaagtaaaaagttaaaaaaaaattcagaactaaaaatataattaatccaaaaattggttcatatgtccaaaaaggagtttttttttttcctggtgagggcatttaatttttttaacaggagtgcatagtaaatagaatattctatttcactatgaccttacgagttacgttgctaccgcaacagcaatagaagatttccatttaagaagatggaaggttgtcttgaacttgaaggatgaaagaagggataggtggttgattataattttttttattaattattaatatttatggataaaaaaaaattcatttcactttaccttatctaggagatacgttgcaacttgcaattgaacaccaatgccataaggtcaaatatgcattttgacagaaaaatgaaaatggcacaccagcaacagcaacttatgtattgatatattgacatcatgacatgtgtcgcaatgaaaggatttgtaaacagaccttagtttcaaattttaatcttgttaaaatttatgaatttttatgtggagatttaattgttgtaaaataagatttgcatctattttaaaaaaatatttttttactcttttttttcataaattgatttgtatttagttatttaaaaatcttaaaatatgatatattattgaaataaaaaataaaaaatattttaaaattaatataatactataaaatctaaaaagaaagtaattaaaatctaaaaattgagatcttctattacatatactttaatagaaagatttctatttttacgtggtccttacgagatagtacgttgcaatcgaacactaaatgtcatatcaaggccaaacattttgataccgcagcagaaaacccacttccagtagttttcttgtgttgaatgatttccaccggaagtagaattcaagtcttcaatgcattaaattaattcacattaatgcatttgaataagtcttcagggaataacaaaatttggactcatatttatcacagtgcgcgtctaaaatatttacttttttcttatttgtccaatttgaaaaacaacttatttttactgaactatttaattattcaagataatattaaatagtaccatttaattatatgctcttatttttacttaattcttaattattttatatgcttttcatatataaaagacaaataattaataataaaaattatattaggaaatttaaaataatttcaatataatatatttttgtgggtctattcaaataaacttttttactaatatttaggaaaagaaaaaaatataataaacttgttcaaagtctaacccgttttgaggtgatttttagttgagtttattttatttttttaaaaaaaacaagattttagtttttaaatttatgttttttattttatttttagtttcaaaatatacttattttttaaaagttttttattttattaaaattaatttaatagtgttttttgttgcgatgactatgattacattaataacaataatgatattgtatagtactaatattgataaaggtgatggagataatagtgactatagtggtagaaacatcaaaaaagctatgtcaaatatagaaagtgagtgttttttaaattaaaaacaaaattgataaaaaaaaatcttgattttaaaaatgaatcaaaatcatttcaactttatttttatcaaatgagttttattttcaaaattatatttgataaccaaaaactcacaatcacctcaaatagatcctaagcttatgcacaagttaatttaaaatatctctctcaaattaacttctctaaaagtttatttttgaattatgtataaattaattttaaaattttaagtttattttgttcttctatgaatgcttaaggaaaaaattattaaaacatgtgataaggctttctgaatatgttagtgttgggttagtacatacgtttggctatgtgagtgctgaatttagttgaacaccacttgtttgatgaacaaaatctgaatagaaaatgtttttttttaatatattgagtaaatggtgtatgcttttaattaagctgcttccaaagatgttggatactagtttcatgccagcaccacaagttagcaactaattaatctttattttatctcgagtgccaggtttgaaatggcacaaactctcgggtctatatgcgtcttgcgtttataaacaaactcgtttcgatatgctcctttaatgtactatttaatttggctaagaggttcatatatgttttaggaattgaattgttgaaccatttattattgacccgagcatgtatttcttcattcattgcccaaaaatcaatacaaatcatgcaagtcttcaaggacaaggacatagcatacgagcattcaccttgaagggtccatgtcgttgacattcattgccaatgaccttaatttgaacaaccttgaaaaatctttcattcttatctttttattttaacaagttttgtgtgctgtggtgggattttgatgcatataaatatataataaaagttacggaggtttgttaattatgttattggttcgcttgatacagattttgagcgaattttgtactgtgacaaatacatttcctcactaggtggctgtacaggctgctttatatttgtatttgtgtcgcgataagtatgatctattccttacacatgctactgctgcatttcaactttttcatatgataacctcacacctccttgatttttgtttttaaattatttgtttgcataatctgtcagacgagtttatgaagtgccattccctcaaaagttatattttaaaatactaatataatttaaaatttattttgatgtattttcaatgtaaagatagataaccgtataacaaatatttatactataatacttctaatcaaactctataatttatgaaaaaaacaaaaatttccaattaaaatttgctgtgtttccaacttatagtttatcatagtgatcaaagtgattatcacagcaatataacacagtgaaaatgagcttatttctaaattagatatgtttacttttatttaatttaaagcatatcattaatcttaaccaactaaaagtttagatttttaaattcctctaaaggatcaagtaagaaattttggtccatcaaaaaatatccaacacatttataattggttatgcataataaatgagtaatttattttactctcaaaagtgagttactagctctaaaggttcactttggtaaaaaaaaaaaaaaacgtctagaagtgcatgatccctaaaatttaaaggtaaataaagatggaacaacagttactcaacaaagcatatgagaattcacaattatcactaatcgcttgtagtgtccttgttaacaacttgggctgggtgtcctccaagtgcataccggacaaaaataacccacctcacgtatgcaaccagactatacgacctttttttttttttgagccacagactatactacctaataagtgctgcacaatttggtattatacaaacgtaactttacactattaagtataacgaatgaaaaaatagcttaatacattttttaaacaaagactagattaagaaaacaaagcaaaataaaaaatgaattactgaagaagtaattaaagacactaatcatattaattagctggttataagattttaaaaatgactgccacaggaatgttgacaacatgaccttgattaccatacagcccaattctcccatagctagcagcagaactgttgctggttgcattgaagatcacagacaagactagtctccccccacttgcaagagagaagtgattaggagacaccttcatagacgtgccatatggagcactccaaccaacattgtatgtttcatttccagcaatgttttggattgttctttgtaccactctagattggttcaaccttgctattatgattgagggcaagttcagatcagggccatatagtgttgaattataagtccagcaattttgaccggtgtagtttagcactgtaggagttgaaccattgataccacataggaatgacatgtagtcatcatagcctacaaagaaaatatgtataaacacatttggaaattcagaaaacaggcttgtttattaatccagcagctttcataaatttgagctagataagtgagacatttgaacaacaatcgttgctgaatttttgaaacatttgaacttgcatggaaattataatgatttgaaagttcattagtcaagtgagacttactagaatcaaaaagcaatcccggatttaatgctgcagtagcattcacaaaaccacttcccatgtcaaagggagttgctggagataggttttggtctatggaggggtatgatcgctgagccattattggcctcccattgttgtcatacagagaacctgtagtggaaagtgcagatccaatggctgcaggactaaaattgggaaacgtttgcttaattagtgcagcaagaccagcaacatgaggtgcagccatgcttgtgccagacatcattgcaaaactctcacctgttagaatagtgtagatcagatattcacatatcagtatattgacatgcttaataaattaaaattcctatttcctagtataaatatttataacttaaaaagatgttatgtttaacttggaacaggccaaataaacaccttaaacttgtttatgttttgttttctagtaaaaataagcttatgtattgacaaacctagaaattcaacagaatcagtggcaacagaactccaagcagcccatataaaatttccaggagctaccaagttgggtttcataatatcagcttcatgaggaagactgtcctctggatctggtcccctggcagagtaatacacaacctttggggcctcagtattgtagttggcttctaatccaccaccaatgctagcaacagccccaaatttaacaattttttttgaatccccatctatttgcagtgaagaattgtagtattgcagtaatatctgcacagttaaaaaagcaaagtgaatagttggtctcagtgtcattcccacacacatgtaagcaaggaatagaaataagttgactgttgacaaatgtcaaatccacaccatggtttttcatgcagatattcggtgttgcttgcactattctccaattagaattggagtttcacctcagtaatttgcataattgaatgtttgcattaaaggattatttagcaggtgaaactccaattctgattgaagaacagtaccaacagcacccatataataaaatacaagcgaaaaaaaataagaaaaaagacagtatacatgtgcaagggagaaaatgaacaatgcaccttggaatcatttgcagatggaattattatgccagccattttcattggaactgggttaagctgaaaagcagacacaaaagggtccatggagaaaacaacaccaactgcactaaggttcatggctgtttctaatgcctgttgaatggtggagagcccaaccacaaatcggactgaatagctacagatcaggaggtttccctggactaaatcctgactgaacttacttgcatcttgacactcaccaatatacatatcatcagtaactgttgtgtttttgttcaaagcatgtcttgcatgaatcagtttaaacatcgtgttctcatatgttccagctggggaaagtaattaaacaaaaatgaaaaaaaattagggtattaataaaaatctcaataggcgtactgatgtaacaaattatacttgcacaaattaataattaaatcattttattgttcatcaaggaacttccccaatgtaacatgattaaggtcttaaaggtaacaaaaagtagttgtttcagtagtgtagtgtccattttaaatcttgaatttctttgttcttggtagggattcatatataaagtatgacatcactttttgaaatcactcactcacaccagatttaccccatccaagtaattactttcccatctgcacttctttgttaatttcaagaccaaatgcccaccaaggccaaaaggccaagtttgtcttaaacaaattcatgtatagctaaccaggattagagcaacagaattttacgtgctagtccaacaccggatatggtcacactatttccaagacatagggagttgctataaactcgatcatgagaggtggcaccaacagtaaagatccatggactgaaggaggacatgctcataggtgatggtccagtattgccagcagcttgcactacaaaaataccagctttcacagctgatagcaatgccatatctattggattgaagaaagttgcgatgcccgaaggacgcctattaggagtgattgacaagcatattatgtcaaccccatcctgacctgcctgtaaacaattgattatactataagccataccataaatgtaaaattggggatacaattaagtaaacagattttgaaaggaacacatgcaaggaaagtactttttacactttacagtaactcttcaattcaagaccatgcataccctcaatgaaaatttaaataaatgaatgaataaatacattaacaaactttaaatgaaaagtaaattatattggatcaacccacaggttaaatttagaatcctaatacaatctatattacatgctcttcactgaatcagaattatttgaagccaataaacaggctgttgaaaaatggataacaataattatgtagttaatcaagcaatcatattggcgagtactagagaaaggaagagataacattaagatgataaaaacaagaaaatatatcaagtgtcaacaaatgacctaaagtaaaattatcaaatattactgacacataaatggcatacaaaagtacagacacctggtcaatagctgcaacaacatctgctgcaaatcctccaaatctcttgtatagtgccttgtaaatggcaatgctgtaaaatattgaaatggaatgcattcaaatgttacatatatagaataaaaattaattatgcttgcatgtaattattagaaatccaggttagaacagatccactcttcattttgttcttgaataaaaagaattacatacaccgttaatataattttctataatctttttcaagtgccaaataaatttacataaattgtcggttactgtacatggagatcaattctatggaattgaagcattccacaggggagaaaaagagataagtgacagagaccaaggcagaaaataaagtagagcatatgacagaatatgtggaaaatttaattatgaatggcaggtaatgtacacagggacaatggagtggtccatctcctaggacagctacctattttggttctgaacctggcccaaccattgaaggagttttctttcagtttttcttgtagaaaatcttgtaattttgagagacaggaaatatttcccccttacttctgaaaatcatattgcaagtctcatttcggggcttaaatgctctaaagcatcctgagcttttgataattaatcaatctcgtaaatatgacttggaaaaatcttctagatgcacagaccactgacttaatacatagaaccacatacccttgcaaggtaataaatatctagaggtctaatattttaactgcattgatatactagcctatgttatcttgaagctcaatgcaaggaaggaaccctctttaagaatatagatactcagctttagcacctagttgagcacttctctgcaaagcaaaaggcattaagcgtttctgagataaattacatctttctatcactagatatcaactttctcttcttttttctcccttttaagtctattggtccatttcatctcatcgtcaattattttccaaaatgacacatgagtttttaacttgtataaagttcaagattagttactgtgaatgaggagccatcccactagcatttccaaaaaattgcccagcaacgaccactggaattccatggtttccggctgcaacagaagctgtgtgcctgttatagatatatcagaatggacattcagtgaaaaaacaagtaaaatgaagttttagttttgtggcacacttaattcaaatacctatcatattttgaacttttgaatgaaagaaacatgattgatagtctggcatgaatatgtaagttcatttttaactttcaagcattggctaaatccatatcggcgagtagcaattccagaccatttttcaatatattttctttctaaactattaaagctaaacaaaacagggggagaactaattgatgagttcaaaattctgataaacagaagctagatagaaatgattcatcaaagttcaagcagagggaaataaacttcaaaaagataaaattatagaaagacagatttgttgatatggacaaaaagaggaggagaatggaccagatgtccaattgtggttaacaacatttgaacacaagactcatttggaaacacgaaacactcacgtgccgtggccatcaccatcaaagggagaagcatagtcctgggatgagttaaatattcctctggttatagcagaagctgcaaaatgtctagccccaacaagtttcctattgcaagaactggccggaaaatctggcgtaacctcacagacgccagagaaatgagcaggaacggggaatggatgttcagatttatcatctgcaaaactagggtgtgtaggatcaatgccagtgtcaacaaacccaatagtgattccttctccagcagtttcaaacccacctgcttgcaaccaagctccctgtggcagacccaaaaattgtggagtgtgtgtggttgcagttctcacagaaaaatccaaaaccacattggacacttctcttctccttgaaagtttttctgccttcaagatttcaaaaatcaagaacatgttggttgaagaagtttaccagatcacaaatacaaaaaccaaaatatgcacaaatggaaacaactcaaacaacgaagcacatatttcttcacagaataagcacacaatcaagatgttgaaaagtaaaaccattccatacctgtcgttgggtaaccagcacagcgaatccattaatcaagtaatgatagctatagagcttcagatatttctccccattaaacactttattcaataacgagtcgtgaactcgggcaaagtacgaaaaacgtttcataactggctttgtaacattctgatgtctgaaaaaaaaaaaaaaaaaannnnnnnnnnnnnnnnnnnnnnnnnnnnnnnnnnnnnnnnntctctcaaatgaatgcacaattaagcacaaaagtcaaaaaattggagactaaaaatatggtacaaagtacaggaatttagagtatcaaacaaatactataatgataaggttttcaaacaacttgtacacgagttgtgtagatactatgacaatcatttaaacaaatgttcatcttatcatcataacacaaatacataacttcaacaagaagtctcaccctcagctataaaaggaatgtaacaattaatacactttgaacacagtttgttaacattgaaaacaaatatgggggggtaccttggtttgtgaactctagttcttctcccagatgaaccatgtctagagttcttgcccactgtgatcaactcatgatgatgatagtgagaagcaggagcttgtctcagagtaacaatgtacacagctgtagttgcatcactttgacacacggaaggtatcagaaccattcccaagaaaaacagtaccactaaatgtgtatgctgtgaccaatgcatgttttccgtttgggttttggaatgcaaagccaaagccccaccaagcatgaacaagagtgatgacaactattgttcagttcagcagcacgtagtaaagtccatcttcaactgtaagacttgttgacctttaatagtatttatgaaagttgagtaaatactgaaaaactgtgtctggttttgcagcttgttctgaagcctgaagtggaagtggaaagtggagccaactcaacaatgatattaaagcaggttggttcggaattaacaggtcaagtatgtatggagaatcttaaactatctcgggtgctgtgatagtgtggagtagtagtatagtatagtagcatagtaatacatacatgaattatttattcaacaataagccttaacatacatcctctctttaattgttgaaatttatgagtttaactaattttcaaatgaaatctattaaataaaaaatggatttcacatatttaatttcattcaataaaaaaatgtattcagaagacacaaaagaaaatgtaaataaaatttagtttaatatttatgtactgaaaatatataaaataattttatattatcattaaatcataaattgtttaaattattttaaaataattactttaaaaattaatgaatttattatacatacataatgaaatgagttgtaattaaataaatgttttaaaaaaatttacattatataactttttctcataaaatttagtgtacgtagattatactgagatatccattgcatactgacttatggaatattgaatgttcctatactaaacctaaatctagataacatttataaagggaaggtttcagtggggcatgtacgtgtagccttcaacctaacattacaaatatttaaggcactgctttttggctgtgccccaaagaaagtggatacataatggttcggtggcatttcaagtgcaagtgcctttgcgcacatgtcatagtgatagtgcacctccacccggtgcaaaaagtgttatctcatagcattctaagttaaaaatgcatgttttggaaaaaaaaaaaaaaattgctttgctgattagttatcattatgagatccacgcatgcctcaattttttactctttggtggctatttgagaccaagaagcaagactgccatattttgataaagttttgttttatatgaaactttttggttgtgaataaaatatagttgaggtgcaatgaccactgcgaagtaaactaataaaatatggtttactaaaaaagttgttgataagactgataaaataaaagattattttaagacaattatattatttacatattttttttataagattactttcttatctcctcccattacattgatcattttctttttttaactagagtatcccagttagaaactaagaactaatctacattaaatctcatcaagtcttgtactcatgttagttgtaacttgatgagttcgagtattaaaaatgtttctgttgataagcaataggtaaattttactataaattttcacaaaagatgataattttttctagtctagcaaatggatgtgtcttctcttagtctaatatatcatgctcataagttattaattttaatatatatatatatatagttttatttatttacttaaaaataaactcactggctttttcggtaacattggtcaaagtgataggccatggtatcattccatctttctccgcactttaggaacaatcttttaaaatatctgttgaagtgcttcttcgaatggcgaaagatcccgattctagctactactacaagcagtttggtatggtatggtatggctttcttttctatttcaaatgatgactttgtgcatgtgtccccaataccagaagaaaggcttttgggtgtgagattctgttccaattgcaattttgtatcaatcccatgaagttccgaaatttcaggattctattcttttcttcaaactttttggacctccaaatcaaaatctgtaagtagttaatttccttttttttcattataaaatatttataaaatctaatctaaaaatgtcaaaagtaatttaaaaaaaaaacaaaaaataatatcaaataatttatagcaacttacttactatttctcaaacaaaaacccttgacaatgtcaagtacctgagtacatttgtaatagtcaaacgacattaaaaaaaagaaaaagaaaaattggtgaattagccgagtcctaactatgcataaaaagataaaaacctagacctaaataaacgagacgcaagtgtaatattaataatagcagataaagattatgtgacatccgtcctatctttgaaaatataaatgtaattttttttctagcttacatcataaaaagtagggatttaaatacaatattataagtttcttaaaactgatcatatctactaagatatatattttacgaaatttaagtggttgagagtttctacatcaaagtactggggagaaactctgtcaagcttctacacttatctcgatcattgccataaaattctctcgttcttctttactttcactctctttttttaaacaaattttcactcactcttaaatttagagttgatagttttattctcatttttattaaattttataacaaatcttcattattactaattagttttaaatcaaatatgaattatctcgttttacagtctattccacttaatttttcttctcaagtaattagaaatacattttattgtaatgttataatatttggtgttagtatttatataagtattttctttgtttatttatgtgttatgggttggataaatttttgtataaacacttttatgagaagaaaataaaaaataataatttaataaattaattcgtagaagttttcttatattaatttatctaaaaagatgattttaaattcatgcataagttaattttagtttatgaataaattcaatttttttattttctttttataaaaataagtttgaaaaagtttatccaaacatccctttcttcatcttagtccaattatcgctaaggatcacattatctagaattttcctctcatttgaggcacctcagaatcatccgtcggatctattttaatttttttttttccagtgttcactttattcaatactcttttatttctaatgtaaaatttaagctatttcttcatttccacaaatccagattactaatgatctgtccgcccaacccgtgactctggcccaaaatttcctcactcccctgtccatcgatctggtccaattaacgttccttccttgtttcccatctccaccccttctcttgggcatttgtttcctgcactcccattattgcatcctgtacctcccattgcattccggaaagctcattctgaaatgcaaaatggattttctggaatgcaatcatagctgtaggatgcaatagcccttctcttgaggcttgagcgtactactcagtgtatttggtttggtggtaagaaatcatggtgagtttagtacaaatgcaactatttgttgcttcctaaaatcatagtgagtttaactctctctcttaatatgactatggcttttgacaatatcattgagagattgatcaataattactacttcagcataatatactgaaaaattatggtaattatgactgtcattgagatattgataggcaattgctactttagtatgatctcattaaattaggataacttgacgtaatggaacatgattattgattaggaaagagttcaaactttctttttttggttaataacctgactagtatttaatcccccaaatcaagcagtcctataagggacttggtgacatgtagtcaggggttgaacccaaattagtttatgcttagaggattattagttatacaggagccacacagagctaactttcctacaaatcagaaaacagcatgtggagatttatgaatgctgtttgcttcaaactaaaatcagatattcaatgtctatcaataaaaaagatcagatattcaatattctgaccaagaaggaacttattccaaatttaactctccatgtattgttcctactcttgtcatcatttatagcagtaacatttgtttttctatttatatacataattggagagtatgaagatcactaaggatgaaacatgtactaaaatactatcaaagctgcaggccaggccatcagaagtaaatgtaaactcaaaaggaaagttggaatgggtcaatggcattagcacctacaattggtccatgtcattatccatctctaagttattgacaccgagcaagtagcaaaattttatctggcctttcacccagcatcatcttcagttcaattggtcactgaaagaaaggacctcactaagaactaaaatgaaatacgacttatctaaagtcagatagagctgagatgttacactttatgcacaagctttctggatttcctctatcagagatacaaatgccgctctccacttagtgaactgtgcatcagagctgaataacttatgcatggcacttaattcatcagaacttgcctttttcaagaatccttgtagcaccaatttcatctcttcaaaagaatcacaacttcctatgatgctatcttgctcctgctttatcaaacaggcatcaaaaagcttagtcttgacatcacctagggagttgcttgaaccatgactgaacttacagtcatcaatggcactgcctgaggattcagagacaacttctttgtgattccagtactcgatgcattgatgattgggatcctcagcttcaatggcctggaaatttttttcagaattgattaaaacatcataagtcaaaacatgataagctacattaaactagttcaagaaaactggctgaagataagatccgaattccaaactttatgactataaatctatattagaaaagaatacaccagtgatattaattttagcaaaacaagggtgtgaatagcttaaacattcatgagtttgcattacctgaataacggatggtgaaaggaatccaaacatttcgtgaccgttaatgctttgcagaagttccaagggaggaagttctatttcaccttgactcctttgcctcttgatttcatgatttagtctgtcaagaactgattcccagcacctatctgctgaggtgtttgtgaaagcctcatttggatgttcttccatggtaacctgaaatatattttactgaatgagaaagaaatatacttccaactgaaaaatgtccatgcaaataccatttaaaatagaataacaagaaatcaattatcacttagttccattatattatgttagaagattgtcagcttccatgaattttcatacagaaactcagcataaacttttctattcaatggaaaattagcagcagctgagtttctccaaaaaaatatccaagaaaaaaagtcttctctgaaaatgtttagcattgtctttaagacaaatgcaccatattttagcagtttagccaacagcagacttgatcaaaaaattacaagcctactgcccctcaagagagaaaaaaaggattgcggagagatacccttgatttttgtaaatgagtaagtgaatttccctgtacaccttaactcctatttatattattaaataggtttaaagtacatatatctacaagcagaaagtagtcgatatgattttaacatgaaacagaaacatcaggaataataccttgaaaataggcccaagaaatccagcatcatagacttcagaaacatagttacaaattcttggtggatcaagaatgctaaagaacttaacacgactcttgaatccttcataaatttaccaaaacaaatgaaatgttaaactcccacaaaaaaaattaaaggcatattacaagcccagaaaagatcctacactgcagcttaccttttggatatattgcatgcttactgcaccacagctttccacaaataacagagcccaaatttacaggctcaacagaaataccaaacttctgcattaagaagctttggtttgtcaacaatatacttgtattggaggtttcaacgtcacccattttagatacactgttgagttgctctcctgaatcagaatgcatctgcagatccaccccaaacaatttataaccatcaagtgtacaagaattttgaacatcccttgaacaagatgaaaattctttgccagcaatacaatcagccccaggttccatgttgtctggttcatttctggcctctgcaaagctgactttttccacatatggaacacccttattatgatggtaatcagcagcatgcagaaaataattttcaggttcaccagacataacatcaatattcaaatccacagaacctcctttctccaccgtaactttatcgtccatgaccaaatctttttcattcaaattgtctttatgacagtctttagtgccatatggtgcactaaaagtttcatggtgaaatgagtggactaattctgctgaaatgtggctgtaagaactactaggtatagttgaatttgacttatcattacttcctgtacaagttgagtttttcccttctttgtaactctgggtttggcaaatggcgctctccacatcttgtttgtaaatgcaagcatcctcagcattagcagaaaccattccagagtttctatttgaccacacttcaatagcatgcgattctccctctaatgcttcaaccaatgtacttagttcattcatagtataacgaaacagaataaatctgttgtccatttcacatgagcaaaacaaatttgagtgtttgagacaagaataacagtcaggagagcacttgcaacctacagcagataggtgcaagtcatagaagcaagagaagcattctctttcctcaaacaaatcaaatttactgtccatcttcagcatctttaaatgagttggaagacagtcaagcctttccttttccatagttatccttgtctgtcaaaaataagggtaacaaaatttggaaaaaaaaaataatgaaatgaagaacaggtatctccatgggaactaaaattaaataataaatgccaaccaaagtgttataaagctttataaatatgtggagtgggttatgatcaaagataaagagtatgcaagaatcattaccttaactgccttggtaagaactccatctttcccacaagcacttctccattttatatattttagattttcttttccatgaagagttagctcttcaagggcatgcacggcttcctgagcacatccaaataataacttgtcatgagacaatgaagtcttacggcactgcaaactgtaaagctcggcagcattctggccatgcacaagccaatcaacaggagccacattcacagcctctgcacagttgaagccacaattgaagccacagtggtatgcccttggaaaggtaacaacaaattcccctgaatgctgaacagtgtgatgtacaggaaccccctcagatttaagaattgatggagataactgagtcacctgctcaaagatgaaatcataaccactagaatcataatacagttcccaaactctatctactacacaaagagaactaaaatatccaagacttgtatgagagatgaacagatgtgctagagagttctggagagataagatagggtcgctttggtagaaacagaattgtcaaagttcagcatactacataacgagagaaaggtcataaaacagataactataccataattttaaaatctttaatggacttgtaaagaactaagggtaacttgacaaatgcaggtgatatgaccaagagcgtttaccatcatgccaaaagcttgatctattagcaaaggtgaaacttttgacatatagcatcctacattaaacgcaaaccattccctatttaaggctttaagccattattaggcaaaagccactaggtcaaacctgaccctcacaaccttttggacatatcattttgtccctcgaagagaaggttcaccctcaaacattaagatgattggaaacatatcaaacccgtgatttgaacccgtgttgactctaattctaaatgatatgaccaatacacttaccacaggacatttgtctacaggaacttatgtgtcgtacagtatacatcaccgcaggacatttgtctacaggaaccattaagttgtttagatgatacttactcctaatcaacactttatcccaaactcaataggagcttaccaggtagattctatactgaactagtgaactttgattcttgggaaggccaaggattaactcttctagaagcttaagttattaagtggaaacataataacaattttatatctacaagatggctcacacaagggaagctaaggcttgaagtgtggatagtgcataagtccatcatacctagtgaaaatagttaggatcataatcttgaccacttgttcatagtggctcaaatactatgtcatggatatcctaaaaacttttctcaagtggagggtcaagaatagtttttcatttccagcacagggagaataaaccgggattttgagagaggggggggggggtcttctctaccttactcataaattttactcataaattgattacctaataactccagtttccgctatatatataattttacaaataaaagtatcatacactaaactaaacaaatgtgtcacgcctttaactaaacaaacatgaagtgacactctgaagtctaaagatttcaaaatttcatcatggttttagtttcttaactttcacaggtggcattaaaagttcctagcaaacttccaacaaaatacacatttagcatccactacaatctctgtttgtttatgaaatctctatattgaaacagaatgaaggcaaccaaaaaactgaaatttaggaggaaagtacaattctgnnnnnnnnnnttctctcttaattaaagtcaatcttataactccaattttatttacttttttaattacaaagtataattgtttttacctttttcattttttattcagcattctcgcttttccaaaattcttttcttttaactttttcaaaacttccttttatttttccaaaaaaaaaatatatacattttctctcaccctctattatatgggttaatgtcccttcctcatgcttgtatttccctttcctctcaaaatattgtattggacttttttttaacagataatataatacatttttgttttatatggtctatgatgcaacatcattgttaatagcttttagattaatttatagtgcaactttttatcatggattttccacatnnnnnnnnnngggtcaagaatagtttttcatttccagcacagggagaataaaccagagggggggggggaggggggggtctctaccttactcataaattgattacctaataactctagcttccgctatatatatatatatatatatatatatatatatatatataattttataaataaaagtatcatacactaaactaatcaaatgcatcacgcctttaactaaacacacatgaagtgacactctgaagtctaaagatttcaaaatgtcatcatagttttagtttcttaactttcacaggtggcattaaaatttcctagcaaacttccaacaaaatacacatttagcatcaactacaatctctgtttgtttatgaaatttctatattgaaacagaatgaaggcaaccaaaaaactgaaatttaggaggaaagtacaattctgagtagtataccaattcattgagtagatttggttgttcttcaaataaatcaggcaagtgctttctcattgcatcttccagacctggagcatggcttccaggtactccataccatacttttgggtcaccccagtgcagataattaagtgaatagaggtgatggtcctcaacatgctgttgcaaggagaaagaaacaagaaaaaggtgttagtttttattggaaagtatgaagatctgaaacaaaagcaatgcaaaattgaagacaatattacttgttttatagctcaatatttcaaacaaatcaacataaagcagtggaaccaaaaatgttgagtgtaagcacaccgagaattctattatactatacatgattcaataattatgcagtttgtagggatccctatctggattctagtctatgtcttacactagttctagtcctttattttctccgctgaacctttaatgaaattatattttttttataaaacagacagattttaaaaatttcaactcagctttcatgaaaaataacttaaactctataactccacagacagatacagaaagtgattaaaaagaaaatcagtaatatcatcagttatgccttaaactttgtttcttgcatagatttagactgaaagaaaatgtaattctcactacttacccagcaaaatgaggaaaagcacattccaacatacagccatggaactacaactcctgagatatcacttccttcaaaacataaggcagaacctggcagtcgcgggaagttattcagattccagccagacagggcatatctatctgactcattcttagttaaggatgatgtcttaggaaaaccacttccaagtgatccagtttccaagtcagctccataatacaccttcaaaaataacagaataatatataatttttttgcttaattatgtgacagtaagactaatgatattatcaatgaaccgcaattagtacctcaacctcatcagttggttgctctattattcgccagtattcaccttcaatttcctccacagagggtttccatctctgctggtgactactatcactaacttttccatattcattggcatcattcaatccaaagtagcaatctttaaaaacattggcatattgctgaaagtctttaagtgtgaagtccgaccctgattggaatccaaacttctcctcaggctcagaagcaacattagcttcagaacctgatttggcagttctcgtatccatgcccatctttgactgctttctacgttttcgtttccttcccctaattttctttctcatgggttccctgttctgaagcaagtcaatttgctgaatacgagtgggaaattttgcattttcccataaatctttctcctgaagagggcaaggtggtacccagcaagctggagggacaatcctacatatgccataaggttcagcttgggggcgaatcttagctatgtaaccaagtgtgtcttcaaactcctgataagagtataaacaaaaatttaattcaaaatacaatataaccaccaccaaaaactataatactatgatagtgataattataagtacctcaatagttggataaaacagaggtgcttcatcaactataggccggcatgcttcaaccggatcccatctggctgatatctgcaacatgacaacaacatataaaaaaataaaaactacgtatcccattgcccggaggctccacgctatacgcagataaaggagagggatattgtacgcagccttatccttgcatatgcaaagaggctgtttccggattcgaacccatgattaacaagtcaccaagacatcaacaagtcaccatgacaacaacatatatgcatagtaatttttaaatcatttttttctattgaatatccaaactgatatttattcaccataaaaaatatccaaactctataggaagacaaattcacagcacagtagatcatgctaaatacctttctatgtcgtggactgccagaagactcaagtgtgttttccatttctggtttatgcctaagaggattatcctgcaaaatatcacatgtatgaatgctaaatttgttgactctgataaaaaatgattgggagaaacatcaaagtctagcaacgtctaacacaaaatgtcctttccaaaggatttattcaaacactgtaacagattaatttcaagcatttatgttgctacaccagctagaaatcatgtaaaatttatggagtttcaggtaaaggcagaacagcgactcaatcatgcagttactgccatctaatcttctaaaacaagttatacaacattgatgcccttcatttgcttatgctggtaaggtataagcagtgtatgccatgagacagatttaagtttgattgaagcctcaactagcagtattgactcatcattgatgcaaggttggagatagctctcagaattcaaagacaacaggatgcaatcttgtattaaaaaaaaaaaaagaaatcggtatcaaatgtaaaaccaaaacggttttcgtactttggcatcattcaggttgcttacatcatagttgaataaatacacttcaaacggttacaaaaagattaactaaatttaagtgaatcacatttttatagctcaaaaaaacatcctcatattttaagctttaataagatagactcagagagcattagattagtattttcaaagttcaaatgcatgcaatgctcttgaaaccaaataatgtaaatgcaattcaatacaaaacaggaaccatcaaaagattaggcgatccaatgccagacataataaaacattccggaaagctaaacaaaccagtcaccaccaccagggtgagaaatttccaatctttccaaaccccaaaaaacgaaaagtcacataacatgtaaagaccagcctacagtaaaaaaaattaagggtttacaattcctgagtaaattaacatcatccttctgaggagcagaaattagcacaggaactaaactagtaatatcaaatattacacaagcgaaaacacaatcacaatgtcttaaacataatgagaaaagacaaaaaagaaagaaagcaatgaaggaaggaagagatacacaaaaataacaacagttttcaaattccataaacaaagaaaagatctgaaatttgtgatgatccataataacagaggatggaaaatttgaacagagtagcagcacatggatgaaaagcgctctagaacacgtaccacattgtcaaggtttaaaatttaaatcacaaaatgagaaaaaagaaagaaccaacctcttcggcgtgagattctgcagccaatttcaactgtttcattcaatgcaaaatgaaagataaacccaattgaataagttattgagcctgcaacaagaacagagaccattgtaactaaccttatcagagtcccaattagccaaagagacattccacaaaacagtttcccacttatctatctattacccaactaactgaccccaaacaaaccttaaaactgctaaaaaaaaaactacaacaaaacaaatgcagaacacaaacgtactcaatgcagcaaaattcttcccgaaaagttgtttccacgttctgaaggaaaaacacagcagttgcgtacaaaagaattaaccacgaaaattccttcacaaatcaaacgaaaacccaaatgcaaattgaattgcatgtatatatattttattttatttattgtatctaagtatgtaccaatgcatgaatgtagcaaaccccaaaatttgttgtgaaattgcaaaagaatcaaaaatctacaaatcttggattctaaattctaatgcccaaaatcaaatagcagcagaggaccttttaataacgataaaaatagaaacaaaagaatagagtgggacataaaaaccatgtaaatatattttgacaggtgtaatgggaaacaaaattaaataaatagtgattgaaaataatggaatggatacgaagtcccaggtgaaaccccaacaacagtacttgtacagttacgctacactacaaaaagattttaattccattaataatgataataaattttttgtaccgaataagcgacaataatattaatattaaaactaattataaaagttattctgaaaaagaaaaacaaatcttttaatatctttgaaaaaataaggggacagaaaagaaagtgaactgctgtggcagcgggaagcggctaagattctacactgaaagacgtgcaattgtacttgaacacttttgctcaaataaaatttgttgtcgttttataaattttaataacttaactattatctacttctaagataatgttttgtaaaatgaagataaacgatttcataccagcaatgagtttattgcgttgtcttatcacttatttaagtcttaataacattttttttatgttacctttagtatcgaccatcatcaataataatatgtaaattaaaattaatcataataactcacaaaaatatcattacacgttttcataacttcatttttattatttttttaccggacttattattatgagaatatataaaaattattaatagcataataataaatgtgatagaattggtattaataactcttcgaattggaatagaaaaaaggaataaattttcaaattgaattaagaaacagatccaatgacattaaaacatcttataatatatttattgttaaaagatgtatttaataatttctatgaataatttatatctaattactaagaatgggtcaactcagcatatcatctaatagaaaatatttaaaaatttgttagtggatttattgttgataaaattcctcaaatatttaaaaggttgttagtagatttatttatgataaaattcatcgtagtctaaattgtatcaaataatctaagtgaatgtcaatttaaaaggtgaaggtgtgtagtgcgcgcaatattaactgaaagtgatgaaacaacccaacgaaccacaaaatgaatggcacattttcttggcttgctttcttaagtctcgtttggtttacacgttggctttcctactcctccacattccacaacaaactggcgtttgcaacatttgtcatttgcttcggcagatataaccatgtttgtataaccatcacatccaaatatgttaaaaataaaatatatgaaaagtattttttttttaagaaagtacaatcaacacgtaaaaatatattcaaaacgattatataaaaaaaaacgattatctaaaatgaatttaatatgtcccttacagattaatatatttttaatctatgacataaaaagataaagaaaatagaaagtcttttaacatacaattttctttgacaatgttacttatcctttttttaaagtcgatgtcattatctaatatgttgattttttttgttaataagaaggaatagaactcacaatctttttttatgttccttctctcttaattaaagtcaatcttataactccaattttatttacttttttaattacaaagtataattgtttttacctttttcattttttattcagcattctcgcttttccaaaattcttttcttttaactttttcaaaacttccttttatttttccaaaaaaaaaatatatacattttctctcaccctctattatatgggttaatgtcccttcctcatgcttgtatttccctttcctctcaaaatattgtattggacttttttttaacagataatataatacatttttgttttatatggtctatgatgcaacatcattgttaatagcttttagattaatttatagtgcaactttttatcatggattttccacatnnnnnnnnnntttttaaaaagaaaaattataaacaaaaagtcgtgccttgaaaaatatgcgacttcatattgaggattttatttcttaatttcaactttttatttataaattttattttaaaaattattaactattataattatagtttgattttaatttttaacttttgatatgatatgttgtaccaaactgaatatatctttcttttttaatacactgaatattaatattacagaaatatttataaatcctaattaaaattgtattctaaaaattaaaattataannnnnnnnnntctctcttaattaaagtcaatcttataactccaattttatttacttttttaattacaaagtataattgtttttacctttttcattttttattcagcattctcgcttttccaaaattcttttcttttaactttttcaaaacttccttttatttttccaaaaaaaaaatatatacattttctctcaccctctattatatgggttaatgtcccttcctcatgcttgtatttccctttcctctcaaaatattgtattggacttttttttaacagataatataatacatttttgttttatatggtctatgatgcaacatcattgttaatagcttttagattaatttatagtgcaactttttatcatggattttccacatctgatccttaatccttcttcttggtaccactcttcgttgtgcgtcaccttcaaaggcaatttcgggacagaattgccactttttttttcttctattttctgcttcttctccctctccttccctctttgtcacctttggcggaccctccattaatctcatgcttcgcagcaccatcaacatcaaccttaactcctagaacctcgttgaggaaaccaactatatcccccataggaaatggtcaaagaaggaaccaaatggagaccaacgagcaccaaaggtattaatctaaagactattaacaatggtgcaccacagaccacatgaagtagtggtgtgtcgtagaatctaaaaactattaataaataaggtcaattttgaattcacattaattaattggcattgaaagtgttgaattctacatttgaattacctcaattgctcttgcttcaatctacaatcaattggaaagactatgctttttcatatctatcattctcataagttcgatctagtttaaaattcattgatatttgatgccaaatttcccttttcattgcacaaataaatatataaacaatggtattgtaaataaataaataaaattaattgatgaaatttcatgtgcctattttttaatttgaaaatcttatgtctagacatacgacaacaataagaataaaatatgacatttttaatgtcttttcttgacttataaattgacgttttatctttatcccattatattcatcctttaataatatatttatgaacgaacaatcaattatataataaaaatttcaatttttcacacaaaaataaatttaaagtacatgcaatataactgaaaagaggtaaagagaaattttacataaataattatacatgtttattaccctataagagatttgggaatgtcctcccaaacctcacaagcatgtctatcatttgacagttatatccaaaagaaataaagaatcaacaacataatatcaagtttcaagaagtttttcacctttttactttgaagcagttcaagatcaacaataaaatggcgtaagataaatatttttaagaaaaaagaaagatgaattcaattcttnnnnnnnnnnnnnnnnnnnnnnnnnnnnnnnnnnnnnnnnnnnnnnnnnnnnnnnnnnnnnnnnnnnnnnnnnnnnnnnnngcaatattgtgacagattttgcttaagacaatcaaatatgtgcgacgtgaaatgttttaagagtttaattttttttaagctaaagtgagaagaaaataacctctgatgaatttttttaaatttgagagttgtttttcttcttttcttgaccccccagaacttttataaacccaaagaagggtaggtttgtccaattatcaatttatgggtatttttgacaaattataaaaaaattaatgaaaaaattgacataactgaaaatatagtcattaattaaaggaaaatgtaatttatctcaaaaaaattacataaaaaatgaagtggcaaagtatcaactcacagatgcattgccacgtgaccctatgaaagtcccacaccaatataatttgtgaaaaagtaaataatgagaatatttttgtgctttagtataagaaaaaggagaaagaaaaatataaataaaaaatttaataaatgatcgttaatgattttatttaaattgggatttaattttaaattaatcacacacatatatatatacacatttgtaaggattctaagattttcctactttaatctgtatttttatatgtttttattttaataatttatttctatatgcaccgaaaataataataataaattatgtgatgtaatatgatggaaagatttaaaagaaagtaaataaaaaagtaaaaatattatataaatatataaataattaatgcgtgtgaaaattgaaaaaagaaaaatataattgaggtatcaatagaagtgatatggtggaaagaagaaaaataagacaggtagcagggtgcgtgacactgtgactaagggtaattgtttgtcgtaatataatgctagtatatattattaatattaaatgttcaatttttatttatttataattaaattgaagcgacaaagtttttaccaaaaaatttagtttaattgatttaaccgagcacgtgaatattagaaaccctagtgtgttttgtagtaggtgttgggtatgtgatagtacactacaccgataatggataaattgtagtgattcatcaaaaatgttactgccttaatcataacctagagtcgacaacgactcatccacatgtgagatgtgtataaacgctctcaagatctccctgccctcaactacaagattggcgcctcatcaaagggtgtagctactttggaccctaagtccagcaataatgatataattataggcacttttgttagagttgatatccattaaaaaaaattacaaagaaattttgttttttcttaatctcaatttctaatattacaataattattaagttataagattgatttaatagctgaagaatgaagaagaaaaaaaaacatcttaaatttaaatctttttcactgacaaaagctaataaactagcacatcaataaaaaatacttattacaataattatcaataattcttatttagtagatgtaatcattcaactgtcttaattttaacataaagattgtttttaaaataaaacttttaacagaaagattaattgtcatgcacatgagtatgagtatgaacaaattcatcaagttatattaattagttttttttttaccactgtgattaggtctttaagtgagatataaggttgatatagtaatgaagggaaaaatgaagggatataagttgcaagttcgaatcttttgccaataaaaattatcagtattaataattaatatttgtcaataaacaaataaaattaaaatataatcttcgtcttccttgtaggattccaagctagatatcttcacaaacttcgaccctttaagttgattataaaattaatcttcggttctagatttagttatatttaaaattcatcgtctatcataaatgatgtnnnnnnnnnnnnnnnnnnnnnnnnnnnnnnnnnttatataaaaattgaatttagatttttctttacaaacttaaaacttaacacgttgtgaactatgttatatccattaaatacatcaatttgttactaatcgatcgagaattgagggcaataattaaaaaaataaacaataaaaaaattaattacagcaagatataggtaatttaccacatctcattgcttcaaatcttactttcactctctccttttataatttgagatttataattttattctcatctctttattaacttttatggaaatgctttctcataattaaattattctaatcatattctcctttgaaatttatggagaatcccatcttattacactgtaatcttcttactctatcttaaaataactataataatctttgttattactaagtattagaattgtttttttatgatagactaagtattagaattgttattgttattattaataatagtaatattagtattattttgttattcttttactagttattatcataattttggttattataagtcctagatcactaagaatcacatttattaattttgtttctctcactcgagacatgcatctcataatttccatgtcagttaatttcctttctttttagtatttggctaatttattaagatataatcccgcacttgtagagatactttggctaatttatatattactgttgggaattataatggacaaacaaaacacattaacttaatttcagaacagccaatgcagttgagagtggggagcaagacagttggcaaaaaagacaaagaggagattcatgccaccaacatattttacacaaaaactaagaaatttttataaaagtccatgtaatcaacgtatttatttgtggtcctatgacacaactaaatacacatatatcacacactggattgcacttaaacaggtgaatatagaaagcaggatatcaatatgtatcatgcattaattgtaagcatgaaggtgctaaatgtgatttagcttgagcagcttggtgatggacatcactgtaacaacgagaaggagaatgagaccaacgaaagaggcaacgagggcaacaccacctcggttgcagtatgcttcgaatttgtcacatatcttatcccaccttgcatgtgaattaccattccttcctaattctgccatgaatgttgctgcaccatctccagttgctgctagagccatcgtcatcttcacccaaaaggatatatagtcaaatagttttcatatatatttgttaatttaataatttaattttgataaaatgttagtataacaatttgtaaattatcaaataattagaaatcactttaaatatgatttttaaaataattattatgaaaatcaacaattttatttatatgacaatctattataagagttgattttgacattttatggatctgaagtaaaacaataaataaaacccccttacatacgtgtattcataagaaaatataaacatataattttactaaaaatgatttataaattcatttcataaaaaataattaagtgggtgatacttccaaataaacatgccacattttaatttgactttaaaaagaatgaaagtggtaaattttaatctatttatgaaaataatataaaaaagcctattattcaatttcaactgatgaactttttttttttcaggaaaattaatctgtttcctgtcttgggccacgggccattacctctctagattaggtccgaaattgactttatatgtgattattttttttggttgagaaattttagcggaagcaagaaggagatggtgtttcacagaaaacctctggactcaaaaaatatttacaaaaacttatctttatctcattctaacaagacaaatgagaattcaaatataaggcctgtcttactctactcaaggaatcccttgggatgactttatatatgattagagaactatgtaaagatttttatattttatatatattattgtaaattctaattaaattcttaacttgaatataaaaaaatgtgtaaaagtgaaggtgactaaaaaaaaaagtaggatccattcagtaccacgtctaatattgcaatcagtccaagacgaagtccttcgtaatcatattggggtcctaatatctccactcctatcaccagcaagttatagaaactagcaattgcattgactatcacgaagaatctgcctcaccataaataacacataagaaggtcaacatgtctagctaatatagtactataatattgcaatgttaaaaaaagtgtaaacgaaaacaaaggaaaattaaaccatatgatttgtagaactaacataaaagctggagtgtgctgaaacattgcagtaagagtaattgttactgggttggtgccaatggtagcaactaccatgcctttggtttgtttgttgaatgccataacaagtgtagcagatgctgtggcaaaaaatgcgaccaccctaagggacaaaatgacccaatccttcatgggcttgggatcaggaacagcactgaaagcaagctctagtttgtctccattttctgaggccattgtgcaagtatttgccagttgattaccgtagtgagaaaatggtcggagataatgcagatggcctaaggagaaggatgggttaatataagataaagcaaaattgatcaaccatatcatttgttaagtctaagaagccaagtgtgggttctgtctctgaattcttaaggttgtcggaccaactaaattcagttgttgctaattggtgagaaatatgtgagtagctgcaactccaaaattttaattctatattattaaaaataaaaaataaagttatgtttcataacaacaacaattatagcaataatgttaaaagtttaataatcgatgagcatgtaacatgaataaattgacatattgttacaggttcaaactttatattaactttgacattgaataaatgaagatgtgcgtggagtgaatgttattaattattataccggcttctctaaatgagcaacagagcaagtcaatttatttgaggctaagataaacaattttaatggtgtgttgtagtagtattttttatttttgtttttgtttttgaaatcacggtgtgttttattttgtgatttgaactttatctcaatttgatgcacttgcaaatttgcaatctctctctctctctctctctctctcattctctcaacaatgtaagtattatttttatatttaaatgtttttttatctacgctaaatttagagatatttccctaaaacttattaaatttacaccaagaagcagaatgcttaatacaaataaaattaattatatttattttattactagatcaatatattaattaaatatgtaataagttccataaatgaataaaaaaataccgtgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattttattattaataatttattatctccgtcatcagtatatcaacaaattcaacgcggtttacggcttggcttagattgattttgaagttaatttattccatttgatcattttagaaaaacctatacgcaaagaaaagtcaaatttaattaatcaaatataatcatttataattttattaaataaattatatattttttaatggacaactcgttatttttaatcaataaacaaatgaaagttcataagattagaattttgaaccggcatataaattcctctattatttaatttttcatttaaggaaaaatacttattaaataaaaaataaaatatatagtaaatataaaaatcttgttcagatactaagtttcatcacaaaccataacttgatataaattacaaattacaagttaaaacaatttcaagtttattttaagaaactaatgcaagtttactatatatatttatggttttgtttaatttatttctattttgaacattaaaaaaaattgaactgaatgttgttcattttttttcaacaaacgattttaaagatttatttgatttttttagaccagtctgctaattttgaacagtttgggaaaataaatttttgaatagtattctataataaacaagatttttgtgagttgtgataaggctaaaaataatggtgactttggattgctgtcatgggacattttgcgtaagcgttaggaacaagtaaaatatattttatgattttcaatttacatctttaaggtaattatttaaaataaaaaaatgagagcatgttagatagacacaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaactttaatattcaagtaattttttgtgtaattatctaggatttctatgatctgtcctttatatttggagtttcttttttgggctttgctcctcctcgctaaaaaaaaaaattgtataaaatttataaatttaatgacatcataaaatttaagataaataatttatttaaggaagtgaagatgctcttaatttttatctgatatttattttaccatgataaaagaataagtaaaagggaccaatgttttatacttttattttgattaaaaaaaaagaaaaaagaaacgtacactaatagtcgctgaagaaatttccgaaagtgtgtgtgcgatgagaagatgatgaggaaacattggtagaagtaattgaagagagagagagagagggttgaatttgttttcttcttcatttctctaaagagaatctaatctcaatcctcattacagatttcttcattcctctctcaatcttttctgttttccccctttgacatcctcgttttcgccgaaacaaaaacaactaagatttttttttgttttttatttttcttcttcttgttgttatttgactcggttgttgcagcagggtcgggagccacaggtattgccagatcctttgttatttccattatcttatttgttttgattttctgttttgggtgtgttttgtttggttatggaacatatgtgtctggttttggttttggagcatattatattgaacatattgactctcgaatgttggggttggtcatatttgtctgcggagcaggtgctacgtgtttttgacttggatcaggcattctggtgtctggtttcctctgtaaaacaaattagtgggaattttggttcaattggttattgattcatttgcgtgtgagtcttagcgtttcattttggttgagtttcctggtgaatggtctttaactttgcagctatgcagagccaagttgtgtgcaatggttgtaggagccttctgctttacccaagaggggcaaccaatgtttgttgtgcattgtgcaacacaattacctctgttcctccacctggtaagctcattggttgtttctgtttttgcaaattttaagattaggtaaactcactcattttatattggtgtgtctcccgtctttatctatttggtatgtgccatttattcaatttgaaacaaatcatgttgccttctggatttaatatttacatgtagtcagactccattttgatgcttattctgaggaactctaccataataataacctgcagggatggaaatgtctcaactttattgtggaggttgtaggacattgctaatgtacacacgtggagctacaagtgtgagatgttcctgctgtcacactgtaaaccttgttccaccaggtactgaatgttagtatgttcttgttaaaaaaaccactacatgttagtatgttaccttagtggtttagcattgattttggtggactgtatgttaatttgcttgttaatataaatcttctattttataattgtggtgatgttttgttggattacttggttattgaatatatggttaatgtgaatggtgttaccaaatcctggtgaaggggtcagcaaggggtgcattaaggtgatccttttatttatttattcatttatttcctgtgtattctttgggatgcatctggcttgctacttaaaaagattgctaccaacttgacctttcattagaaagaaggtttccctttttgagggaggtcatgactcatgaccacataacctcgattcagtcttcctcatctattatccctctttgttcaaattcctatagggtggaagataagttgaaaaaattatgtgagattcctttcacatgcggttggagattgtaatatggtcatctggttatttgccagtttgttgtaaggctagaaaagaatgaggtcttagtcttggtggtttagtttctaagaacattactctagtggcaaaatggttatggtggtttcccttggaacttatctatctgtgattctgtggtactgtatgatttgtaaattttggaaccttatctttttgtgaattcattttccagcaaatcacatagaatataggtttgtgtcagaatccccccctcccaaaaaaaagcagcagcagcagccacattcatcaattcttccttcatgatcaatcaatgaaaatgttgattcttaacatttgtccttgccctattgcttttgcttacagtctggactctggagaagaacaatcttaatcacaaagatataaaaacatgagagttagtataaatggcaaacagttgttataatttatagccagctacttgttaatctgtcattgagttttatttctttgataaaagaatatactttcataatcatttttcattgtcattttttggaatattccaattccaatgttaattttgaattgcatattaactacaagatgttgggatccttatgcagtgttgctttaattggttctgttttcttatactcatgcccatctaatgatgaaatccttgttatatttaataacctatgcttattattcaattaattgtttcctgactatccgttgctgggctttgtatctgcattataaagcatctaatcaagtagctcatgtccattgtgggaactgccggacaacactcatgtatccttatggagctccctcagtcaaatgtgctctttgtcactttattactaatgtcagtgtaagtttttattgatagaactatgttatctgagcattgaatatttaggctaaaaatttgttatgggtcagtgtatgttgtgtgtaggtaattatataacctgtgttttctaataggaaaggcttttatatatagataatttatatttttattagctattctggtattagtcttattaccttctgtgtcctgtttattctttacaagcatgaccacttgagtaatctcatgctggctaatagagattgggatccagcctaaaagattggagcctataatttgtcaaaacccacttatatgccctacctcttgactaacttactaggatgtcctttaacattagatgcatctgtaaaggttatgatatactgaatatataattatgagattgtcaggagttataaggttgacttggtggttgggaagggggtttaaggttgaagggagaagagggggaggggggagaggttgtatgcttgtatccctccactaaaattctaacaaatactaacaactaacatttgctgataaaagaaattatgagattgtcattctcaacttctattttttgtgaatatgaatgtatctatttggtatgtttaatttttctgagttgatttttatactgtttacttgcttttgctcccctttcctgtcttgtagacaaacaatggaaggcttccgatccctgtccatagacccaatgggacaaccaatgctggaacactacctactacttcaacagtatgcttttattttaattttaattttttgtgattattcatagtaaggatgtattagcggttttctgttctgattatattattctatttcactacctgcagtcaatgccccaatctcaaagtcaaacagtagtggtagaaaatccaatgtctgttgattcaagtgggaaattggtaattgttattgcttttcatttttattttggacttgtattttctttcttcatatatgattcccctgagcatagcaagttttccttaaaataaatttgacatgttacaggtgagcaatgttgttgttggcgttacaacagataagaaataacgtcctcacatataaaaggtacagttcatgccatgacgccttaccacagttgctgtcacaggaagatattgtttgtgtatatgaatatatatgatattgcagcctgcaattgttgaattgaaatcgatatttttccaatataagagctggacaaatatcatgcacgtatgtatgaatgtatatgaggcggacaagccgtgaaaagggcataaaacctgttttgtgtgattgccagagcctactttgttgtttccttgctagccatacccaaagcaattggttcattctgattatatgttgacttacaagtcctagactagtaaatgctactatttctttcatgacttgtgaagcttgtgcttttcttggtgatctgttagttacatatgttgtaatatttgatgatcttgtgcaagcattgcttgataaaaatgactgatatcatagatttttaccagtcatttgaaaatttggacaagacccaggctgctttagaaatttgatttatacaaattctcatttgacttaggtaaacaaataatgttgaaaaacatttccaggaaaataatgaacatttgcaattacttgtgctcaaatgctacctgttggccagcatttctttcttaaaaatgtttttttaattacctgaaaatagaaataaaataaaatggagaaatcttttggtagaatcacgttaatgttatttcacacatcgtgagttttcattggaattgtgtatcaaacacatcgttgcttgtgtggttgaatatctaagataactttgtggctctttgcccccgttattacataaaataaaaatctactgtttgttaagttaaattattttttaggattaattacattttaccctcttataatttctcatttttttacatcactaaatttttcctaaagcttggtttaaaacaaaaccatcaaatttcgttaactctgcttaattaactaattgtagccttctgtaaaaaaagaaaacctaattatagccttgttagtaacggtttaaaccatagttatgatatttttcagttaaatattttttttgttcacattttagcctaaagcgtttatttgattttttttcttgggggggaaggatggaaaaacttttcattcgtttatctgttaaaaaaacttgagtgctaaaaagtgttggatatcattaccttaactaagaatttttatatttaagatattgattattcaaaaatggatttttttcatgagatgatgctcaagtagcacttttatgctcccaatttaggctcagatttcaagtaacaaactgaaattggctcaaggacccattaaacagaaaacagatcttccgaaaatgtactccaaatgtatagtttagatatcaaagtacagtttttttatatatatataaaaaaaaaaaaactatatatcaaagtacagttaattatacctttactnntcaacaatgttagatatcaccctaacaaaaactattagatatcaaagtctaagcaagtgtatagtttttattttgctctccaaatgtatagtttagacaaaagataaatgggtgctttctaatcatgaacatgaaagaagtaaatcagcagagtaccagatttgaaggaaaaacaatttcaaaattggatattatacgagataataaggaaaatgttaaggtaccaggcacctgcctcattgacgtagctgcctttaagatttctttatatatagaaaattaattttaacttaaattattaggtgagtacttttaatatattatttataattaattcattagtaacattttggaatctaaaaatatatatcgttaaagagtatttaataagccttatcacttatttaaaaaaatataagaaaatttatttaaaaaaaaaatggcattgacatgaatatagagctaaaacttcattaaaaaaataatatgatctatggaaacagaccattttgatgaaaaagacagtggttagttctcttattgagagctaatttgaacaaactttagaatatgaaatcacttttgtcttttttatctgaatcccaacaattaattttttaaaagatggaaaattaaaaaataataaatattaatatgaaacaattttgagttatagtgagcattaattttatattgattttatttttctaaaattaaagatactgaatgaaatactaataagcattttattagaagtattaaattatattaaaaaaatatctccttgaaaatgaatgtaatgtttataaaatatcatcaacaatacttgttattattgtcattgttaaaggatgtttttcaaatttaaagttaatttttaaaaaattctatttacaataacaatgttataacctagtaatagatcaatgaattaccatattcgtgagagattgaaattaattttattacaaacatttaattaataattacattagttatttattagcatcacttaagtatgtaatgataatacaaataagtattaatggatttgagttttgtgaataaaaaaatatggttgagatgaaaaattcactaaaagtgattagttaaaattttcgggtaaaaattagttaaataaaaattagtggatactcgacattattgtcgtagtgataaaaaaaataatataaaaagtgctgtattattacacacttaagtgatttcatctgttgattctttcaattaagaaaaagagtagccactaattggtatattatgttttcggggtggggatgtattcaatggcgccgtgctgtatttttggggcatattccatatgctgttgttaggaaacttgctgggaaatgcaataggggctatgcttgtacacgtacgattgtcccatattaataatatttctttggtgcttaaaagaatctactgattctttggtgtgggctgattttgatgtgtggtttttactttgttcgctttttgattttattgtagttgtagcagccataacagtgttgttgaggaagagagagaaaaggaggagatacaggggcagtgttgtcacggggttgagggagatggagggataaatttggaaactttgagaaaaggagaagaagaaaaaatcccagacggtggatacagaaaactcataaatctaacggacaatatttctttcccacaacggtggatatatgttgttcagactgaaagttacatttcgcagtttaaacatttgctttgaggtccgcagtttacaactacaacaagtgagtgatatggattcttctgatcactcttactcatcaaacaaccagcaggtatgtaacttgtttccaaatgatgcagcaaatatatgattttttttctacttagaatgaaaaatgaagcattattttgtggaaacaatagctaaaaaagtgaacttggaatataatcataatcataactcgtttgatgtgtttcacacacacacacacacacacacaacacatagaggtttctctagtttgggctccaacctttgcttcaaactgaacatgtgatctgtatatttggacatatattatgacaactatgtttgtttttctaatttgcacatatttaatcataatcataactcgtttgatgtgtttcacacacacacaacacatagaggtttctctattttgggctccaacctttgcttcaaactgaatatgtgatctgtatatttggacatatattatgacaactatgtttgtttttctaatttgcacatattattggtctgtgtttgatgatgttcagtcagactcttggtgggagggcactccttctgccaaaaacaaaaagtgtttgattccagattccactagaatttgtgggattcgtgcgaggttgagatcatcatgcaaggttatgggaactagaagaaacatctgtgaagacttactaccagatttcagattcagaatgttctctaatagaagtagaatcccttccaacacgtacaagttgatcatccttctacctttgagccagaaatcacatatgaagcatctgaaaatacatttcccatcttcttagcaaatcgaactagtgtgccaaactgtttccagtcaaacctatcgaatcggttgatccggttcttaaaacactgcaaataggtatgatttcaaatggcatttcgcactcacaattgtggccgtaatgtcaaagtattttaactcacaacaacgcaatcgtaattaaaatcctatcagctgtattttctcatgtaatcgcgaccgcaattaggtcaataggtaaaaaagcaagagtgcaagagaccgaacctgcgacgggaatttccacggcgaactaggtagcagaacaccgagaacaaggcggagacgctggaaacgacgtaggagagcacgacggcgggtccgaccaccgtccttgcctcgaggccggtgaggacgaatatgccggaacctatgacagcgccgattacgaaccacatgaggtcccaccagttcagcatcttcatctcgtggctgctccgtgccttcatctccaccaccgtttcttatgttttgctcctctcacttccgaactgaaaactgaaaagtggttattatggatccaaagtaagaagagtcatgaggagaataatggatatttatttatagtggagacttatagcaactttagtgcaagattttaagtaaggatcttgagctcaagatctgatcttcactagatcttccaataaaggaggtagagagatctctaacatggagaatgagttcttatagaagaacctttaagatctgcacattgttcaaaagagaataaattttttttctctttctctctccctaagatctcaaaataaaatctaccattaaagaacaaaataggagggatcttgagagatcttcaatcctacatggcactatgaggtctaccaaaaaatggtctaagattccaatttgagatctatcactgcttaatttgcatggtatacaattccaaaatcattgactaaatataataatataattttaattaattagataaaattgagtaattaattactcgtgtgtaaggttgcacgcattaaaaaatcgaatttaaattattgcaggaacgggacatggaaaataatcagggagagaaataggtacgatgtttggaaaaacaaaaaaaatactgctgctgtattaaggactttatttcgcattattgtattcacttttagctgccatgacatgttcccaccattttaggaatagataaaattgtctatatatttttattatgatattggcataaaatatttattaattttgataataattaatttttatcaaagaatctaactaataaattttaataaaatctctattttgaaacacattttttcatttgcttaatttcgaaaacttagataaaaaataaaattcatgatcactcgaataatgatttgttggtaaaaatattatctatttatttattctataaatgacatctccatgtgcacaattaatacacatgcgatgtgcttagcccccttattttccggtaatatatatatatttttttgtaataatgtgcttagcccttgttatgaaataattaacaaaaaacaaagctgtctaaaaaattaacaaaaaaacaaatgttgacggaatgaagtaagtgggtgatagtttagtgaaaaaaagtcagtcggaaacgaaaagagaatcatgtggagacatcaaggagacagtagtcaaaggatgaaaaaaaaagttcttatacttccacatttgaccttataataataaatttaaaaatttagtttaaactataatatccttcacctgagccgacatagagaattttaaacaattaaatttgtggaatttgaatttccctctaaaagtgagaaattgaaattctctttttttttagaagttctaaatgcacaactttttattccgtctcaatcatagacatacttcgacctccactgctctcaagataatattcaccttaagtatttttccgtgaatgaggttcaaaattttaaaaatgaagaaattcaatttctttatccaaatacaaaattttgaaaataaaaaatttttaattgatgtattttaatttccctgaattttaaatttcctaaaattttaaaatatttcgttcaaacatactctaaagaaatacattctaaatttttcaactagaggggtacatatcaaaatggaccaaattttccataaaaacaaaacaaaagaacaatatatacgtcaaattaaattaataaggaacctggacatattaatttatagtaaatcaagttgtataccccgtactgttaaaaatacaataatatatgaccctaaagtagtgcgaggcttttcttgttaattactaatttaggcacacacattcatcatgaattgttatatactgctatttattgcatatataaattaaagcgcaacccctcagggtctccaccaggtgcaccccctctactcttgaaacgctttctttctctcacgcaccagatgatcgctgttttctccactttcacttccttaattcattccattaattagattttgcatgttcccctccataattgtctgtaagtactattttgcttagtagtttcctctctatatatatttgctttttgagaatatgtaagcattgagaagaagacaccttgtgcgtgtgtgtattagcgtgtttatttctacattaatttcacatgtgattttcacgtctgagatatgatcttcagagattaataattatatatactatatctcaaacatgattcagaaattcagacatgttgtatatatatgcgtgcatctagctataatattgctctcttaggcttggattctagcttattagttataagtaacacgtacaagaacatcatgcatgcatgtatgtcatgacataagaagaaaagaaagacaagacaaaatgctaattcaggttttgtttggtacttcctgcgtaaactatattaattaataattatatactgaaccattaattacgtaacgcgcatgcatatattttgatttatacagagagaggaacagaatggaaatggaagaaggtgggagcaggggtgcaaggagaaggggatgcacgtttcagaaaaacgatttcttcccggaggaatcgtttaagagttggggtaactatggaaaagcgttgagggagacgccgtggaggtttaaggatcgggttacgacccgatccaaggacgagacggaggtggtggagatgaaggggaggagcagcaacgagatgaagaagacgctcaactcgtgggatctcatatggttcggcatcggcgccgtcatcggctccggcatatttgttattaccggcctcgaggctcgtgaggctgctggtccagctgtcgtcttgtcctacgttgtttccggcatgtccgccttgctctccgtcttctgctacaccgaattcgccgtcgaaattcccgtcgcaggtttttgccctactttattattaagacaagacaaagcttactttcagtttggtgttttttcggagatactgtgaaatggtcaactaggacttcattgtcctaatcaatgtccacaaattacgtagttgagtaattacatgttagtgggagattgacaaagacttgtagattcgatcatagtgattatttctattaatcttttggtgtatcgattatttcttttcttatatattatagagatgaaaactttcataagaacacaatgtcaaaaatactttaagaaatagtaaaaatcgttgacacagattatttgatatttagatatcttaatcaaggtctttgatgggggttttggtctttttaaagtactgagatgaagttttaattttatctacataaaatcttccaacttttaacttaagattttgtttttgaaaattaaaagcaaaatggcgctacataccagagaaaaagaaacctataataagtaatatcattggaggaaattttctgttacttaattctattggattcgaatagaattattttaaaaaaataagaattaatagatatgtatcataataaatgcctaatgtataatcactgttttacttaagaatgtgaaagcaatgatatatatacgatagtttttgtggtgtgtgtttttcaggtgggtcatttgcatacttaagagtggaactgggagacttcgtggccttcatggccgccggaaacatcctcctggagtacgtaataggcggcgccgccatatcgcggtcatggacctcctacttcgccaccctatgcaaccaccacccagacgagttccgcataatagtccccaacatgaaccccgactacggccacctggaccccatagccgtggtggtcctcatcgccatagccaccctcgcaatgtgcagcaccaaagcctcctccatcttcaacaacatcgccaccatcctccactgcctcgtcatcgtcttcatcatcgtcgccggattaatcaacgccaatccacaaaacctaactcccttcgcacccttcggagcccgcggcgtcttcaaggcctcggcggttctcttctttgcctacctcggcttcgacgcggtggcgacaatggcagaggaaaccaagaaccctgctagagacattcccattggacttgtcgggtccatgacgataacaacgttggtgtattgcttattgtctttatcactatgtcttgtgcagtcctacaaggatattgacgtggatgcaccgttttctgttgcttttaacgctgttgggtgggattgggcaaagtacatcgttgcattgggtgcgttaaagggaatgaccactgttttgcttgtgactatagttggtgagtctcgttacttgacacacatttcacgtactcacatgatgccaccttggtttggccacgtggatgacaagaccgggacgccggtgaatgctacaatagcaatgctcacagcaacctcagtggttgctttcttcacaaactttcgtgttctctctaacctcttgtccatttccactctctttattttcatgcttgtggccgtggcgcttctagttaggcgatattactcaagtggggtaacaacaaaggagaatcaagtgaagtttgttctgtgccttgtgctaatatttgggtcttcgtgtggcgtttcggcttattgggcaaacagtgatgggattattgggtacgtgatttgtgtgccgttatgggttttagggaccggagggctttggcttggtgttccaatggccaaaaaacccaaagtttggggggtgcctttggttccgtggctgcctgctttgtctatttatatcaatattttccttcttggctctatcgacgtggactcgtatattaggtttggggtgtggacggtgttgctcttggtttactatgctcttgttgggttgcatgcttcttatgacacggcaaaggagtctgagagtgaaagtaatattactactaatcaggttcatgaccaagagttgaaccatgttgaacagggactgcaaagcgaaaagactacataggttcaaaaaagttgttttacttgtgtattacatcataaatcgtatcatatttatattttttttctctttcactagatattgaataatatcatgccattatggatgttaatccaacatttttcctaaacgtaatgtgcatatacatataatatatatatatatatatataatattaagtgatgatttatgagtatccatatgttttaattaaacacttattctttctctatctctttttttatgtatatttttcccacttttaactctcttattaggtgttgattgatatattggatgttcaagtataatttttgtatgatattagattagattagagatcaaccacaaaaaaataaatagtctcacgtgcttattatgtgtgagaatatatatgcaaagtaatatttattgtaagaaaatacatatggggtctgtttggatgtaactttatctcaaaatatttttagaagaaaaaaaaatgaaataagtttttctataaattaaaataagttttttattagttaatttgtagatatcatctcatcttttagagaaattatattggtgaacttctaaaaattagctaatgaaaaacttatttttatttttgaaaaaattcattttatttttttccttcttatttttttctttaaaagtacttatagaaaaatttacatccaaaccgagcttatgtaaacattgaaagagcaaaataccaaaaaagatcaaatagaacattaaattatgtgtaatataaaaaacaaaacttcagatacatcgatatatcaatgtaatttattctatttaattaaattttgaaattattgggggcagtacaaagagagcaaatggacagcatagtttacaaaagttgaagcataatatgagcttctatcggaacagtggtcaaaataccacactttctaaaattatttgtcaatctgccacaccaacaaaacaaattatgcatatgccacgtgggctaattcgcaggaccattaggcgaattaggtgcattagctggtgacccttttttgccacgtggcaatccacaattggttacctaattcgctagacaggttagcgaattaggtgctgaccgggcaatgtctgattggacagggtaggacacgtggcaattggacacgtaatttgtcatggcttgaagcgaattaggtaatatttgataaaaattttactgaataaaaataaattttaannnnnnnnnntttgtcggtcacatgattatattttttttttattgtcgctaactagtgtcttaaaaaattaaaaggaaattttttttaatatgaaaattatagataagcagaaaaaaatcataaagagtacaatttcatacatcctaataaaaaaatcatgggttagcatttgtcttgagcgctatttgtttggtgattattaaaaagaaagaaaaaatattaatttaaataatgttaaactatgtaagtgtaattaagaggatttagttcaattaaggatgataaatgaatgttataaatctcttcatnnnnnnnnnnnnnnnnnnnnnnnnnnnnnnnnnnnnnnnnnnnnnnnnnnnnnnnnnnatactttaccattttgtaaatttaattaaaataaatctctttatattatcttcgatttgattcttatagataaaaaaaaaatgtaaacttaaagaataaataaagtagagatttttaggggggaatgcttatggttggaacaaatccattttcttatgacgttacagttgcatttgtcctagaccagctaatttatctgagcagactgagccttctgccatttctactgaagcaactgggttgaaaggttcagttgctgatctcataagattattgacttgagtaatttgtacgtattattgtttcattgatttggttttcaagggttgtagtagtgtgatgtgaagaaatatagttgtctttgagaggtcatacttattatgataattagctcataaacatgtgattatatttgttataattttgctttatttgtagtcccaggatattggtttctagctttagttttagatctgattttgtgtcgagtaatgccttcctagtggtaggagaatatttctcactttgtttaaattgtcataaatccaaattttacatatgcagagcatttcttgaagcaaagtgtggatttctgataactcaagtgcaaagggcacctttttgtgttagttatgctatctgtaatcagtttatattaagttccattggctttttggtattgcaagaaattctagttttattcgtggttatcaacaaggatatgtttaccagcagaagtttagtttggtgaacataaagttgaaatgggtgaaagataggacattggatgttgttgttgctggtcagagggatcttaaggcagctgggatccttgtctccgtcatttattcttcttctgaatactgccttccaatataccatctttctcgccacagtggacaaatcagtcttccgagtgacctcaaactctccacctttatcagaagatatcccaatatatttattgagtcctcttttcttgatagtggaggctctcctgttctgtgtttcagtttgagtcctgaagccttggagctccatcacgaggaaatgaacatccttcagcaaaatcagttggaactccgggataggctgtgcaaattgcttatgctcacaagtgataggatccttccactacaaaccattgaccagttaaagtgggacttggttttaccatatgattaccagcattcttttgttccaaatcaccctgaaaggttctcatatgttcgccttcctgatgattgtgttggcttgaaattgttgttttgggatgacaatcttgtcatcagttacagaagaatacttctctacaacaaaaggcagaagacataaaaaatggatccttagcatttccatttagtttcacaaggggttttggtttgaaaagaaaatgcatggagtggttgaaagagtggcagaaactcccctatacttcaccttacatcaatgcctctcacaaaaagaaaaagaatagttagggtcttccatgagctccttcacctcacacttcataagcaaactgagcgcaagaacgttagcaacttgtgtaaacccttggctctacctcataagtttattaaggctttgtttgggagttaggagaggaagggaaggaaagagattaaaggggaagggagggaaaggaaagggaagaaaatgagggaagttccttcctccttatttggaagttaaaaatataataagagagggaatgaagagttaataagatatttttacaattttgctcttgaattgtgattcagtgctttatattttggtgttttattaacactgactggagtaagatagtaattttattaacactgactggggtaggatagtaattattatttttccttctaaaaactctcaaattggtagaacaacaatttttagactttgaagaatttcaaatgagttttaaaaattctcaaatcatttttctcaaaaattaaaactttcaaacaaggagatgtcaccacctaaacctttatcttacctcgcttctcctctacaatccctctcccaaacaaagcctaaagtatttgagtgtcatcctggtattttttatatttccaagaagagtgatacccaaacagttgttcttagggaggcctataatggtcaggaacctttgctgaatcatccccttctacaaattagagaggaattctcaagcctgctgaagaaagggctaccggataggagtaggggtgtatacaaaaaaaacatagacattaatttggtggagggtctggagaggaggtttgcattgctaaaaaaactaaccagcttagttctgaggacgaatcagattccatgttttctgaatatgattcagatggccctctacaaaacccttgctgatatatgtgaatgtgatatttctctttagccattatgttaatgtggtttgacttagtgacaattttgaaatctgtcctagatgggagggatgtttgcatattactacttttaacccgcttttgcctcttgtgaagatctgtcaatgaccaaatatatcagcaatgctatcttagcaagggagagcattttctgattagatgtaatattatggaataaggtttacagctcaatattatttgaagattagatagacacaggtatagctacaattcattttactaaaagaaattttgggtatctcagaatctttatggtagttgaaaatgtaatttaaaaacaatgactagatgcttatagttctagagcatctttttttctggggttatgggaggtgtttgacaaaaatcacaatatttttaaaaacaaattcgcatgaatttgttcattatgcccatgaggaagttttgctgaactaattaaagtatctttatcctgtaattagagaaagagttgcataattttttctctcttcaaattcacacacgataaaaataagctgatacatgcctttaagccctatttttgtaataataaaataaaaactagttcttgaaaggtagcctgttaattaattcataaaggggaattcatactcaggaacggttggtattcttactctggcatttgtcctcgcgtcccaaaagttaaattttgtcgtgtaagatattaaatgcatgccatttatattattctgaatataaacttgatgccactcgtgctattgagactttcaacttttttctccatttgaaagtgacaaaactgtacagtttaagcgcttcatgatcacaattcacaactgacttatcagtttttcatattccaattttgtagatgaccagtccaaaaccaattttttacggacaaaatttaaataatgtcccttttaatcctcttaattcttaaataaatcatgtactttgaataatattcaaatattattgatcgatgtaataaaatacttaaatctaaattttgccatttcaattttatcaatttgatctaccatttcagcttattttcataacattgatctttttttaaaataacttatttttgccatcaatgaattttccaaataacttttttttcttaaaagattattacataaacagatcaacttaacacttacatatgttgaaattaaaataattaaaagactactactgcttggtgaaatcaaagtgacagtcctccaatgactgaaaatcaacttgatttaccattttttcaaggaccaaatttatgtctcaaaaatcattcgaattaccttttttttaatgttcaactaaaacttttgaacaatgttaaaatacatcttgatattggacgtcaaatctgaccagattttctatgcgtgtttcgcttgttaacatgacacttgacagaactgcaacgtataactaacttgaaagcaaatattaggaaaatgatagcgtgtccaaaagtgaaagcactatcatgccttagaacatgacattcatatcatacactatgtgatctccatgtattgtgaaatgcaaacagaagttaaaagcggggggaaaaatacaaacatatatgttattttaacccccacccaacctctcaaaaagaacaaagttaaatgagaaaaaaaaaaaaaaacaaaacaacgaaactacaaaactacaaaactacaaaacaatataaaatcagtgcaaccttgtcaactcttctactctcttgcataactcctctactgaaacgtccaatgccttggaaatttcatccatcttactgcggttaagatcaagaaatgattcgatcaaatctccatctaaaaagtttctggcttcaacagttttcttctcgttgttaaatgatctccattgctcatggctgagccctccaacgcctttaattaccttcctcaaatttgactgaagtttctccaagaaaacatattgctcatgtggaagagaagcaattactccaataacaccattaatggtgccaaagataacagttgggatctggcccacatcagaatctggcaagcgcataacaagggagccatgccggaaccgattgacaaattctccaaggtgatactcaccaaccacttcaagacgacctcgctcttcatcagtggcaccttcactatttttccgaacagtgaacagattaaaactgttttctgcacctagatatatgtcatcatcaacgatttcaacggcagacatccaatttgcgttgtagtcacgagctctttcctcaatagcaccttcttcatgctatcaataaggaaaaatttatcattccaaaagaacatggtatactcattatatatacaaaaatcagttattcatccaaaacgataagcagcacaacagttgaaatttaacaaaaccagacagaaaatagtgtcacaacagtttaaaatttaccttgtagattaacaaggaaattgacttcatcagatcaccaactacaataaaatctcctctagtttgcacataaagtgctaggatgtgcccatgatgtccacattcagactgcaattcatgggtaccatcatcccggagcacccacttatacagctgaattttttgattaatagcagcaagcaatttaccattaaatgcattcaagcaataaacagctcctttagtctctttctcggcaattagctgtagttttccatcttcaacagcaaaaacaagaattcttccctacatgttttaaaatggccataggaagcaggatatcagaagctttgactagaacaaagccgaaaaaatacaaatttctcaacttactttggttggttcattctcctctggatgtacatatgcagttccaacacagtaatacacattattgtcatctgagaaggagcagctaattatgaagcaaccgtactcataagtgtcaagagaataagttgatatgaactcaaaagtctggtcgtccagcaaacggacaaagtgcatttcagattcttcaccacttgctgggttgtatttcaaactacaaatagcaaaagtcctagattgctcctggtggcagatacgtcgtgcatgctcccccagtggaatagagcgaatatgaagtttttgtatatcatcaatggtgccaatagtaagctcaccttcttttgcaattgccaaactgtttaagttattaaaagtagatgagtaccattaccagtaaattattttacattaaattgaacaagatccaagaacagcacaaggggatatgtcaataactctagtaagtcaaactaacaaagaccaagatacctgtctggaaaagcagcagaattgaaaggacacatgtgactcacttccttcagattcacattactataaagtaactttttgttactactgtaaatcacagttggccgatcagatgcagcaaacacatgagtagtatttttggaggagaacgtccgtagtgtaataggttgtgtccctagagatacctttttcctatctgttaattcaccagtacttgtattcaacataaagtttaagagatggccatcacctagagcacatagcaagtacgatatctggaggataaattgacaaggcaacacactttaataggatatttttaaggaaactaccataaaacttgtgacattgaaagctaagcaatgcctcaatttaacatgagcataagagtaaaaagatattaatgttgctgatcttcgtatattcctcacaactgccacacatgtaaaaatccaaaatctctacctcaaattgaacttacaagaaataaaataagaaagcagaatgctagaatcaaaaaaacaaaaccaagtacaaaaaataactcaacgaaagcctaccccttcaaaggcacaaagaagaacagaacgaggtatgatctcccctcctaattgttcctttgtgatgagactcagatcaggaagagaaaaaattctaacacttatgtctgtccacattccaactgctgctagatgactgtgattggggttttcaccaatgggatttatgtccaggcatgaaatctcatactccagctgggcatgttttacttcctgtaatatgccatctccaatttcaaggtaaaccaaatgccctcctcctgtggccaacaaaacctgtgtccaagtgtaacaataattaccaatttaattgcaaactcaatatgtattgtcataataaaatccaacaatggaaatgtgcagtgtaaaagtaatgaaatagattgaagcaaattctcttaaatggtaactttagtagagcttggttggataccataccaaaactactcgtagagatccagaaataatatcaaaggccaagttttgaagttgcaaccaagcagaacatttatttggccagcagcaaaatactgttacttctggtcaaaattaattctagtatttctttacaaattaaacaaaatcatgtttggctgaacagtcttatattatataaaacttattccaaggagcttgattggataccataccaaaactactcgtggagatacatcaaaggccaagttttgaagttgctgcaaagcacaacatttgtttgaccagtagcaaaaatactgatacttctggtcaaaattaattctagtatttctataccaattaaacaaaatcatgtttggctcaacggtcttatgttatataaaacttattccaaggaatttgccacaaattatattactttgtagattgtctgtagctttaagatatcagaatctggagttctctaccctttggaggagtcttgcagtgatgcaaaatcctttcaactttaaggaattaaaataagtaaaatatacactgccactgagtcattaacttgttttagctttaactttccactgttattggattattgttttatattattaaaaaacataggacaaaataaatattacacaatctgaattaaaatatcaaaacagacaacaaacaaatttatcagtataaaagacattcttattcatgtagaataacttattattggagcttcactgaacaccaaaaacaatccatggagaatcaaagaacatgattctttaagtaaatgaaatgatggaagcaggcatttaaaaactacagccttcgcacctaactaacatttactgcaccttcaggaaatatctttcatgcttagagcttcactgaacaccaaaaaacaatccttgaagaatcaaagaacatgattctctaagtaaatgaaaaattggaagcaggcattaaaaaactagagccctcacacctaacatagactgaaaaggaaatattcgtctttcatacttacagaagtcataaagtcatttacttaaaaaatattccataaaccaatgacaaatatgtcacaattactaattcaacatgccttcagctgtcttcctccttttatctttaagaattaacccaaggtagcatttattagcattacattctacttcaatgatcctatagctttctaaacacaataatttcacccaaataactctagcagctaatagcaaaacaggggctcaagtcatattaaagttaatgataaggagcttctcatgtcactacttccatcgtcctgacagctaatgtacatcaaaattatttccatcggaacaagtgggagggggaatgtgtcagactctgatctgcctctactcagataagccacattgacgagggaaccaattggaatttaaaaaaccactaaacaaatatcgcctataatttttaaacataacattttttgtaaagcaaccaaatcacacctgggtagcgtttgctgtagctacatttactgaatagcctgatggtgcatgccattcattccgaagctctctagttgtggagctgaccagtctgacagagctcgatgtgacctgtaatttcgatttattagctaatggcaggtgtctgccataaaacaaaataaaataaacaaaaaaagcatagaagtgtacagcagaatagcattaattaatttatggaatcaatttatgaaaattattcaaattaactacaaaggagcatgcagaacttaagcttacaaaagaagtttcaagattattaacacattatgtaagtttaaatctttatttctttaaagttccaacgtattataattcttattgtttgattccgattttgacctacccacagctttgtattatccaaaaactctaaataaatttcttattaatttttcacaaaatgggcaatcttttttaaaacaaagaaaccaaaaagaagctgacacaaatattttgtattttgaagaaacctgttgaaaacatacatcatagtaggtactaagatatcagtcctgtcttctgtctcgtgtagtcacagagaaaaaaaattctttgacaagaaatcaaaatttgtcaaaattcaaaacataaaaatatacacaaacacattatacacacatctatactgatatcttgatatcaggtaatttttatatgcagaagataaaacatgccactaattattttagaaaaatagaaaactaaaataaaaggttttattataccaaaaagggtatatatttatagtgatcaatattgggttggttgagaaacagtttgaaaattaaaggaaagcaatcctgtaagaaaacataataaatagacagcctaacagtaaaatttgatagcaaatccataagcaaatgacaaaagaactctgcagctataaatagttttcttaaccaccacttctcttaaatttagtcagagagatgtaggtgttaaatcaagataaacagaaaatcaatatggtaagaaaataaggtaagaacctacttgaacaagttgattatgaactgcatcatggcaaaataatgtctgcacttgagaacagaatccctcaatctcagtttcttccagctcatcctcaagattcattgctaagattcttgtttcacttataaaactcacaaccagaaaagtgtcaaagggatcatctgttgaggatctaagtgaccacattcctttgataccttgaagttctactgatgcctagaccaaatacatgcataaaaaaattaatattttgtaaggtgtttgtcattgatataaagatttatttttcccaatttccattccttttgaaagtgtcttgggtgcaaatgttccacactgtggtggaggaaggggagctgacctgttcattaatccctattccattacgaacgacgcgaagagaaccatccttgtaagctccagagcaagttacaacctgaccttggccctgcctttcgaggtctaccacacagaagtcaacaataggccccaaattgacatacctttccagtacttctacataagaaccttttgcatcaggctgtagatttagttttattagctgcattttaacatcagagattgtcaatatgttatgtctgaatatgtaagcataagtattcagcaatggatatgccatactacacttccaaagactttaaagcaacatgaatagaaaaggcaatgaagaaaacacttcacatattgcaaaagcttcctgatacagatatgttctttcccttccttgttatcttatattagagtaaaaaaattagaagaaaagaaaatatcctaagaaaaacacttgattgttttggtgatgcaggtcccttttgtacttatgttcttactgtactatttcatttactttgttatggagttggaatgtcagaatatttattatatattataggcttaattactgttttagtccctgaatttgggggtgtgctttttttagtccctgaaatttaaaaatgctttttttagtccctgaatttcgaaaattgctcgttttagtccctgacataataaattgatactttgtggcagtttttaagcactttatggcaggtttttttagcactttgtgacagtttttaaatgcaaattcaagtggctaaaaaataaaaattaatttaagacagctaaaaaccgtcacaaagtgtaaatttattatatcagggactaaaaaatgcaattttcaaaatttagggactaaaaatagcatttttaaatttgagggatttaaaaaaaaaaaacataccccaaattcagggactaaaacagtatttaagcctatattatatatgggagaggatccacttgctccaagagtaactcttttagagttactcttcatcctcaccgttcattttcttaagatctaatggttgtaataagtaactgatcttaaccattagatctcaagaaaatgaatggtgaggatgaggagaattactcttgaagtaagtcgatcccctcccattatatattatatatatgctgttaaattatgtttggggttccacaatagattttaagtaatatttcaaaagtctcaagtttacaactcaagtttgacagccttgctatttactatataaataaagttatgctctctaagctatatttaaacaagtacattcaagagtcataaattctcaaatctgaatacaattaataagtaatcaacccaacataagctacagattccatttcacattaaaataatgaaacaagtcaaagcttccataatagttcaaaactagtgcttggggagacggaaatttggaaataattaactttcacgttatgttctcacaaaacgaaaatttataaagtaattttccagttcattaacccacctgtgaatctccataacttgaaccaatgtagacgaatgcattatcaaggtatgatactgtagatgcaatggaagtctccccaaggggctcaattttaagtccagtaaccctataaaataaatgtaaatgacaaaccataagattcaacagttaaaatagtggtctattgtttttttataaaaatacagattgtttattcaatcaatatactgatgccgagaatgagagatcacatacttttctttctcatgggttattacaagtaggctaagcaaccctgtatggtcaccaagtaaatatctagaaccatcaggatcaactcttccataggcttttgtaattgactgaaaagcacaaaaggtacaattaagatggaagggaagtccaataactcgtattgtacaaatgcacttgtttcaaaaaatcacagatgatttaaatggaagtacaaaaaataatttttaacatacaggtctgatcgggatagccttgaaagcattagcactgcagtacactatgttttcttccccaataataagcacaccacaaagaggtgggggaactggtatcaataaatcagccccattatcaagattgttctggtaccatggaccttcaagaaaatctttatccttcagtgcaacctcatatgttttaacatgacgagcatctttattatcctgtcattgatgaaaacagtaacaaatccatcaaaatcaaaattgtttatgctaaacaccatttttccaacaaatagtattgcataaaggaaatgcaagaaaaaaattaaaatatgcagcagacatattcatagatgatcaaatcatagcaacattgaatacacaaattatgcaagaatatgaatatgcccacccataaactgaaactaaaacaagacaattataacatatgggttacaaaccctcttcagtcttcagcactctttaaatttgtctcaaaccttgtgtaaacaattctaatacaagttcatgtgaatgatgtgatacttactcttctctgacacttctaaaacacaaattatgtgaagaactttcctgtatttttttcttcttctgtgtctcaaatgtatattaaattagaaattgaaaagaattattttgaaaaagcagagaaagagcatggtattataatgattccatgctgactgtataaacaatcattaggccaaatggaggtaagactccatcaggaaaaaattgtgaagcacaagcataattccctcataacaaattttggggcaacaatacacccttaaaggtgtaagcgttctgctccaactacacatgccaaaggacagcttaaactgcatgcagccacacaaatttagcctcctgttatagagcactagatttctaaatgcatttagcgtggacccaaagacaaaaataaaagagcagagtaaagaaaagaagcaaaacaaaatgacaataggtagaataaaattagaaacctggtaaagaaccacaatagttggctttgaacaaccataaagaaatttgatatccaaaacttggagctcctcaagcctgaaaacaaatgcatcataattctaataaactatatcagaactagaaacaaaaaagaggaaaaagaaaaagtagggaagaaaattacaaaaaataaattataaataaaaacattttcaatttaaaaaatgccaacagtatttgcttttcttttaaatttcaaataaggtttcaagaagagttaggtagtaacaatcaagatcaaaataatctgatctgattctcccttattttctccatatcttatcctaatgtttattccataatcagggtggttaggatctctccttgtcagctctgcctttataaatcatgtaaattcaaatcaatcaataatacagaatatctttttcttctcctaaaattatatagtatcaaagcttcagccctgatcttgtatctgcacaccatgtcttgtgttgacacgccacaacaaaatggagtgactgaaacaaaaaataagcatatactagaagttgctcaggcattgtttcaaaatgtagcaccaaaatatctttggggtgaaagcaatcttaattggaacttatttgatcaaaaacaagtatagcaaagttttgagcttcaaaactctttgatgttctcacaaggtttttttccaaataatagactctcattcactttacctctaagaatatttgggtgtactctgtactgtttttgtgcatacgcatgaaccaaatgaaagtaaacttgatcctagagcaaaagtatactgctatgctcccaaccaaaaaagatacaaataacttacacccatattttatgaatgttctcttaggtaacataacatttaaaactgaaagcaaacaaactagcaagccactatgagatcagcaaagcacactatgagatcagcaaagcataaacaaagctagggttgttttcccagcacagccattgtccatagtcacagcggatataacatgaaaaaaagatacaaagaaactaaactgtacagacacccatttacatccatgacttagctccaccatgacatccacaattttgctcaatgtttataaaactggaccgatcatcgaaccaattaaggcattagtttaaccatggtcgaaccagtattatttttattattattatataatttttaactgtctgtacaggagaaagtttggattttaaaaccatctcaattaaacacatagattaaaccaactaataaatgtatattcatacttcattttgttctttcaaagaaagctatatctaagttcactattgacccattgatgcatgagatgcagaatcgacttttttcaatcttatgtaaagacaccaacaatatccaacttgacataggttcgcatttcattcttacacaaccagggctttggtaactggtaatccttaatcaaggtcataggctcatagttactagcactacatttaggcatacctagcaaaggtcaaattgtaaaagaaaaaatatttatcagcaaaaataattatattaataaaagatagtagtagcagtgcaagtagtaatgctatgaatacaccctaccaagaacaaagcagaacagacactaatatggttaccttatattaaaggtcaaattgtaaatagaatccatgtgtagaaaaccaagataataatatggttaccttatattaaatgcttccttgagctgtcccttattgtcgaagggaataacctggaagatcaatgaacagtgaatcattcaaatactttaacgtgacactaaacagaaacatattgtcattctaatcttctaatatttttacagaatagtgaatgagaagcagttacatactttaaacaaaccatcatacaagtggagtccaatcagtctacaatcaggatcaataatgccaatctgcagaaagaaaatggaataacagctgaaatgcactgaacaactttcaactgatcctagactagataaagcataaatgttaaaaatatcaaaactgaaagaatactataactacccaagttttatcagtagatataagtaaaacaattcaaatacctgaccgttatctgtgggacgtcctatccggtcagaaacatcccccattgccctggattacaataacaaagagaattaaacaaataaatgagccaaccattcatgcccttacaaggaatttcaatttataatatataatatacagaaattggacagcctaactgtttctttgagctactttggctcactatttgttttcattttttaggaggatttcctctcctgtctcctgccccatatgtacattctctcaaacttacatgaactcacacatttaagttagggatttggggttttattcttattttgacttacaattcccagcttaactccaactccaaagtcctgttagggtcctaaatgaccccgacaagacctattcaattaacataaggtaatgtcaagaccccgacaacatttcaatcttaatttttcacagaaattcctagcttgtatgctcaagacactactcaaagtacaaagttatcaaccaataatcccactcaaaagaaagtaaaagaggcagcctaatgcacaagactccgtctagggaagtcagatgcatgcaatttacccaacaactaaatgtttccctcccaagttctaagggatactaatttccttcttcataagttctaacacatcagaaagaggttatacaaaatatcaccagagccaccatttgctgccgccggccaaatatccggcgaacccaaggtttgatgcgccttagtgagcgtgacctaacccagcaagtcacacagccaaaaaggcctccacacgccacttgtacagagccttttgtttggcgtgtgaagtctacgcgccgccctctactggtcggaaacttgccacaacagtacagaacaactcgcaaatctccctagacctagatctggtcctggatcttcattatctctcattagtagtgttgggttctcaagttggaacctttcttgaaggttctgtctgtgcgagtttggcatcttggtttgcacaactcctccttgttataagatgcctctacaacctcttctacaacttcttctgttagtcccacaatttctttctcgaggacacctgtcataacctcagagaagctgggtgatagtaacaattatttgtcccggtctatatttgtggaactctgttccttggccaagggcatcacaatcacttggagaaagagttcactgaagtactagcaaaaagttaggaacaatggaaagacttgacttccagctttttaccttgttgtggcagtctgtggagcaaaatatcttaggaaccttgaggtccttcaaaacttgttgctctttttgggaaaaggcccaaaagatctatgccaatgacattcagagattgtatgatgcagctgcctagttgacatcttataagcaaacagatcatcatatgaccttgtttgttgctcaaatccaatctgcagttgaaggactaaatatgctcttagatgttgagtcaatgaaggaaatgaaaaggaagcatgacaatctgtatatggtgctggccttacgtgccatgaatccagattttgatcatattcgtgatcaaattctgactagtcaagaagttccttcaatggatcgcctcatgacacgccttcttcatgttcccagaccccaaggaatattggaaactcatttgagcattttgaatcttcaacaatggtgctactagaggaagaggggatcatgggaatcgtggaggacatggtggtggtagaaacatgaattcaaacctttgatgctcacattgtaagaagcgaggccacacccaagacatgctactacataattggctggactgataaaacaacaaatgtcaccaatcagaaacacttgatcctaagttttttgaagaggagtatcaagaataccttcgactgaagtccaacagtcaagctcaatcatcttcaagcccgagtacttcaacaacttgcatttctcagtttgtggatagtcaaggtccatttgcaattgattcaggtgtttctaatcatattttcggtaatgactctttattcacctctatgtctcctccaaaatttcctcatctgatcaccctagcaaatggcaccaatgtcgcctctaaaggagttggcaaagtctccattgcttctttaaacttggatccagttctttttgttcctaattgtccctcaacttagtttctcttagtcaactgacaaaatcattaaattgttctgtagcatttgatgttgactcctttgttatacaggaacttggaacgaatcggttcatcggcgtaggacatgaattcagaggtctctactatcttgaagccaacacatctatgtcttgttttgcatctttgtctcctaaacttttgcatgatcacttgggtcatccacatttgtcagagatgaagaaaatggttccgaatctcagcaagcgtcaggtcttagagtgtcaatcatgtcaattaggaaaacatgttaggtcccgaaagagaactaaaaacaagatgtaactcttctttttccacttttcactctgatatttggggtccaagtcgtgccacatcttttggtttcagatagtttgttacctttattgatgaatactctagatctacttgggcttatttaatgaaagattgatttgaacttttacctatattcatgtctttcttaatgaaatcaagacccggttttgaaataagacaatgataatcaacatcaacaacacctttaacccaagttaattgggatcgatggtggacgaacccaataataaatcggaaataagacaaagaatgagaaagggtgaggggaagaaaaagtggaaaaaagacaaaacaaaggaaaaataaacaaaaataaaagaagggtgcaaggaggagaaaagaagaggaaaagaactaaaaaagggaacgactggaacatgaaactactaattcgtttaaccctccaccaaacttatagtttttctctgctccgtcctaagacatatcgtccgtcaatctatgtcccactccattaggtcttgtttaactaccttttcctaggtaagtttcggtcgacctctacctctctttatgttaagctcttggtaacaaactcttgttcttacgggaacatccagtgatcgtctcatgacgtgtccaaaccatatcaatctatgtcccctcatccagtgaccgtctcaagaatgatcatgccaaagaatatttctcctctaatctctcttcgtttttaaccacaaggcattttacatcagtccacatgtcctaacacaccatagcaaaatgctatagcagaaagaaaaatggtatatcattggggtgatgccatccttactgcctgttttttaattaatagaatgtcatcttcatctcctgagaataaaattccttactcaattctctttccaaatgaaccattatttcatgtctctcctcgtttttttggttgtacttgttttgttcacaatgtttctccaggtcgggacaagctatttgcaagggccattaaatgcgttttcttggctactcccgtctacaaaaggggtaccgttgctacttaccaaacactagatgatactacatgtcagtaaatgtcaacttctttgaagaaactcgctttttctcttcttcaatgcaagatttcaatttagtccaacaagttttacctgtcccatcacttgatccactattgtctccaattcattaaatccctattatggacacaaatcaagccacctctccaaccagcctttcttcatcacctcacactactcactagtatgagacacaaatagagtaatctagtcctgtgtcacatggagagtcctttgcttcatgttggtcaccttcagctatttgtacaacggttccaactgaggatgactctgggtgcccaattgctcttaagaaaggtattcgatctaccagaaattcccatcctatttataactgtttgagttatcaccgattagtcaatttatgcaggctcctcacattgataattgaaatgctgtaattcgcattcttagttacattaaaagggctctgggacaggaattgttgtatgaagacaggggaaatacccatgttactgggtattgtgataggctctcctacagacagacactctactactggatattgtgtattcataggaggaaatctgatttcttggaagagcaagaaacataattttttttctggcttcagccacttgtgaactaacgtgggtcaaacaactcctccaagaacttaaattttgtgaagttcagcagatgcaactatattgtgataatcaggcagcacctcatattgcttctaatccagtattccatgaaaaccaaacacatagaaattggctgccactttgttcgagagaatttgttggctgaggaaattagaactgaaaaaattagctctgataatcaaattgcagatattttgactaagtcattgaggggacctaggattcagtttttatgtcctaagcttggtgcatatgatttatatgctccaacttgagggggaatgttagaaaataggttattatatccccattgtactaggctactgttctttttgactttttgtatctgctctgttctgagtttcctgtaaaagcttcctttgtaagctaagtttgatatataagagaagctgagtgttgagaaaacacttagcatttcatccaaaaatatctctcattatactcaagcatatcaatctggactttctggtcatacagaaagaatgtgctatgttaagtgcaagcaaatacaaaatacatgtcagaaacatattttctccccattccttcatctggcagcaccagaaagcttagcagtaataactaatgaagtagttagtcaattaacaaagatactatgcttcaaagttatgaaactctcttttacacactgcatacaaagtaccctattctaaactaactggattattgcataacaaaattcacattgagatagttaataccccagctaacagcttatacaacccctacatcataattgcttaaaattaaaaacaatgttgatttcaatctatacaaaaacaagctgaacaaaaggaagtccactccaaaggaaagaattgatgcttcctcacacataccgtgtaacaagctcagaagtttcagaatcccattgaagaacacagaatttgtatctttcagttgcaataaaaagataatcctgtgtttcaccctgtttgaaaccaaaacaaacaaacaaaaaaaatacattatggaagaataaaactacaacattagacaataactcaaaaaacacgtatgcttttaattttctcacatgagggcggaagagttcaagtgttgcaattcttccatatatcggcacatccaacataggctgcaaagagaggtttccgttgaaaacagaagacaacaaaatccaaaaaaagaatgcatattcaaataaaaatgattaaaacaagaagcctgtgaaatggaatagaggaagaacctgcaagccctgaggagaaagcaagtgaatctcgatgcgcgtgcatttcctggaagaaaaaacgaagtgaaagggtaaataaacggtgacgaaattgaaagagaagaaatgaaaccctaggaaaacgaaagggaatatgaatagatacgcgataatgagattgaggtcttgaggactggtgaaattgccgacgcaggagtgagtgacgttggtgggtttgtgagctgtgacgacgtagttccatatactcatcgttctcttctcttacacacacgaaaatacaaactctgattctagtgttctgagattacaaattgaatagggttccgtttcagttcggttcagagtggttaaccgcttccggtcagggcgtgccccacaacaagcacctcactctcactcaaacactttctctcaggccctcccttgggcggcttttgtcttttgccctcgtctcgaagatgcgccaggtaaagtgaagtgaatcagtgttataaaactctgcccgcttattgatttgtagagattatgggtggaaaaaaaaaatcatatccacataataatctatatctaattcaatttaatttattttaaatttatttaaatggattaattttatatttaaatatatttttttagattttaaatctaatccaattaattggatataaagtgaatatggattgaatatttgtttgaatttttaaatctaattttttggcaaaaatatcatgtagattcttttgtcaattttttttgtcaactttgattgagactatttttttggtcgacgtcaactaatgatacttttaaactgtcattgttgagtctattttttcaattaatgttagtaagatttttttagtcaatattgattgagattattttttgtccggcatcagtcgatactattttttttttcgaaatcagctaggtttttctttatcgatgtatgtcgaaattattttttgtcgacatcaagtagatttttcgctcaacgtcgactatgatttttttttgtcaacgccatacgagacaattttttgccgacatcggttaaaaaatatcgatctacatcagccaaaaaacctagttgacgtcagccaaaatatttctccaaattgacaccgatcgaacaaatcctagttgttgccaacaaaaatatagtttcaaccaacatcgacaaaaaaatatagctaacgtcgacaaaaaaaagtcctgacgaatgttggcaaaaaaatatcaatgattgacatcggaaaaaaaaaaaacttatcaatgttagccacaaaatcctaataaatgtcgacaaaaaaatgtactgactaaaaatcctggcgacctcaaccaaaaagtaaccctatctaagatcgaccaaaaacatcattgaccaatgtcgattgaaaatgcactgactaatgtcagcaaaaaaatagtcttagttgatgtcagtctaaaattgtctggaccgatatctgtcgaaattgctttggttgagatatgtcaaaaatacactaaccaatatctataaaaaaaatagtcttaactaaggtccattgaaaatagcttttaaatggacaagtacttagttttcactttttagcatttaataactaaaatttgtaaaaaaaaaaaatcttacaacaattaagtgaatataaattaaatatatccaaatcaatattcatttaaatggattggatcttgagtctgaattattttttaaaaaatatggatatggatttaaaatacaatccatttaaatagatatgaattgaatatggattgaattcttaaaaattcaatcaatgcccacccctaggtgagataataggtcagttgtccaatcgacttaccaataattgattcaattttatttgatctattttaaaaaatttaaaattatattatatatatataattaacattatttgattaaaaaaagttcatccataatttcaaactcaaaaatctaaaataaaaattgaaatattaaagttgataacacaaataaaatgtgttaataatataaaagagtttaaataacaattatctaacttaaaacacaagtctagttttcaataaataaaataagtagaagtccattttaaaaatgcaaaatggaaaccgcataataaaagggatgcacgaatcaatatctagcaaaattaggcccaagtccaactaaaaaacctctaatccctaatatatattcttctcttgttgttggccatcattcttctcttgtgcattctctctccttcctatatcgccttttcgtctgaaaaagagccaccacctttgctccagttccctcctataacaccatagttgccttccatgggttactattcgacgacattctttgctctgcgttaaagaaacccaaagcgtgaagtgacaatttttcgacgacattatttgctctacgtcaaagaaacctaaagcgtgaagcgacaatttatgtcttctctacctttgtcaacgatttctgccttcttgttttgacgacaacgtggtgggctggtgtcaatcaaagcgtgaaggcgacaaaggtgtgaagtgaaagtgaaacctagaccaaatttcaaaaatcgattggatcaccaagtcactctgcaaaatcggtaaggtctggccgggtcatctagggctagatacatggccggtccaataactaaaccagttcgattatgccaccggatactggttggacagatccgatgtactggttccgatcaattttcacaacatcgaagtgagtgcttattttcttccatttttagtcttttccttttattgaaaataacatataatgataagtgtttatattgtatgtttttaaaatttaagcgtacttttaaattataaattcaaaacattttaaataaaaataagtaaaatataagttgttttaatttaaaccgtaaaaatagatattcaaattttagtttttttctatttgtatgtgaaattcgaaaaaatttatttcacacttaagtaataaagattaaagacctcaatttgaaattaaaaattatctataaggcttaaaagttaaaatatagtgaattttaaggattttgtggacataaatttcactttttaaaggaaatttttatcatttagttaacttattagtatatgctaccaaactttgccaataattaattaattatctttagtaaatttttcttttacttagactttttcattcataaagtttaaatataatattttgtttaaggggtttggttttatttccacttgaactaacatcatattggttgttttttccttttcattatatttattataaatattttcttagtttgtcatttatctcagtctttaactttttagtgagataccgcaatctccaattttttaagtaaggtttgattatttgaagtttttcttcttcttgatagcatattatgagcaatattgagattagaccaattattgactcaatcacaatattggtcaataaattattagtaaacctcatgattgatacaattggcataataattacaagaatttaatgtttatgcatgggtaatgtaaaacaattttattttatcattcaatcacaaattattatttaaaatattttaagataattattttaaaagtcaataaatttatcatgcacgatagattgtaaatgaatgacctatataactttttacattataaatgtataacatttttttatgattagaaatgtttttagattatttttttgcataatttaataagcaagtagcataaatggtaccaaacataagggagtaagcaaagtaattggtttaattccttggatgccagacttgcattttcttgaaactaggcttgcatgacaacgtgaaaatacatcgcaatgcatttagtctaactactattatttttgttgacttacaagggcttaaatagctcgaaaaaaataccagaaaaacacatatacaatcctcctattgctgatttctccgccaacaaactagggatagcaaaattatgggtctgcatgaaaaagaaccagcctatgagacaaactgagagcatgtttagcaaaggcatccgttcatgcattatattctttgaaaatgtgcttgaaagacatcatcattggaggctcaatgctgctctttatagctcaacagatctgaaaacagacatcatcttcgttgcacccatcaaggataagatgtatatcttctgttgagtcagattgagatcctacttgcagaatctgtttttctcgatctagcaagttgaatgtcatggaatatgacctataactctgattgaagaactgaactcactcccagattataagcaaagcctgccataaaatcacccacatcatttctaagaagaccatcacacaatataattgcatttgcttgagatctagcaccaacgcaattaagagtgaactaatttccttgggatgaatttcaaatgaaattattaacttgaacattgttggaattatttttgatagttccctcttgattcttggtaacatgattccataccagctccatcttatgtaaccgaatcatgatatcctctttgcttcagttttgatcttgaaacacttcaaaattccttcgctcacaaagtaaatcaattataaagccaattgaatttaggtcaggaacatattgacacaaattttaaaaatttaaaactaagataaatttttgaaaagataactataaaaataatttctcacgataaaattaaacaccaaaaataatttttgagaaaaatcaatatacattttttaaaaatttaaatataaaatactactcatgataaagtaatttattatataaaaaaagaaaaataaaatttatttaaacagcgaaactcagatttacaatatgaataactattcattttttttagaactagctagtccttttaccggtggccttttatattaagtgtaaattatataatagttagtttaattataatttatacttaatggacataaataatacaataaaaggtacaactatcttttgagaataatgtataataaacaactgaattgtaaaaaaaatgttcaattaattttaatattatgaagtagataatattatactgaaaaaatatgtagataataatgaattaaaaaaaattaattgcatagatattacttttactttctatgtttgttattattatttaaaaaatatttttcatagctataataaatgaatacacacattcaaacattcttaattgcaaaaacattatttcattttgacttatattattttcaaaattaaaaatataaatatattctaattatttaaatttatttttaaagtttctgtacactttttaatttatttaaaaacgactgaactatatataaaaagaaataaaacacggaaacaaacgcattctttatcttaaaaattaaaattaaaaactatttttaagaaacaaaaattaaaacaaaaacgtttcttagacttaaaccaaatatatatttaaataggagatagtccctaatggcaacaacaaagaaaagggccacaggggcagtaagcagagaaaaagaacattacacaaagggaaacgaataatgtacaaaactacaaattaagctgcaaaaagagattatttgcacgattagagattcttgtcctgacccaacatgaaagctaagaataccttagcaacaaaaacacaattaaaaaatgctaacaaaggtacattccctaaccttcctctaattcccttttccttttgtcctcggtttggccgaccatagtcacatccaaaagtatgaaagcagtagcaaggcagcaagtttcgaccaaacgaggttttggttatgcttcctcagtgaagctggcgcagaagcaactaaagatctgtcgcataaaaatataatgatataaatgtgagttaataaaatgtatacaaacttctttcaatttaggctatgtagttatgctattaacatcatacatacccagatgtagaatagacacattttccataacctgaagtgaagagaaacatagaagtttagaatgaattctatttcaaaatcaaagtatgaacattctgatgtgaacactccaatggttgagtattaagtaattcatctagcaagactaagatcaaaattccaccaagcaggaataaaatttaggggaagaaactaagctgccactactctgcacttaattttcagaaagcatccaacaaaaatgcgtaatatgtacacttttatgtcatcaggaatataatccaatgtacctacttattatatataccaactcaaaacaattgcttattgaaaagtaaaccttctggtgtcttctaaaagaatatcagtatatcacatcacagcacttcatgttataaaaaccttttgcagttttacaaagaaaactagttaattttaaactttaagaaactagaataatgcaaatgcaaaaagagaaaacactcaaacaaaagtaaactagaattagttgcttaaccacccgtcttttcaacacctcacacccttctcaaacaaaaaagaacgaaagaaaaatgccgaaagttctagaaaactttacaaaatgatattcatcaaccagctgatcaatgtataaacatatttatatttatattcatcaaccagaaagaaattcagtaaggatcacacaacaactaacgctattaataaagcatcactatggtaccaaaagggaaaggatgctacgtagacatcaaaacaaaatagcaaagaggaaaagtactaaagttcccaagatccaagaggcgaaactgtttgttacttgcgatcttcacataatgcatccacatattttatggtggggctatggaatcttcatcccatatttcataacataaaatttcccacagcactaaacaaagatcatatttagataaacttttcaatatcacttacaggtgaataaaataagaagatagaataaattaagcttttgtaagttaaaatcaatttatacactttaatttttatagaagatctctcatttaatttatccaaattctaaaagctccctcatataacttatctaaaaactgattataactcatgtataagttaattttaacttttattttattctatttgagaatttttcgaaaagtttacccaactgggccagaatttgggttacattaatatttaacttactggggttatgctttgtcaaggcagcagttcctccaaaattgcatgcaatatcagaattgccatttatctgatagtagctgttgaaagcaaaggatgcatgagaaactagtgtgtctggttcaaaacatggtccaccattttggatggctgtgcaatctgccattccaagtccacaagcccaatcaagagcattctgcaagtcagcctgggaaacaccagcaagagccacacaccaagtagtgccatcaatgaatgtagtgttgccttcaggtggtgacaatgttgtcactgggattgcagcttctgacttttgttgcaccacaattcctcttgccatggctaaatatttttgccagacatagaaccagtaaaatcattacactaattattaaataaataaagaaaacaccaaaccaatcattcaatagtattgtatttcgtgaagatcatgcgatagcatcaacagttggtccaccataaattaacaacacgagaaaaagaacaagtgaataaaagaaagtggcctcatcactttatagttatacatgtctgatatataaagtatttagattagattatttcgtggggattgtggcatgaagcaaagaatttgaactccatcattcttatccttctatccctccttttcaaactaaaaactaccaaaaaaaattgacagtttcgtatggttcataaataataaactattgggtttagggtttaaagcccacaaaaagaaaattaaggttacaacttacaaataatgactcaaatgggatacagcaaattttttgtcacaactcacagcttcacaatactcagaaatgcaactcaacaaaggattaaaaaaatcatgttatttttttttttcctgtttacaagacaactacaaggtgcaaaggggtcgttgggtaggttttgaggattaatttatttttattttgttctcccccacttgacaagaagagtacaaggaagagcattaaacatgcttcctctgattttttgaagagtcaaaaatcagcataagtcacaacattttttgcctacctggttaacaaaaaccaatgagcccccttccccttccccttcctaaaaagaagctataaaatttaatattgcaatgataaaaatggaagtgaccccaaataaaaaagaaaaaaaaaagatttattgattagttaccaagaggcagagaacactaagatctgctgaattgagtaagttcaaagaaaatgtgatccttttagcaaaaaagaaaaagaatatgtgatcctaaacttgcacactgcatagcaagtaagaagacactcaataactagtaaaaaaaaacacaaaaaccagagaagaaagtgcaaacaagaaggggaaaaaaagagaagcaaaaccgagttatagattgctatgaagagacaaacacaaacaagaccaaactggtactaacaaaggagaaggatgacatacccagatagcattccataaaaaacaggaacaggaaaaggcacattttgtttctcatgtttccagctacaaatgaccaagttgctccaaaggttatatagaacttaatattccaagctttacttagtactctgactcctgaagaaaggtgaaatgcaatcactagtgctataagagtagcagtgtcaatggaatcaccggttacttgaaggaagatttcattttttttttctttttcactttttgttgttttaaaattatttatgatgaaggagaatgcatccttctgaagcaagtactatctttgacagactacagcagaggatacatttgagcaattgagccttttcacgctcacacagctacaaaaggcagtagagtcctgcaagcaatataaagcctatgttattatcaattgattaattgataatgttttatatgccatttatttggaacagtgcaacaaaattcaatttgctataaaaaaaatttaaatagtttcatatgatttgaattaaattaatgtaatttgaattgatctaaaaattaaacattatgtttcaaactcattataaaaattttgatttaattttctttgagaatcactgttataattggaatttatggggaaaaatgaggttttcttttataatattataatttctcctgtcgctaaaataagttataataatacatgagaggtaaaatttaaaagtgtcataaactatctatacatatgtacatacaaaaatatttttaaaaaggaaacttatacgtgactttctcagttctacaaaataaaataaaaaattacacatagtattttcaagataaaatgatttgattgaaatattcacctaaaatattgatatgattatatacatttgattgtatttgaatttgaataattgattattagctaattagacaatcaataacaattgattaaaaaatctataatttgaataactgattatagaaagagaaaattaaaaagtcaaagtcactaggttggcaataaatattggaaaaaaaataaaggtccagacgttttttttattattaaaaagcaaaggctaacacaaggtgagttaaaaccaagctgaaacagttacaataaatcatagaatttcccccctcccccaaaaattcctatgtgaactgaagtttgccccaaccaaaatggagatttttgtaagagcagaaatatatatatttccaaaaattcatcctctaccattacttattaatgaacttctagtctgcacattcaattgatgacttgctccttgccaagcattcatatacgagaatgcttttcatgataaatcagccagtaccaagcataaacacaaaaactcatcacatctgcatactttctatatatcagaacttaatacaaaggataaaatctgacaggaaaacctcaccatcttcacctcgaaaaaccacttctcagtgttgttgattcaaggcatgcatatggattcatcatccatgctgacagtgaataccagaatcccttttaatttctgtgcctttaaccgccatttccaagccattacatttacttaagctgattccagaatttcttggctctgcaccacttcatttctgaaaatcattttcttccttcccatccaaatggccctgatctatgatctatcaataatttagtttataaattataaaattataatgatcgttaggattgatgcacaacaatcagatttttaatagttgcatgcatttttatttaccagattttgatagtttatagtaaattttgcacaggtctaaattaagactaatgtggtgatttttaatatttgatctttcattatgtaacatatttgttaatattgtgcttggatttatttatttatatattagctagaaattaatagagatatgagtggttattgtttgttcaagatatgaatgatttacagattgctcttatttatttattcttttgaaaaaaaaaaatcatgtcattttcggttatgctatatcaacacaaggacaatttatttattgtgtaacatttttaaagtttctactttatatttttctcttaatgattccaatttgcatcatcacattcataagttttaattccccatttccctttttctgaacattttcctttcatttttcatgagtgcttatatgtctatattttgtttttgtgtgattcaatgtgctgcttattggatgttgggtattgctatcgactattctggaaatgttggattttaaaatttcttgggttttattttgtttcagattatttgaccatgtttggaattcacacttattttataatttctttttagaattactattttttttgtttctgattttgaaatttcgtgcctctaatttattttgtacattaacaatagacatcatcaaaagattatcaaacgaattgaaataaaaaactatccttgctaacaaaaaacctggcaatcaaagacaaagataatttgagatacaccaatattaataatggttttgtattgggtgatatgcaagacttctaaattaaatgtatagtaattgcatagccaagatgttgcataagagagaagcatttagcagtaatgagcaaataaactaagtgatcaaatgaaaatgataacaatctaggatctaaatacaaatatgctaatggtaacaacttacttgtctttcaatataaggagtttcatgttctttatttggatttcaacatgatagtcaatctgatatttgttatatgtaaaagacaatctataagtgtatttgtgtgcagagtcgattacaagttcaatacatagatgctcaagggggttaaggcttagtggtttagcttatttactgtattttggttgatgagaattttctttcaatgagtagctgatgtctagattaatctttgatgcttaattatgatacacataattgatacttcctagctttaatttctaaacaatgttatcagaatgtatatacaataattttggaaagagaatagaagaaaacaagcacatatagaagaaatttgccatttcttagtagtgtcatttcccagcatcttaattgagtccgagagaataggaaatgggagtcatgaattgtgccagtttctcttgatgctttactttcattttctatgaatgaaacgccccctctgtggtttcaactctgtcatgttaaattggtttagttgctttgttgtaactcgatttgatcaggtttgctgtaactcagtcatcttatcaattgttgtaactctaaatttgcttgaaggacctttactacatcaatggaattagatccccaagtgaagagcagatttagaggatctctactaggctgaaatagtttggtaccatgaaaagtcataatctttttttgtttcttctatactgttgccaccaccaaaaactgctttacactgttgaaaactgtcactcaacaacttcattttcttctttatggtggtcatcacattttcataattatttttcatcactttcatttttcacctattgcggctctaaaagtcaatttaacccgattcaccttgggtttcaaccttctgcttcatttgcactttgagtttagaacaatcatgttttttttttcttttgagaaattttttattgacctgaaatgtataagaaacatagtctatctctataatatggaattattgtgaacctttcaagttaccaactggaagaagaaatgtgctttattggaaatgaacataagattctatcccccccccaaaaaaaaaaataattgcactgtgatttactgcttttcatttccaaaatgagcaaaacaacaggtgtcgggtgattgtgtagaattttattattttcctttttaaattccaacttggtttggatatttatctgagaatttattctctcaataatttcttattctgtgatataaattacaaactaataatgttgagattcgatttacttgctgattatcatttatattaacttgctgtattttcatttttatcagattcgatttatttccaatcacttcaatccagggtgctacaataaatattgattgtatttgtcatctttttatttgttctatttaatcctttattgctaataagtggaggtatgaatttctacaaatcttagaatgctaataagtgttgcagtgctaatattttcttcataatttatgtgcaagtggggtttcgtaatcctttgaaacaattcatggagtagaattctaatgttttattttaattgtatgattcttttgatttgaagttgtttcagtaaatattaatgtgcttctctatgttccacctttactactcctcacgctgaagttagatgataagttggatatgggtttcaattgttatatatcactcgagctaatttgaaaatctgttattttttcaatttcatttactagactaaaaggccatgaccatccagtgagattctaggtgctttgtcaaggaggaaaaaaaaggacacaaaatatagataagagagaggcttccgatctttgccttagttggctagctgctgctgattgctacaattggagtaagaattctttaaggaatacagttgctttgctcattctccatttggaatgataaaggttgtnnnnnnnnnnntatatatatatatatatatatatatatatatatatatatatattgtgccttaattttgtttcattctattttagtttgaataatgagcatgaaaaaatgataagaagaaatggactcatgggtaattttgcctttaatgggttagatttataatttgttaataaaaactgagagattaatgaaaattgatctcttactttttaattgaatttccatattggagtgcacaaaacaaatcatatttgctgagcttaagtccttaagtcctcacttggttgaaaagcatgttcactgttgcccagtttcatccccaattctttctactgatcaaaacaatgatactaaaggtttagacttttcattcaatgtaaattagaaaatgtggactgttgttctgagtgtagaaaatttgtttctaattggttttatattcaatgtgaatgacttctataatacgatgagaattagatactgagttatactgaaaccagtttcccttttgatttgcttctttagccaaccccattatgatgttagtaacataaaggaacttctacattgctaacattatctttctcatttttctctctctataaatacttatctatctgcatttacaaataatactcttttcttgattttccaccttttattttctatttactttattagagaagggaaatgaaaggggagtgtatgtgtatttaacaaatgtaactggaattgaacagggaagaacttttgaatatgctggaattcaataatttctatgttcagggttattgagatttatatgacagaccatcataactaactgttgattcaacaattatttagaacatagaatgcaaaccaatgatttggctgagaaggaatatctaaggggtgggaaattatatatgttgttgatcccacaataaattactttaatttgtgatttataaattcaggatgatttgcatgtgatttctttgagttctgtttgcctcaaaatatcttttttcctcatcttttttttttcctcttctttctttcactcaattcaaaatttgagcccatccaatatcttattatctttgttttcttttctcaacagattttaacggtgactgtccttggatttgactggagtaatcatcaagaggcagttgagatgggcatcaggggtttattttcttttatctttattcatttttatgatttgtgggggttctctttgacttatgttgtggttgagtttctggtttttgggttgtgagttccttttttaaaatttgtgatttccaaattcaggatgatttgtgtatgactctttaatttttgtttcactattattttggtcctccaaatttttttgctaaacattattctttatgttgtttatttgtattttgtacttactctttaagcttgaagaaaagaaccttgaccctttaaattttttatttcactatgttagcatttagtggtttttttttacctcgtgtaattttctttctccttttctcttctattttctgtgttttttctatttgcaaaggaaattgatgttaccaggatttaaaatatttaaattttattttatattgtatcaagataattttttcctatatcttaaatataaagacaaaataacccttaaaaaattgtatgtatccttatacccgcatatataataactttaaataacagatttattttgttcaaatatcaacttctataaaatcgaattattttgtaaatattccttttctctttagatataattatgtatattatttaattattttaattaattatagattttatagtattgaattatttaatttgtatttttaatttttacttaaattaggaaaaaatgtacacaaaacatgtatcataaatcaataagtagaaaacatgtgtatatactatatataaatggaccattaatatctttatttaattttatttaactttgatttaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgtgttactggtttattttgtcattttaatttgtatatataatttaatttttaattaaaccacaaaatatgtgaatcaactgcaaatttgattattggtttaacacgtgatctcaactcaaatttaaatcttgctagctaggtaaaagagaattttgatatcgatattaatcctatttggcttgagcaacatcatatcccaaagaggatacacattgtctctattaaaaaatccaattaatccacatctatagtattattatacaaatttaaatataaaataatattatttgatttccatcaaaatgtttggtttcctatcatttttaaaaaataagtagatttttcatgttatttggttatgatataaataattgattctatctaatatattatattatttatttttaaagaaaataattatacacattaattatttttaaacacttatataaacaacaaacttgacccgtgcgcatgcacgcgttaccagttagtttgctaataaataataaattcaatcttcttatttgttgaacctcgatttctttatccacccattggacatgtaataatagaacggtttcaagttccttaagcatataattttgagttaaatcatgataatatatgtatataaaaatatatattactatcaattaagaagagatgaagcctttaacatttgagctgaccatatttttaagtgattgatttttcggccatttatctgataagaagatactcaggaactaaaagcatacatttaatttgtaccatgcatttttatgaactaaagtatgtcactaaagacttatttaaatatgttaaaaagtttttcaatagctaaatggttcaaagagataaggacctatgtgaaacagtttttaactgaaatatgttaaaaagttaaattgcatcctattaatactaccacatgaagagtacatgtgactcaaaatatgtcactaatgaccttcctacattattaaagtaatatagtaaacaaagaagtcgtattaaaaatagatacggcagctaattgactaacatctccaaaatctatgttataaaaacagttaaagcccttaaaaccggttgactcgatctcaatcgatctatcccatttaaaattctttgttgcggaaaatcgtgatttagtattaccttactaatcacatgatttaatttggattctaggcttaatatcatatatcatatggtgggacaaaatctgtagttagatgaacaaccactgatgaaccaatttttatattataaaaccaaagaagacatagaaacaatgtagaagaattcggcaacatacggcgtggacatcatattattatggtaccgaggaggagaaactgagattccacatcaaattttccatgcatttagctaaacattactttaaagccatggtcacagaaggaacaaaaatgaagaaaagtatataatttaactatcatttttaataaaattgtctgtttattatatttttagctatttaataattatcttaaactaattacgttttttgtttttatcactggatttcctaaacattcatacatgaaactataatctaattagacaatgattaaactttcttttgtttataataaatcatagacaagatnattattatggtaccgaggaggagaaactgagattccacatcaaattttccatgcatttagctatataatttaagtatataatttaagtatcatctttaattatcttaagttggtggcatgatgtcatttcttctatacaaagtttaattttacattacatcaagctaggatgagttcctgtctaatgtgacatattttgtctgattgtcggcctatcaatatagcgggaatattggtgggtgttttctttctaccatagacggtgcttccttgtaattgccctttgattcttccacaataatttgctcataatcacaatattctcgaaattttatactattatttagggtgtttctttcccctgcttcctttttcgatcatgattcttataggtttaattgactcttttgataaatattaataaaatttatttatttttgttttaaatatatttacaataatgatacgaaaggaatttatgcaggatttgtttcataagtaagaaaaatttataaacgataagcgattgcgatataaatatttatattagaaatttctttgaagtatatatgagaaggggtatgtgtttgaagtcattttaactaacttattgcctattttattaatttagatacatatattcactgatgtatatattcaaaatacgggtacacaattaagttttatagaaagaaaaagtttggaggatatatcgaactctattcaacaccaaaatagggaaagagagaataaagaaaaaatgtagatatatgctcattttagtaaagaggaaagaagtaggttggatgagaataaaaaaaaatgtgtgaaaataggttaaaatagtacactgaactctactaattttaaaattagttatcctctaaatttctccaccaaaaaaacctaataattttcatctgcttctcttcttccgttttcctatctattaaacagagacataatgggtgatatgatataataataatcataataataataataattaataataataataataataaaatattgatatatagtttttgatatgtagaggtgtcactacaagaagatcataaaaaagagacaatcaaaagtcggcgtaacaactagtctagctcctatcgcaacttttattgttggcaatgggatggtcttgcttgttgtgtcaattcaaatagcaaagattaaaaaaaaaagtagtatttttattgatgacattctattctctcctaaattaccacagctcaagagccaccacttgcaagtaattttcttttttagccacggccacatagaaaccaaaaacaatcattaaaaccaccataaaaaaggtaaaataaaagcaggaagaagaacaaggagaaaacaccattgccaccattaagttaatgtcgcctcacataatttgatttcaactaagtaagacaaagaaatccaaatttgtcacgattttgataataaaaaaatacatgctttgatcaaatataaatatgaatatgatatataactattattcaattttttaaaataagaatgagtacgaggatgaataaataactatatacccttatccatacttgttctaatatgttttttataaatttttgttacatcacacacccatataagattttcttgttataattttatataaaaataattattttaatagataaatggtttaaaattattataataattaactaataaatttaaaactatatatataactaaaacacaattcaattcttaatttttttaattcttttatatatttattatttttatatatcacttgaattaaaatataattaatgacttaatacataattaatttaaaaccttataagtgaactaaaattataaaaaaatgatgggaccggatatccatgagtatttccaaatttgataaaatccgatggaaatgagaataatgagtattaaaatttaataaactcacatcttttatattctatctcaaacatatccggccttctatggagatggggatggatacccatttccaacatgttccattgtcatgccgaaattcaacgtctcaataacattaatttcaaactttgcttactcttctttttcaaaatttcagaaaagaggaaaatgcgaaataaagaggtaatttttttttagttttagagctcaggttatcatagtggatgactaggtcattgcttacatttaaaaaattcaaacctttaaaaatcaacggcaatagcctagctgtcacatactttaaaaaataaaaatagctgttacggtttttattattaatattgacattacctcatatcgtttcactaaagataaacgattcaatacaacttgaaatatcagaaaaaataatggaggaagcataagagatgactgtccttgctaacacatgagttaccatgttgatgaattgcctcgaaataaacttgacttgttttgatgaatagagagaagggttctgcattatttcaggacatcatcacccttctcggaaaggtcctctcttcgaactcagatgtagggaagcaccccatttgagggccagcaggcaaatggctgttcacgttaaaaaatatttacgtatattttaaaataaatttatacttttgctctaattttactaacaattttagtcgttgctatatgcaatagcctcgaggttattgcctttggtccaccgctattatggtaatttactataacgtgtttatatatcaccactcaatattaaaataacacactaactgtatgtactaattgtattccctatgatgcttgcttgtgaagacggcaaataccgcaaaaaagtagaatataatagtatgtttgattgtgaagaaataaaagaaaaagaacgagaaattttcaaaatttagtatgagttttatactttttttttttacttttatttaaatatttcttttaattcttttctaaccaaaccaaccataagggagtttaattggcccacaagtatcttttgagagagattagttagaatttggagctattcaataagtgagttttttttttctatcggcaaaatagtttgatttgttatattctgttttgctaaatcagattttttggtagatatgaccctatccatcagttgataattagtctgctttagagtatggtttgtgccatcgggacaatcaattattggctcctctcgttcgtttaggcagttgcatactagttttctttaaaagcattcatggcacattcttttattgcttcatatttttttttagtaactaagcaatctcttatgaacataattatcaacaaaaagtaagaattaattaaagtgcatggaagggtgtctggttggtacgtcagtaaatgaaatgaaagttagctaggttcattgcgttgagttagtgtagtgtttcaaattttgtcatgaacctcaaaagcaaacaaaataacatcaatagtaatgtgtatttgggtttccctttttgggataacgttggccccccaggcacaacaattccctttgatacactttttgttgttctttcccaaaacaccatccaattcccgtccaaacaatcatgggtcccttatgaacaatttcttctacatctacatcaacaatagtgagaaggtgagcatcaaataatacaaatatcatgtagggattttagggaattattcctttttattgggacccgattatttcccgtcaactgcatgcatggaccgcacttttgcatactttattgtacttgatgtttatttaatgagaataatatatacatgtttttttttatcagcaaaaatgtatattatattaataaggaaagatttaaggtacaagtagtgcctaaaatcaagaaaatataagacgaaaggcccccaatgtatacaggttatatataaatgtttttctaagtgaaatttcatatactgtatcatattgtcattaagattgtttgcgcactaaatcaatttttcacgctgactcatcttgtgtcatatgtgaatttgacctaaacacaataagtaacatataatgatctgtgtaaacgaaacattttcaatgatattattaccccattttgtttttaactagctgctatttttaaaaaaatatttaaaagtttaatacaatatttatttattatatatattttcaactaagattagttgtttcatatatttatcacgaaactaaacagaaatgaaaatataactgataagaaaattaatcaattaattaaagaaaaatacaataagaaattgaataaaaatcttaataaaaataagaatttcagatgtatttttaaatttatgaataattttttactcattgcgtatttaagtgatgactaaattttttaaaatatccttcttaagaaatatgagaccgtttatgcttgagtaaacaaaaagaataaaaaggaaaatttacagataatattattttgtttgattgaaatgaagataaaaaaataaaaaaaaattgttttaaaaataaaatcattttctaagataatttttaaaaaaattataattatttttattttctatttaatttgaaactttctttgctatattttgtgttgcaaaagatgtaggagggtgatcctctgcatttaattgccattattagtcccgctgctccctaccctctagacccaatacgttcacgcagtaccacctttggatatcggttaaataaaatgaacggtgatagttacactacctattatatcattttcatatcacatcaaatgattactctagataagttttgaatgctggtttttaataaggacttgctttgaattattttagttatatttaaaatattttttattttaaaaacttaaaagtgtgcattttcttaaaatctaaattcaaacaggagcgtgttaaaatttaattaatgtgcccgtgagtttaatcatacaaacgaaagtttcacaattattaatatataaaaccacggtatgagattaatttctcgattcagaaaaaaaaaaaagatcagtttcttgaaaattgtttcactttcaacgtcattacaaatatttctgttatctttaaataaataatcacttttaaaattaccacatactttaaattatgtgcacatttctatattttcaaataaaaattcatatgtaattctatttcattttgattatttatgtatttttatagttttaaatacttttgaaataataaatttttaaatttgatataaatttaaaaaattcttaatttttaatgatatcgattatttgtcttttttaatttaaaaatttgttcatttgatataaattcaaataaaaactttgatagttaataacttatataaaaaaatttaatgaacaaagagatcaaagaaaacaagccacgttattagaaaaaaaaaggaacttatgatactgacataaggtacaaataacaacaatattatgttacatggaaaattgggtgtgtgtttgcgtaggagtcacaccaaatgcaattggcactctaggaaaatcttccctcacttgctttggtgttttctgctttagaaagttaaatttttccattgaatgtgatttagatggttttccatatacactcttcaaatctaaatcatgacaattttgttcactaaaacaacgtctttctaaataatttggattttgctcccatgttcttaagaaggtcattcaacattttttttccaccaggtcatcatcatatgctaatgcttcttaaatgaattattcttagatccgtttgtcccaatgatagatttttcacttggataaatgaaatgagaatcttgattgtaatatatagaaatcattataaatataattcttattttcctttgtaagattgtggccgggagaaaaatctaagacttattcgtttaataaactaggaaaaggtataagacactgaacgaatatctcagaaggacacaacctaatttatctaaagatgttgtaatgaaacaacattaatacatttatcattattcaattgttcatgtgcaacctgatgttttcctagtttgcacttaatatcaataacgtgtatattagactagcattatatattgataagactagtgtcgtttattattattattattattattattattattattattattattattatcaactctaaagattttttttttgaaaaatatgactctaacatcattttttgagaataaatatctctaaatacatttgtactactcctgtttaagagtcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataatgaaatgtttcctttcatcatttacagctcaagattaattagtatattattactttcaaactctaataagttaacacattatatttaatcaatgaatgtcttaataatacatttatccctaagagttcatgtgtactcgaaaatctaatttacaatcattttgtttaaccttttttttcctattcctttcacccctcttttatttttgcttattttttctcttttgtcttatttctactttttccttcctctctccctttctnnnnnnnnnnttattattattattattattattattattattattattattattattatcaactctaaagattttttttttgaaaaatatgactctaacatcattttttgagaataaatatctctaaatacatttgtactactcctgtttaagagtcagtcttacaattatatatgtgttactcccgtttagaagccattgatgttttagtctctctctatttcaaaattattgatatttcataaatttaaagtttcattttttgatcacatataactctatttagaataactagattcaatattcataaaaaaaacactacgcttacaacttatttttttttaaaaaaatcaacaaataatgaaccacatttatattttgtattagtgaaattatattaaattaaatagacgaatattttagacattgaatattttttaatatgtgtacattaaccttaaatattaatattgtagaatagaggtagtaaaagtaaatattcaatagactcactatttagtacttactcattttatacagaattgacaaataaaaatgtataagaaagaattttggctgtacagttgcactgtaatgttagactcaatttccgacacaggctaatctcgcacaagaagattcccatgccatgcagtggcttgaaagggattatagtcagaaaggccacgtcaagacttacactttgttttggtaaaggtaaacgaaagtttgtcaaaacagataaagtaaagataaaaaatattttagtgttaaatgataggagagaaaaaaaatcttattaactaattatcttttcatttctatccatttcagtcaagaaaagagaaaatatgtaaagataagatcatttatcacaaataataaagtatataaatagaaatatttaaataaaaatattttcttccatatgtctatcatcatattaaataagttaatttatttttcacgattttctttctagtcattttctgaaatcatacaaaatatcagggtgagtagtctgtagcaccacttatcccacttctgccgttgacggtgcctgggtgttaggatgtgagtccaaaaacatcgctattagtattattttcagcaaattaattaaaacaacttttttggctgaagaattagaatcaatagacgggcatatttgcgtgaacattatcattcactgtgtctctgcatctacaggcattatattgtcattcatcacctttcttatcatttgacatgactctctttcgtcgccaaaagctagtttgattccaaccccaaatttgtggttcttgataagtcaattattagaaacttttttttttttacattgcttgcagttgaaattcttcacattcattgaatcaaaggattaactttaatcatgttagaaaactctggtttccgtttgttttaaagttaataaagttgattttaaaaaaggttgtagtaaaaacaattgattttttgaatgaaaaattttgattttatacatttattaaacaagctgtaacactttaactaactgaattattgaactctcccataagtgagtttgaatgtacagaagagaatgaaaagaaaaaaaaaaaattaaagtaaagaggtgaaggtgtggaagccgtgtaaatttatgatttttttttctaactaaacaaaaggataaggatatttccgtcattgcaatgaaaaaagcttcccctacctgcaccggcacacgctcattagtaatcgattgctcagtaagttgtgaaagcttaagcaatgctccaaagaaacctctgccacgtgggaactcctcctcttctcaattcgtcatcatcctcacaaacaccaacaccaacacccacccctaccctactagttcccactcctttttctctattagtacttggcacgtgccaaaacttcctctctcacgtgcctccctccttctctgtacgtacgtgttgagcataaatacaacgcaaccacctctcctgtatcgcttcctttctttaacactcctcactctatttctggcccaaactgcgcctctcttattgctctgaaacgcttcgtaccatccaacttttattgttctttcaatttttttgtgctggctaaaccctaacccttcataaagccttcactaacagaaactttcgttcattccacacaaaccactgttgccattccaatttccgagctcctttctcttcttttttgtttcgtacagtgttactaccatgttagggagtggttgtggtggtgaacgtgattctgaggcgactttggagaccgtgaattcttcctcacttggaagctccatgagcagcgagagcatttgcagcaccagtttcagccgtctctccttcgatctcctccctccttcgccggagagtctctccatcaagcctcaccgctcctccgactttgcctactccgccatccgctccgccaccttccgccgcaaggccgctctcactttccgcgacttccacctcctccgccgcatcggcgccggcgacattggcaccgtctacctttgccgcctccgccacgccaacaacaaccaattcaacaagcaggaagaagacgaagaagatgcttcctgtttatacgccatgaaggtggttgacaaagacgcagtggcattgaagaagaagtctcagagagcggaaatggagagaaaaatcctcaagatgctcgaccacccgtttctccctacgctctacgctgagttcgaagcttctcatttctcttgcatcgtcatggagttttgttccggtggagacttgcactccctgcgcttcaagcaccctcacaaccgtttccctctcacctccgcaaggtaaaatttaaaacctttatccaaaacgatgacgttttctctgtttattgaactcacaatgttaattacccagattttatgccgcggaggtgctgctggcgttggaatacctccacatgctgggaatcatctacagagatttaaagcctgagaacgtgttggttagatcagacggtcatatcatgctttctgatttcgatctttctctttgctcagatgcaatcccagccgttgaatcctcagcagattccttatcattacctatcgcttacactcgctcgcattcttttatgactccattctcctgcttctcgaaccggctttccgggtcgcgcgaggttcgtgctattgaacccaaccggctttttgttgctgaaccggtttcggctcggtcctgttcctttgttgggacccacgagtatgtctcgccggaggttgcttctggccgttcgcacgggaacgccgtggactggtggtcgttcggcgtctttatctacgagctcatatacggtagcacgccgtatgcgggtccatcgaaggaggccacgctgcggaacatcgtaaagaaacccctggcgttccccacggccacaccaacgagcaatctcgaactacacgcgcgggatttgatatccggcttgctgaacaaggatccggcgcgccggctcggttcgaagcgcggcgccgctgacgtcaagaagcattccttcttcaaagggctcaacttggcgctgattcgcatgcagacgccgcccgaagtgcctggctcgagaaggacaaaaacgacgtcgttgtaccccgtgaagggtaactgcaacaacaaccataaacaacaacaacaactacagacgacgtcgtttgatttttactaatacgttgaaagttttgtgccacgtcttcagtgacgtactgtatattggagccgtccttttttatttttatatgaaataaaataattcttatttgattaaaatatattttaatctttcaatctagtgcatttttagtttttcgatcattcaaaattattattttttaattattgtaaattatgtttattttattttttatcttaaagtattttagataatatttttattatctaaatcatgataaagataaaaaaaacaaaataagtataatttcaaagattaaaaataaaaaaaaaaattaaaaggattaaaaatattaaataataagaactaaaaaaatatttaagtttttttatattatgtcgacgaaaacaagaaataaaattagtttgaagaaaagggagggggaagtgggttcgtgttgttgttccttttaggttgcttgtcctatgaacggaatcatcatagataggtgcctttaaaagctgaacttcgttctctatttcctcttatagaaaagcttacaggacactgggttggacaattctaaatgaagaagattccttgcttaatatcttttcctccttcgcatacacattagagcagtcaaaagaaaggttattaattccaacataaattttgatttgtttatgcatcatacggacatcaagtcaatattctgcctaaatcgaaattcgttaacttagaccatccatgatagatgattgtggagaaaaatcttaaagttaaaaatttattattccaagattaagttactagaaacaccttcaagatctttatgtttaaggtttaatttttgtaagagaatccttataattaccatgtatttttaataaaaaaaatcaatttttattatctttctaactaattgattataaaagaagaaaggaagaaaaacatatcaacaatagaattaagtccaaatgcaacaaatacataacaatataattttaaaacaaataataaaaaataaaataattacataacaatccaaacaccatcacaatcgaccaatgacgaccatcggagcaccatgagaacatagatgggaggggtgggtgggggaagaagagaaggtgggagggggaagaagagggggtgggtgaggggagaaaagagaagaaaaaagaaagaaaggaaaaagagaaattgaaggggcgaagaagatggtaagaagctatagcacactaacaaattttcccctttttttagactattactatagttttttcaatttttatgtaaatttaaattatattgataaataaatattttaattattaataaattttgtatatttgttataattttttgaaattaaaaatatataataaattatttaattattttaaaataaatattagaaggtaaatcttttgttaagtttaaaaaaatgatttaagatcttaaaataaaatttattattagagtaaaaaatttatgagatgtgatatgacactaagaaatctataaaaaggtgattaaattttcaaaataaatattaaatatnagaaccatgtaaggtggtagtagggtgtgattaccgtcatttatttggaaaacgtataaaaaaatatcaaggattttttttatacctaaacagggaacatttttgaaacggcaaactgagaaaaaaaaggtcaagtttacaactcatcattgacctaattaaagagtagtacgtaattagactctagttttttttacttgcttctgcctgaagacagggaacaaaggaaaaacagcataaagaaaccagcatataaatatactatatagataaagaaatgtgcgtgactttcttgcattaatcaatattcaattatttttctcctctcgtggatgtaatacacaatatataaaggatgtcaatagcgtcaatatttctcatttaatgggtatgatgaaaattcctaactagtactatataaatgtcatataaacgcttctgtagatttgtttttggaaaggctgtggattatattttaaatgtcatattgttgtttttctttattggcaatatgtgcatgtaatttaatagaaagaatgttgaccataatgtgcaactcacgtaaagaattgcaagactttaataggatatgttaaaacatgtcgcagcatgcaatgtataaatataaatagttacaacttgttcacgatgtgtgcctcaagatttttatgagcatgaactcatttaagaatcgatctcccagctcattaaaattctgttttctgctttatattgctactttcagcctttacagatatgttcattccatcaaatactgtcatgtcaaatatcatccatagagcgttaaaattctctcttctctttgccacgctttagaatgtccgaaactcttttctatccttgtattccagacaggtgagttcaccattttatcacttgcctttctaagaatcctttttgtccactgatgtagaaagcctatggttgaaattcaccgacataaattgtagaattaattaaaacatgtaattgtcttattcgattaatttttccagttgaaagctaggtcaaaatagtttttgtttttggtctagaaagttggttcaaatagttaaatcgatgagttggtaactcagtattgggtgtaatattttttttatcacatcaatgttaattattaatttctgttataatattaataaaaaaatcaaactcaccatctttttttttttgtttcttcaaccgttaaatctccttctcaatcacaagccaaccttataattgcattggatataatgttataacttttctcatcacatgctcccactttcaattaaacaggaggaatattagagaggatgatgattaaatattaaattaactgtaacatttgaaaagttgcatatcttaaaagattggggggattaaaattacagaatttaaaattgatggaacaaaattacaaaaattatagaagaaccagagtacagtttaacttaaattttattacaagtaaaatatttttaaaagtataaatttgtcaatacttaaacatattgtcaacgactctatccttattaaaactcacttacataatgatttggcaatgcatgattaaacgctagtgttaagaaaacaaacatgttcgctgctaatagtatagttcaataattgtttaaacttagaaaataaagattgttttatcaagaattctctctctctctctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactttttccttcctctctccctttctatttctttgttttattttcgatctatcattgagttcatctatcatcgatcccaattaacttgaattaaaggtagtgttgatgttaaaatgtttaagtgcatgactccaaattgacagtgaagggttgtgaacttcttatgcattcagggattgaaataataccgccataagttataagaggttaaaaccaaacagaacatttcaaactatcctaactaaatttaagcttcagaggctagacattgattgctgatatcgttactcatcagaaaattcaagcctcaggtcttatttcaaacagtatcactatttactcaacttaaccaaggaatctgaatagcatatattttggactaaaatatgaatagcatttatgaacaaatgctttctcatagaccgtgtcagctcaacacaatgtttaacagcacttcaagaacctattgtattggcttactatcctgcagaaatttaattttcctacaagtttccatagcaacctattcagaaactacactactatgaaacagtatgttggtgtgccactagaaataccacatatagttataaaaatggaagctaacagttttagtacaggtttaaacaatgattaacataattaactgaaaacatccatgaatacaataacccaataaaccatcctaaaaatgctgccatggagaaagcagagggaggggatgaagatattgcaaaactagagcaagccatccaccagagagcaattaacaaagcgtcccactttagatttagcatttcttatagtttgagctatcctagcagactcatcttgtgttctagctagtgtctccttgcaagaagtctctttatcgtatattctatcaagtaattgttggaactttgcttccagtgccttcttctctacctcacaacattccaattctttcttggcagattccatagcctttctgttcctatctttttcctctttcagcgtgccagactgtttaagaatatgctttgcctcaagtatctcttctagtctcaggtgaagccactcaatgttcactttcatatttttcatttcatttgcattaacaatcatgttatgcagctcatcgtctctgattttaatcagacccttgtcttccaattctgagaggatgtcacctatcacctctaagaacattgatcggaatgtcattgttgataccatagaattctcaaaaatatctccatgcttactgagaatttttcttaacatgggtatgaatttcggcttcacttggtatccttcaactgtgtccttcggtgagcttactccaaaaaaattaacctcatcaccatcattagcccacatattaaccatttcagtaatgttgagactgaaatgtgaggatgtatgtccaaccattgaaatagacttgctattgttcttgtctgctctttccctagagttagaggattcttgaataccctcagcatccaaaggtttaagctcaagaggaaccatagggttctcagcctcactccttcccgccatttcagctacatcaactaaccaattctctggagcaacaaaatctccaaccttttcaatctcttcatgtctgatttctggtgccaatgtgcaaggttgaacaacttgtcttggaagggattctggttctgctacagaacattgtggaagttggtaagcctgcacaaatgttgttctagtttcagtaaacttctttgctgatctcaaagaggcacaacgagcatgaactacagtgtaatctggaacttggttatcctgcacagatgttgtactctcaatattcttctttgccaatctcaaggaggagcgggttttagaaatgacaggggaatcttgaatcaaatgttttttcttagaaggagggcagtcccaagactctgactgaacatttaacacaggccaacaatgtgcaaattagaactaaaccattgataagggtaagagagaaaataaaaaaacaggtcactgcacatccttttattatgttactgaaaaattcatctgcattttgagtaccaaaagtacaagtcttattgatccttcatctctccccaacaaaacataaacttttttagatgtggagatactaaactaaacatttctgttttagtgcaacaatgagtattcacattgctcaactttcaagatggcagaaaagaataacaaactagtatgatggagaaaaatcaacatagtattcatatttctgtatcctacgagccatgcagctgctaatgaaactagtattcggtcctcaactttaataataacagagaaacagatcaaggaaatgacattaaagtaacttttcacgtgtgatggagcaaaatcaacctccacggttccacccttacaaacagcactcaagtttttcaaaatatttagaaacttgctaccacaatcatgtacttagaaacacagcaaacaatatatcagatagagagagatttttgatttgttaataggttccccaacctcacatgggtgaaaatgagaagtagagattatgattatattccaagttcacgtttctgccattttatttctacaaaaatgcttccattggaccattttcattctttgttgaaaacaatcatcgtagccacaaatatgctgcatcatttggaaacaaagtggataatagaattagcatgtgtctgtgttacatacctggctggattctgccgtataagattgagaagaatccatatccccggcttgcttccccttcttttttgttgttgttgttcttcttcctctaggcatatttagtgtcaatgttcttcttactaaacgtcaaagcaagacacttgcacagcacaggtccggaactcaaacccaaagcgcttccttattcaaactctctctctgagaacatattaattcaaacttgtctttaaccaaaaaacgtttatacttagtaccatctttatgaatgtatacacaaaaaaggtaaagagtattaagtgtatgtatatatgtatcgttactctaaaagtaagaaagcaatcgttttttattttctcagtttgtactagagttttcttcctttttgtgtgataaaatgtttttcttatgccatgggaataaaatctgtgttgtattgtatcttggaccaccacacactgggttaaatttgaggagattgattgaatttgagttgtcttaattacagttacacttactactcaactaatggtttcctatatataatataattgaaacaataggtgactaatccaaaaaaaaggaaacaataagtggcatgccttatttgtgctgcttgagaaattaacatgggcttgagaaggatttgactgggttataacttataattcaccttgtcatttgagtaaatttttagcatcaaagcaggttttaaagcttatgctgacattcccatcgctgctatcatagtcttgtttaaaattgttgaaactttatgagcaatttttatgtttgagttatgatataattaatataggttattaattttcactttattcttttttttattaacaaaaatgtaaaattatcaattgaaagttataatatagtaatttcaatgtcttaccatatattaattcatgttcttactattttacagcattgttattttctatagaacattaaaataaagtttaatttttttaagaatggcaatatttacaagtatcgttaatgatatttcataaattattatatccattttaaagaaattatttttaataaatttaatacttctaataaaatattaaatttcttttaattagtatttatttcaggatctttaattctagaataataaaaccaaaactatcaatatcaattttatactcactaaaactcaaaattgtgtcatattaatagaagacttattaaatgctctacaaaatatatatttttaaattacataatgttactaatgaattaattacaaatacattaaatttaattatctgatcatttaacttcaaagaaaaagtaatatatatatatataagtgtgaacacctatttttgttcatctttaatttatttttaaaaaaataatcattctttcaatttactgtgtttgcttaaacagatcccttttttgtgttaattaaaaaaaaatattttgtctatccatttctaaaagaaactaaaataaaatgtttaagaaaaaaggtaagataatagtaataaaacaagagagagatatagaagaatggagcagcatcttaggctggagactattttcagttttaggcaaacgcccttttggcttgtctttgctttattattatttgttttttatccccattttttctcacacattcactgttgtacactcatccactcttcctgctgacatgtcagcaacggcaatacagaacttgtctctgaatacaaacaaaacaaagaccattctaattttaacaaaaaagaggtcaaacaaaatctgaatacaaaaagggtgagaggttggaaatgtgaatgttttacctaatccctgccttttgttttctgtcttattttcaatattgtaatcttgcggatgcccttgatatatgtagcattttattttatgcatgtaataatgtgataactaaagagccacaaagtaatcttagatattcaagcaatgatgcgcttgatagcctaacatatcataaacattcaaattaacgattaacatgccaaatttctaacatgactaacacaacttaaaaacatatcccttattaattgaaacacgattccaaagaaaaatcatcgtaaaatagtacaacgcaaggaaagcacaagcttcagaagccatgagagaaatagttttttttttttttaaaaagggccctttgaaagaaatagtagtgcttgtttaggacttaagtcaacatataatctgaatgaaccaattgatttgggtatggacaccaaggaaacaaccaagttggctctggtaatcacatagaatatgttttatgccctttcatgactagtcctcctcatatacatcatatgaattcaactttatagtggaaaatattaatttcaattaaatctttcaatgctaaaaaactatacttttgaattagaaggtaatgttccagcattagttgtcccattgggtctatggatatggtaaatgagaatgtcaaaaacagattaatcaatcttaattcttaaatttaattagaaagctaagattgagattaaaagagtcagttaaatattgaaaagtactaaagagatttttttatgcacaaatattaattgttattattaacatttttgttaatggaagaaatcatacctactatttttttttcctctcttcattattcttttatgactcaaccaatcttataattctaaaatctaaaagccaatgatactctcataaatattatatactcactctatatcataatcctttaccgatgcattcaatgttgaatgagattctagtaaattaagcaaggggtagggcatataggtgggttcaaacaccttatttatatgctccaatcgtttagattggatctcaatctcatatagcaggcacgaaattacgcaaatggccatgttcatgaagaataaacatgacacagatggtaacagtgaacgggtataagttgtaaaatgtaaatagctacatgtaacatactctgtcgtccgccccatgccattttcttttagtcttttctctatttccctttagatatgtccagtttgagcatgatagagaactgattcaatgcagaaactacccaacaaccaaaaaataggaggtaatctaacagcagatgatgctatactttttaatctcatgcttagattctgaagaccatagtcttctgaaattcttatgctcagagaagtactaacatttgtaatttagccaaaattgaggataattaattttctacttttttgaatttatcttctgcgtgtaaaaaggaaattaatagaaatatttaacattaacttctcccttatctatcatattctgtgcgaattaaaaattaaagatgaccaaaattacaattttaaaaacaataaaaaggcaaatttcatgtcacctactaatttttaacatccaatggaaagaaagtttaaatttaatctctcttcctatcactttcttttccttctcactccatgctcccaacaaattctgagtggttgttggaataaatgatggcacagaagaggaaggtagaagtagaataaatattttgtttctatgattttaacaaagaaagaaataaagttgagtatgaaagacgtcttgaaatatgtttataccaacagtttgacaaagaccaaggtcaaaatttgaaaaatgttaatgttctcctatacaagaaaattcttaatattgatgtattcttggtatcaaaacaccaaaggcatgatcatgatcatgtactgtatatcctattgcttttttgtagaaaaaactagtgaacaacaattgagtaacttctccctcatccccaattaactctaaataagagattatttctggcttctcttctcagttcttagccattcagaggcactgctttctttattaaagtagggttactcttctcagttcttggtggaggtttgctcattcaaccttggatattagttactgaatctgaaatctagtgtacctagagtgtctcaagtttccttatagttttaaagcaagaaagaaaaatgagtttcagaatccgaaataacaaccaacaaactagatttctccgaattttaaaaattttaagtatccccaactggtctcaacatgattttgagtgggaaacccagtggccagaaaaacaaaagattaactatgttttttatacttaatttttttttttttgagttttcacttttaattcttgaaaaaaaaattgatcagttttaatttctaatgttttcatccatccatagttttagtatttaccattaagtttttttaataagtaataatatgaaactatcataatttctggccgtttaaaactgacaaaaagcctgctaaagtgattaaaccatattaagcaatctctgaagggttcaacgcaacgctcctccaccacgtcgccgtcaaaatcgacaaggagagcatcaaccaagggatacaaaaattgaaactcagatctgaaacccaaaactcagatctgtttttggacctcgaaacccaaaaccattatcagatgagtcgtaggaagctttcgcctctgccatccgccgctgcgactcacggtcaaacggcgccgttttgcaaacccgcccctcccctccgccaaacggcgccgaagatgatggcgttccagaggacgacgtttcagtgtgagggagggatttggagaagcgagtgcccgtagaagtgaagctgattttggacctcaaaacccaaacccaatatcagatttgttgaagagactgatccatagcgagaacaaatcaaaacgaatcgaagaaggagaatcaataattgcggaacacataacaatcttggctgccccgtagcgagaacaaatcgagatgattcacaactttgaatcctcatctcattagatgaacaattaaaaaacatgcagagaaagcaaaaacaaaaaatagaatgagtacgaattagctattaggagttgcccacattcaactattctgcatgtcgtatatcccttcctttcaaatccactaaacatcaaactttaaaagattttatgtaaagtagaaactgttgcttaaattaatgaaaattcaattaaaaaaattattatagcaatttgaaaaatataataccaaaatttcaatcaaatgaataattgtattttgagtctgacgatattggcatctcctgaagcaattaagccgccagaaaatagtttgctacattttaagcctttgttaaatgctgatgtagcactaattttattattattttaattacagtttatgacatttaatttttttggcgatttaatggtaacgacggacaaaaacattaaggaataagactggtcaaatttttatttagggactaaaaagatagttaaaaaaaaacaacttaaatacaacaataacatgaccgcaggaagtcacctaaatttggctaaaattaaaaaataatataatttaaatatttaattaggaaaagggtgtaaattttctaatatttagcaaaatggtgcagccaaacacacctagggttaggcgtgtttaaacacgcccagaatggggcgtatttcaccagatggtgacacgtgacaggcatgaagaggggcctaggattttcgcggtgtttttgtaaattacgaaagactataacttttaactgggacgtccgattgataagaaaccggcgcccacacgctcgaaattgagaggagaaggccaatgcaagtccccttgcccaaattttttttccaaacgaagcctctaagtgcctcaaaattacgatttaagtttcggagcctcaaaaatttttttgttttctaatattttatctactcaattagtgaattgcaagctattctttgtttatctaattacttgtcttaatttcgagccttctgacataaaatacgtcatcatcggacattgctacgagaaattccgactgttcaaagttatatgcatcgtcaattttgcagtataattttggataatttttgaaattatttttgcgatcacaacagcatgattttttaggatttatggttttgggttttgggtttaggtttatggttgaggatttagggtttatgctttagggtttagtggtttcgtgtttggggttaattaatccaaagccctaaaccactaaaaatatacagcaataaccttgacgtacattgtttcaacttgtgccaagttcatcatcatatacaacaataaccgtaatccaacacaaagctttaaacaccctagacctcaggttgattctatctgtcatcatgacaggcgtttttccatcctataatccaataattgttcctaaacagacaactattcctactttggttattatttgtctgtgtttttgtttcacctgaccctgaactatagtgtcaaacaaagtttccaccaatacaatatgtttggcaaggcaaaacttgaattggaaaactaattactcaatattagtgaagtgtatgtaacactcattaggttattcactgccataaaccctaaaccggcacccataaaccctaattctatacccacaatccatattagtgaagtgtatgtaacactcattaggttattcactgccataaccctaaaccagaatctgtcatccataggtctataacccaagccatatgcactaatgaaaacattagacttagttcggaagctgtaaaccctaagtcagtaaccgacgacctaaaccctaatcacaacatcagacctaaaccctaaaccgaattccataaacccaacgtatgtaacccaagccctaaaccctcatcacaacatcaaccctaaacctaaaccggaatccatacaccctagctctgtaacccaagacataaatcctaatcagaactaaaacctaaaccctaggtctgttcccagcggcataaatcctaattacaatataaacccctaaccttaactgaaatccatcaaccctaatcaccacatcacacctaaaccataacctggcacacacaaaccctaactctgtaccccaacccataaaccctaatcaccatgtcaaccttaaaccctaaacccgatttacatacaccataatcactacctcagggcctaaactctaatcacaacataagccctaataacaatgtcccacaggcccctttgtccatataaaagctggtgaaaatgaaacaagttgtgattcactaattgagtagataaaatatcagaaaacaaaaatttttttgaggctccgaaacttgaatcgtaattttgaggcacttataggcttcgtttgggaaaaatttttggacgcgtggccgccggtttcgtgtcaatcggacgtcccagtcaaaagttatagccttccgtaatttacgaaaacaccgtgaaaaccctaggcccctgttcatgcctgccacgtgtcaccatctggtgaaatacgtcccattctgggcgtgtttggctgcaccattttgctaaatattggaaaacttgcacccttttactaattaaatatttaaattgtattattttttaattttagcccctaaatttacattagaatatattttgacaagctaaatatatccatagaaacatagttaacaaaaaaaaaaaaccttaaatacaacaataacatgcctgaagggagatttacattaaaatatagagtaacactagtactccatgtgttttactcaaattccatactcctccctttctgcatcctacaaaaaactccttaaatgtttaactcacattatacctagactccctcttttctagacattgtttaataatctaacacaaattagacacatactagtcctaaattctgaaactaattgagagaggataatttggattttacaataaaaatgtaaggacaattttgtttgctcacatattttaattaacgttagttaacgacgttaatagagagggtaaaagtaatgtccaaaaagggagggatatcgggtgaaatttgaacaaaatatgagtgtaatttactctaaaatatattttgacaagctaaatatatccatagatgtgagcattcataaaagattactcattaaacaatcccaaaatcactacattgaaaaagtagtaaaggagaagaaatggcaaaactaaatcaagccatccgccaagagagcaattaacaaagcgcctcactttagatttagcatttatgataatttgagatatcctagcagattcatcctgtgctctagtcagtgtcttcttgcaagttgtctctctattacaaattctatcaactaatgattggaacgattggatctttgcttccagtgacttcttttctgcttcacaacattccaatgctttcttgacaaattcaatgatctttttgttcctatcattttcctcttttagcatgctagattgtttaagaatctgtcttgcctcaagtatctcttccagtctctagagaagccactcaacgttcactttcatacttttcatctcgtttgcaaaagcaatcatgtaatgcagctcatcttctgtgattttatggagaaccttgtcttccagttctgaaatgatgtcacatatcacctccaagaaaattgaccagagtgtcgttgttgatgccatagaattcttaaaaacatctccatgcttattgagaatgtttcttaatatggggatgcattctggcttcttcacttggtatccttcaaccttgtccatccatgatctttgtccaacaaaattaacctcatcgttccccatattaataatttcagtaagattgaggctgaaggatggatctccaaccattgaaatggacttgccattgttcttgtctgaactttccccagagttagatgcttcaatatcctcttccaaatgttcctgctcaaaagggataaatagggcttcaaatgcattgtgttcttccatttgaactgtgtgattagccaccgggttctcatcctcactcacttttttcatttgagctacatcaacagaatctccagccttttcagtctcttcttgtctggtttgtggcataaaggcagaaggaagtgcaacttgtcttggaacggattgtagttctaccacagaacattctgaacctgggcctgcacagatgttcctctagtttcaataagcttctttgctgatctcaaagaggcatggcgggtagaaatgacagtggaatctggaatcaaacgcttcttggtataaggagggcacctagactctgactgaacattgaacacaggcaacaatgtgcaaattagaaataaaccaatgataagggaaagaagaaaaaaaaggtcattgcacatcctttattatgttactgaaatttacaagaatcaaaaatacattgcattttgaataccaaacccttaacaaaacataaaatttttagatggtgagactgaattaaatatctccgtatttttgtgcaacaatgagtattcacatcgcctcaactctcaagatgactgtaatgattttccttaacatcaagatgtgcatctttttgccacagtttccataacttaacgggtagtagcagttggcaaggaatagggatgggtcatatagtcaaaattttcttgaatcaataaaataagggaattataggcaatctagaacctactgaagaggttttgatttgttataaacaagtaaacaaccgaaagagttgcatggaagctagtacactagtaaatgaagaaattttccttttacactttccactttatgttttgggaacttttttctctcttcaactttctcaagagtgcaaaaggagtggtttaacgcatcaacattttgattcatgcgaagtgaggaaaaaagaaatgtgcattaacttgggtacaatgttaaaagtaaataatataaacaaaaaactctcatggccaacaaacataatagaatgagaatggagcttatgacacaggctgataaatcaagagaagttgtagggacattaaaaaccataagtgtcacggagctgcgattatgattctgtttccaagttcatgtttttgccatttatttatacaaaaatgcttccataaaatcattttcattttttatgggataaatcatggtactcacacaaatgctgcaagattcatgcataatcacagcatttggaaacaagagggtggatggataacataccttacctggttcttgggtgaatcagagtgagaagaatccataagctgatcctgcttccctgtgtttttcattgttccttcttcttaggacaagcacttgcaatatgtgctagaggctgttgtgttgtgtatgatatgagtatgagtctagaggctgcagtgcagtgcaatgcactgtgtgctaatgtactattgcctgttagaataaatctttttcatgctattttgaccacgatatatgcaccgcaacagcannnnnnnnnnnnnnnnnnnnnnnnnnnnnnnnnnnnnnnttggaaaaaaaaaaaaaaaaaaaccaccaagtatgcaattgtgtttgattggacttatgtgttaccgatttctattaacttttttttttctttcactcactctatatctaattgtcacattatagtttgactaatttaagttgagttgagagaattcgttaaaagtctatgaattaactctagagtttaacaacaatagttgctagtgggacatactgtaatttagcaattgttgtgccactacatgcaatttttgcattctagaaaataatacatgaaaataaactggtaaaaaaaacacaatacatgaaccaattgtaactgcatagcttgaattggtcttcatgtcatctacacttcctgcccactcactgtcaacatagacatttagcttaacaactcctatctttaaatactagatgccaaaatttgttgtaccttcaacatatttcagcaccctttttgctactcccatgagatgatgagaacattgtttggtgaactcatgaacctggaaagtaaaatagttggaaacatcaaggctactcgttgtcaagtacagtaaactacccatcaagcttctacatgcagagggctcttcaagtttctcaccatcattcatagaatttctctcactttgtgctagtaaagttggtacttctttgcatgattctaacttacacttgagattgttaacaaataacaacatattttatttgtgaaataaatataactgagccacattggaatactttcactccaacgaagtaaataatgatgccaaagatcagacatctcatatatatcttccatttccattttgaacttggccagcaaaggtaaattacttcctatcacaagcatgtcatccacataaagtgacactacaagttacaaaccacaatcatttatatcaaatatagacttgtttgattttcactcctgaatccaagttggattaagtaagagtcaattatgctatactaggcccttggtgctcttcaaatcataggaatctttggtagtctgtaaactgtgttcttggccagcaacgtcagcctccaggttgaaagattccaaatttgatagttttacctttaaacactggaattttatagatgaattactagaagtagacatattttcatccatatgcctgaaaataaatttctcaacctcactagtatttgcactcaacctctttgcccccaaacacaaaggaagccagctctttataccagttaaatatcagatttgaaaaaaaccaaaatactggaactagaaaatattaaaattgaagaaagaataaaatatttcataaatgagaatgcttatttacgggctcacaaccaatttgaaactcgctaaaaaatctaaactgctgtgagattttattgggattgcaatagctaactaaaacagaaaaataaagagcagaaggtgtaacaattgcaaagactaaatctatccaagatttatttaaaattcaaaggcaaactctcgcaactgtaagcctcttgaacatatctgaaggtgggttaggaatctacaacaaaacaaacttttacagatttgtaagaaaatttgtctttctcaataatgctatgtttaattgattaactgaaaaatatcattcacaagaaaaggcaagatcccaaatttcctctaatttccatcacatgaaattacaataatgaagctctatacaatgcttaaatcttcacacatgcttattgtaaatattgccagtttatataagatgcttctagtaactgctgggattgcaataatttcatgttttcaactgatacttcaaccattttcaagctataaaggtgtctaaactattaagtcatttgtatttaccttttatagttaaaattaatattactaggaaggatcatggatacattaagagaaccaaagatgaaacctgcaatcacagagaatctaaaaccatatggcattatggacaagaaaaaatgatgtattaactttctgcatctcataatttacaacaatgcctttggccagatagcattccatgtctcaaatcatctcttataaaaactaaccatacagaacctacattgatcaacaagaaagctttcacctcgtaaagtttgatttcttctattttgggatgaagtagtaaaagaaatagtgaagctgctggagtgatgaattgatataacctactctattgaagatgtatcactataggaaatatatgctgcaggaaagctactcttcgtagaaattagaaagcaacatatgttaaaaatagagattcatgagtaactgcctcccttttcacctcagaaaacgcctcataacaaataaagaagaacgccagctcaaagattaaatgcaaaatttgcaaaaattggccagaatagcaactatctattagaacttaatgcatgcaaatttatctgttcaaaggttctaactggacttccattcttgcagagggctgtaaatctttatctgcagttgttctggttggactcaagagatcaactgaatcatcttcctcaagattaccaagcacccaattgcctcttccagatatctgccgccctattcgctgcctttcatggtattccaaataaataacaatcaatgcaccaattaaaaaccaaattgccatagcccatctgagtccatggacattttccacatcatatctgtctcctagatgcttcatcccagtaaaaagtgctgcaatgccaaaaacaatggcacatctaccaacaattgtgtggaaatattcccaaataaccctcttggaggatgcctgctccccatttgctggttttggaggccttaggaaagcatttactggctgtatacaagccaacaatatagtagcaaatccaaatttaacatgtgttgagctgaaataaaatcccctaagctcagccacagcaaaaagaagggcaagtagaacaattactaaccctgagtattgcaagtaaacatgaatccggtaccatccatcgcccttgagatgttttagatacctggctgccaatatccctccaggaagcaggataccccatgcaacaaacatcataaatccatgcacagccaaaacaggaagtaaatcctgctccgcctctgctgaaccacgcatcaggtgtacaaggatagccctattacttgtactagaatgcatattcctgtcagtaagatgatcattggtccatttagcacccattgcccaaacaactttgagtggagttgtgggatcaacgatatttttacattctaccctcttttcccgcctacaagatgggtccaagggacgagtaaactcaaaagtaatgatgccattttcggttttacatctcacatgtgtcaaattttcctgcgtggcatgtacgcttgaagcatcctttccatcaatccaataagtgttaacatgtcccataccagtatcatcaatccaacccacatacacatagctgttcaccattccacttccaaaccctatggcaatataaccactttttctctcgccacgagctgcaatagatatggaatcctttgacaatgtccaaaagaaagtaacctgttgatcatccaaaatgacactgttattatacatgtccgatagacccccatcaaccacctcgaccttccaacccatcttctggtcgaacaaggaatgatagtagacgtgatcaggagtgttcctgtcaggagcccaaactaattctgtaggactggcttgaactccgtgggcctctggacctccagcataaatagtctcagtcagatttctcgtggtagcatttccaccaagcggatccgaagtaatataaagtgcaacatcgtgcccggcttggatcgaaaacttgaccggcacccctctttccactctcaagacaggagcttcnnnnnnnnnnaatttgtttgagatgaattatgctaatcatgtaaaaatattttttttagttcatttttttcttattttccacttaatttttttttaaaaaagtttattcttaaataaataatgatgtcctgaaatggatctaagaactaaattaaaaaaaagaagaaccaaaataaatttttgaaaagatgaaataaaaactataaataaatcagattgaatttttttaaaaagaaactaggacaaagaacgaaataagtggtcagtattttttttttttttgnnnnnnnnnngaacaaggaatgatagtagacgtgatcaggagtgttcctgtcaggagcccaaactaattctgtaggactggcttgaactccgtgggcctctggacctccagcataaatagtctcagtcagatttctcgtggtagcatttccaccaagcggatccgaagtaatataaagtgcaacatcgtgcccggcttggatcgaaaacttgaccggcacccctctttccactctcaagacaggagcttcctttttgttgatataaagaaccttttcaggatttggagggttggggtaatgcattgccggagcagaagaaaccaccaacggaacatttgcatctgcagtgatgagaccttgatcttctttgtcttcagcatccaagggacctgtacactcattcacatgctccgagacattcaaaaccaaatggccataattcacagccccatgattctgaggaagatagtaaggattaatagaatcaggaggcttgatacgccccaaagcccaaataaccttcatattcgctgaatggttcacaggatgatcatactttccatcgaccttagtcaaatgcctgcggtatctgacaaaggtcaccccatccttcctatggccataaaccaacattgaattgttgactaaacccaccccatcagggccttcataaaaggaatcaggacataccccttgagcaactccatcactatttctcacacactcactatacttagtaatgaaaaaatcatccacaaagggcataccatcttccttaaaccctgcaacgacaacatcagcgccaatcatgagatcagaatcttcagcactggaattagcccacccaaaagccatgtaattggtgatcccagtcgcggcctccaacccaatttcaagagaatcctcggacacgttcaaactccacctcaacctgaaattcttagacaaaaccttgcaattctcgaacaccgtcggaggcggcggcgtcgccgggacgtccttgcggagcacgacgtggccgaaatcggaggcggtggcacgatcccagacggcgaggacgttgatcatgctccaggaaacattgctcaacaaatgcacatccaaggtggagttgttgtaggttccgttcaatccgtcgttggaaacaatgaatccggcggtgaggctatcgaaatcggaagcctgcgcaccccaccagtggacgtcggaaccgggaagcatgtcgaattgggaaaccctaaaggagcaatcgtccctgattttcagggatcctcggagttggtgttgaaccatttcgaactccaactccgaattgacgacggagctgaggcgagtgcaattgggagcgggatccgcatatacgaacaacaacaagaacaacaagtgtaggatgaagatgagggatctgcgaagcatgacgggtgcacttgttgcactgtcacgcaaattctgtggatcagaatccacgatgaccaaaccttcaggatcggatcgtaacaatgttctgtgtgcgtggcggaggggttcagttaaggtagttcacaaggttctgtcagtcttcgggtggagagatgactcaaatctagtcaatggttgttgtattgtatcacactatcagttgatggatcctgacttacacctcaccctggtgagccatctacgtggattcataaatcatgatctatataatctataatttatttatgatttattttacctatttttaacttcatatagttattataaaaaataacaaattaactatacataatttgtgagtagatttacgctgtcatatttcttcatactaataaaaaaaaacacattgtcatgtgtaacattttttttctgaaacattttttaattatattattgattattcatcaattttatttaaaattaaatataatatcattcaaatcaatgatttattgatatttataaaacatatttaatgaaatataagacgaataaatattgattatttgatcaatcatatatattatagatgatcaaattaaaacatatataaagaattttttttataaaaaatatacttttttaaacaatcaatgtaatattaaatcttgattatttatgaagatatttatcataaattaccaatataaaaaatataacgacatgtgattttcttaaggaaatgtattctagatatagcacgcgagttgttcttgatggttactgttttataaattatcaacacattaattggatttacggtaaatatattgaaaactagtaaagcctaaattgtctaaatttaaaatagctaataaaacctaaattttggcttacttgctttatgttatgcagaaagtcgacacattggtgaaaccttaagcaaacaagtttaatgtcatgagagaaaacaccaaaacttatcaacaatcttcattcttccatggctagctttcaaaggtggaatttgattctcttaagtccaagccacttccaaaatggtcttaaaaatatgttctaatggagcatgaacttacttacatccaagaaactcccataagttaactcaataatgaacagttcaccaaagtgaaagcaccaaggtaattggtcttcaccatattgcattttaggagactttttttcaagggaaaaaaaaaatcacatgttgttcctaaatctattgacaatttatctaaggatcatgcaaaatatgcatatcactcattgaacatcctacaccacatcggaccgttttttatgaatagccctactcttggaattgaatactagatcattaatttccacgtgaccacatcaatgtttagcatgtagaactttaacccaatgagctatgtcattatttaatactatatagtccactttgatacatagctcttatttagttgcctaagattacaaaccccttgcaaaccattatacttagattgcacatatgctccaaatcaattaatgacattttttaacaacagtggagcgcctaataaagttttttacagaaggattaaattttggaatatggaaatttacatcacataagtgactaaaaaaagaattaagttaggactgtcctccttagcaaagaaagataataagttttatagtcttgcaaatctttttaactttatcaattaggaaggcattgttctccctggtaacctttcagcaaagaaagaaaatgccaaggtacatacctaaattatagcaaagtgaattgtcattctagatcaaataacttcaagtcatatttggagggtatactctgaaattatgattgtaacattgatcggaacaatcacaaaactattctgacacttgattaacacagtcaacttgaaattcaaccgctggaagaaatggaatctttaatagcatgggacaaatgttatacacagtgcaaaattaattggtaaagtgataatcatattatggacatagagataaattgtgaaaaaaaagtagtgttatatagtttgttattatcatcatttgtatatataaaattcttttaattaatttacacagattaatcaattaaaaagttggtttataagttggtagtgttcaaattgtcaaaattttttattatttttctaaaagcatccttaaaattattgagattcttcgtttcacttttttatttaattatttttatgtagttaattaatgtgtcttaagcctttttcccattcatcaccaaaaagataatgaatttatctcattaatctaatacattcattgtttactagaggaagaaagcacttcgtatttctctaaattttttaataataaaaaatacaaaattcaaaagttaaataaagttaataaaaaaaagagtgtcagagaggaaaaaaactgacaatataaaaatagtgggcaactattcttgtttagaagaacatggaagtttaaggataaatttttctactaaaatatgtacaccaaataaaaatattttctttattattagtattgattaaccacagatgaaaaagtacaaaacaactaaaggtgttttaattaaaaaattaatacaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgatatgaagatgtacacaactgccatgtattatttttttgattatttaatgtaatttattttcatgtctcaaatgttgcattcataaattggataatttttttccaacaaaacaatctaacttaaaccaagtcaaaccaaattgataatttttttagtaaaccaaattgataactacttttaaaacaatgttaatgacacttttttggtaaccctttatatgtgacaattgaaacttattaaaaattactacctcttattttatatataagaaataattatttaattcaataagatcaataaaataattagatagattaatttatcataaattttaattttattctaagattatctatgatattaaattgtttaagagatgattattttttaagatgaattatcttattttattttgttcaatttgatcttttaatttatttaagatgaattatgctaatcatgtaaaaataatttttttagttcatttttctcttatttcccacttaattttttaaaaaaagtttattcttaaataaataatgatgtcctgaaatggatctaagaactaaattggaaaaaaaagaagaaccaaaatgaatttttgaaaagatgaaataaaaactataaataaataaataaatcagattgaatttttttaaaaagaaattaggacaaagaacgaaataagtggtcagtatttttttgttgcctataagttgaaacaagaatacaaaattacaaatacaaattaggaatccaagtaaaaccctgaataaggacaattgtttcagatctattctatgaactgatagtgatacaacaccatttttactcatgaaaacgaggaaaacgttgctcatttctctaccggaatattaacatctaacacaaacaaacgtgtctgtgacctaccttaaatgaacccctccgccacgcacacagaacattgttacgatccgatcctgaaggtttggtcatcgtggattctgatccacagaatttgcgtgacagtgcaacaattgcacccgtcatgcttcgcagatccctcatcttcatcctacacttgttgttgttgttgtcgttcggatatggggatcccgctcccaattgtactcgcctcagctccgtcgtcaattcggagtcggagttcgaaatggttcaacaccaactccgaggatccctgaaaatcagggacgattgctcctttagggtttcccaattcgacatgcttcccggttccgacgtccactggtggggtgcgcaggcttccgatttcgataacctcaccgccggattcattgtttccaacgacggattgaacggaaccttcaacaactcgaccttcgatgtgcatttgttgagcaatgtttcctggagcatgatcaacgtcctcgccgtctgggatcgtgccaccgcctccgatttcggccacgtcgtgctccgcaaggacgtcccggcgacgccgccgcctccgacggtgttcgagaattgcaaggttttgtcgaagaatttcaggttgaggtggagtttgaacgtgtccgaggattctcttgaaattgggttggaggccgcgactgggatcaccaattacatggcttttgggtgggctaattccagtgctgaagattctgatctcatgattggcgctgatgttgtcgttgcagggtttaaggaagatggtatgccctttgtggatgattttttcattactaagtatagtgagtgtgtgagaaatagtgatggagttgctcaaggggtatgtcctgattccttttatgaaggccctgatggggtgggtttagtcaacaattcaatgttggtttatggccataggaaggatggggtgacctttgtcagataccgcaggcatttgactaaggtcgatggaaagtatgatcatcctgtgaaccattcagcgaatatgacggttatttgggctttggggcgtatcaagcctcctgattctattaatccttactatcttcctcagaatcatggggctgtgaattatggccatttggttttgaatgtctcggagcatgtgaatgagtgtacaggtcccttggatgctgaagacaaagaagatcaaggtctcatcactgcagatgcaaatgttccgttggtggtttcttctgctccggcaatgcattaccccaaccctccaaatcctgaaaaggttctttatatcaacaaaaaggaagctcctgtcttgagagtggaaagaggggtgccggtcaagttttcgatccaagccgggcacgatgttgcactttatattacttcggatccgcttggtggaaatgctaccacgagaaatctgactgagactatttatgctggaggtccagaggcccacggagttcaagccagtcctacagaattagtttgggctcctgacaggaacactcctgatcacgtctactatcattccttgttcgaccagaagatgggttggaaggtcgaggtggttgatgggggtctatcggacatgtataataacagtgtcattttggatgatcaacaggttactttcttttggacattgtcaaaggattccatatctattgcagctcgtggcgagagaaaaagtggttatattgccatagggtttggaagtggaatggtgaacagctatgtgtatgtgggttggattgatgatactggtatgggacatgttaacacttattggattgatggaaaggatgcttcaagcatacatgcaacgcaggaaaatttgacacatgttagatgtaaaacagaaaatggcatcattacctttgagtttactcgtcccttggacccatcttgtaggcgggaaaagagggtagaatgtaaaaatatcgttgatcccacaactccactcaaagctgtttgggcaatgggtgctaaatggaccaatgatcatcttactgacaggaatatgcattctagtacaagtaatagggctatccttgtacacctgatgcgtggttcagcagaggcggagcaggatttacttcctgttttggctgtgcatggatttatgatgtttgttgcatggggtatcctgcttcctggagggttattggcagccaggtatctaaaacatctcaagggcgatggatggtaccggatacatgtttacttgcaatactcagggttagtaattgttctacttgcccttctttttgctgtggctgagcttaggggattttatttcagctcaacacatgttaaatttggatttgctactatattgttggcttgtatacagccagtaaatgctttcctaaggcctccaaaaccagcaaatggggagcaggcatcctccaagagggttatttgggaatatttccacacaattgttggtagatgtgccattgtttttggcattgcagcactttttactgggatgaagcatctaggagacagatatgatgtggaaaatgtccatggactcagatgggctatggcaatttggtttttaattggtgcattgattgttatttatttggaataccatgaaaggcagcgaatagggcggcagatatctggaagaggcaattgggtgcttggtaatcttgaggaagatgattcagttgatcttttgaggccaaccagaacaactgcagataaagagttagagccctctgcaagaatggaagtccagttagaacctttaaacagataaattttgcatgcattaagttctaatagacagttaacccatttttggcaaacttcacggttattttgcaagctggcaggcttctttattggttatgaggtgatgttggaggtgaaaagggaggcacttatcaatctctttttttgacttatgttgctttctagtttctctgtagattagttttgctgcagcatataatgcgtatagttatacatcttcaacagaataggttatatagttactgctactctagctgttactctttgttttttttttacttcttcccaaaatagaagaaaatcaaactttacaaggtgaaagcttttctgttgatcaatttaggttctgaatggtttagtttgatagtatcttagatgatttgagacatggtatttaatctgaccaatggcattgttgtaaattatgagatgcagaaaattaatacaacatcatttttattgtcaataatgctctattgttttagattctatgttattgcatgtttcatctttagttctattagtatgtgtttggttagggagttttgagagtgaaattcaatttttaaagggatttaaaatgccaagtattaaaatatattgtttgtatcaaattcaaagattttttttttttaataatggggactttataagggtttatttttaaagtaaaatgagagaatttcaaataacaccaaaactctgagaatttgtaaatttctctgatcatcaacaccctcactcttgtttgcaactattcaacctcgcatgttcttttcttggctataaattcttaccatcacatgctcctgagtcctgatcactctctcttgcccgagcttctctggctttctcttttttcttctcccttggatctcctgtgattgagctcttctcttctctttggaccacgtaaaatttctttctcactattctccaatctttttcttttcttattttctgaaaatatttgaatctattttgttggtgttcatgtattattctaatttctggactctagatctgattatgattttgatgttattatttgtgtgtgtgatattatttgctgtattgcaacatgattagagtaatattaaaatgcatattatcaccttctgtattctggatcttattcgctctgtgtttattgaaatgaaaaagcatattatcatagccaaattttaaatgggttgattccaatctaggtggtacatgccttgccctgtgtaaaactgcattacaatcaataagttcgtcatgtctgtactgtatcattatggtaaacccaatttaactttctacaagtttgtggcagctaccaaacaagatggaagtgtggatgaatgggcagcacggcttatgtgtgtttgtctgtgtccgtgtgtgtgtttgagcagtgagtttaaaattagaaattttctacaaaccagattaatcttattttttattggaatgttcagaaatcataattaatggtagatgcttttcttttcaacattttgtgtgcaaataaagcttttagagcgagaaggaccagttagaacttgcaagccatagcagtaaagcttagtcaatagtcaagactaggcaaaggtgaatattttatttcatcttgttttgttgtctatttgcaccttaggatttgtcaactgctacttttatgaatgacatacttttttcttctattttcctggtccactttattttaaaggaacatgatactgagttcactgctctataatattaaccactgtgctctaaagaaccttgttaactcttccccctaaaaaaaattggtaactcttctccaactcagttcttgatggctatattggcaagagtttactctacatcatatttgtaccattatttccagctcaacagcatgcttagtagtagatttgtgcaaattatgaataaataagaggttcctttcagtacaattctcaaataaagaattgtcaaaatttgtgtatacccatcctagagatcataacagtaaggttcaacatcactttaaaccatttaacaatgaaacatgaaaactctaacaaaatttaaattttaatagtatctatccagatttcaaatttggaaattactaaatcagagtaatattttcaaagacattttcaagtgcaaaattgaaatatgtaatatatgacattagtcctttaatcagatttttctacgtcagatttttctacgcgagacaatggacaagtttataatatgctaatacttaaaaataggtactggattaaattttgaaatttgtaaaataaaatctaagnnnnnnnnnncatgaccaacaggtcaccaagacacaactttaccgctgtgccagggctcgccctcacaattctcaaataaagaattgtcaaaatttgtgtataacagtaaggttcaacatcactttaaaccatttaacaatgaaacatgaaaactctaacaaatttaaattttaatagtatctatccagatgtcaaatttggaaattactaaatcagagtaatattttcaaagacattttcaagggcaaaattaaaataggtacatatacgacattagtcctttaatcagatttttctacgcgagacacaggacaagtttataatatgctaatacttacaaataggtactgggttaaattttgaaatttgtaaaataaaatctaaggctttagcctacttccatcaagaattttcaagcatacttatgagtaccaataactataaattcaaacttttggaagcaatgctgaatcactgtcatgaatcatgattccatataaaaacgatcgttacaagcccaagtatattttatttgcaaggatttcataaaattatgttgaggagtaattttttttcctaacataactatgtttttctcattttgtaaggtgtgtatttttcactttcatatcaaatggaattaatttaggataaatatttattttagttttaaaaagatgaaaaaaattaaaatttaaatattgaatgtgtaaaaagtaggataaattcatccttcatctaagtcttttttattaactcaaagttcatgtctacatcctacctccggatccaattatcattgaaaaatggttatatgtgttgtttattaggtaaaactaatttgtgagcaaatagtcaatgaattaatttatcagtttcaaaaattgttatttttttaatttaatttctgaagttaataatttattaccattttaatccttaaaattaattatttaatgatatgttggtatctgaacttaaatgtgtattgtcaatttggtctttaaatatacatttgaatttttaattagttatatatttaaagtggtatttactttccttaatttataatgaattttttttactactgtcaatgaaaaataattttcacaaattaatttattgataatttatacaggatgcaagtgaaattagtggattagtggagagaaaggaagggtctttctgaaattatcaagaagtaataccgaaactcgaaagcgcgacacgacatccaaaacttgcaaatttctgtcaaaataagaaacgaatgttggttagtatgaacgtgaattttgaagggtaaaatcccaaatacaaggaaaaagcttctatagtttcactctcgctgtatggctactctctcgctctctctcaattgttggagtatcgtggaacttgttccacatattattttggttactaacaaagtaaaaaatgtatctaaagataactaaatcttcaagccttatcaatttcactaacttattccttttgctctaaaaataagatttttagtgagataataatctagtgaataaaataaacctagaatctttgtaaatagtattgttattggtcgacgtaagaatccaaaaaatcaatcataatatctgtaatgaatttaaaataagattttatatgtatatatactctaataaaaatcagatttaaacactcacaatttataacatcctgaataaataaaatatttaaataaacaataacacttcaatatattcaaataaatataataaacacaaattagtaatttccataatcataagattcaattttttggattctagaactagtgcggatttgatattcttcaaaggatctataaactcatatttcatgcaatgatgttttagtgtcttttccatcataaataaaggtattcaaaatctttttcttatcctagatgaagatatctataaataagtatcattcacaaatgaaagcatctaatattatattctcataatagaaaatacgtcattattcattctcataaggtgattataaattcacaaaattataaaaatatcattctagaaaactaacaaataaactctaattttgtgcatccaataatagtagaccccatactaatgtcatgcatgtaggatttttttattgtttttgctcagcgtcatgcatgtaggattgaatatattttaagatcttttctatttttttctttaatagtatagttattttgaaatcttaaataactttttagtgagtctaacatgaatctcattttttaatatttaaatatttattaaattaaatataatgaattaagtaattaaatttaattaataaaatatggaaggaaaaaatatatgaacactaagaaatgaaataatttaaataatttttatttatgagtaaatgttaaaagaaataaaaaatacataaatttgataatagaaaaagtgtaagagattgttcaaaagaaaaatcaaattttattatttgtggttagtttttttatctccttttagttttttttttctctttatgctgatgccccatttaaaggagagagattttttttttaacactaagtatcttgagggttcttttataagaacttatttttcatgttggagatctatccacctccttttttaggagatctagtgaagaccatatcttgagttcaagatccttctgaagatcttatactaaagatgttctcatatccctatttgctattgaaaacgtggctagattttgctgggtctagcgaggcagccactcagcaggtaactgaatcaaggccatggctctggaaatgtcctttaagattttgtaagcttggtttgccatttaaaacttgaatactatatagtagatcataataagttccgtaaaaaggtagtgcatctgagtagaaatcgttcctacttgagataacttttcttgcaagtctgtgcttttttgtgtttgcgtctgtactctgtatcagtacatggatgctttgctgaactctggaaatattttgctttctgaatcaggtccttagctcacttcagcctttggattatattgttgttgcatttttgcctggtattagtgaggttaaaagaggctactctgcttggcttattttgtctttcttatttatttttcatcatttgactgatatcacatattgtcatcttaaattccaggaactacttttccgaggagcgattcttccacttttgggaatgaactggaatagtattaggattgctgccttgatttttggtgttttacacctagcaatggtcgaaagtattcctttgccatctggtgcatatctttcctatttcccctctctccctctcatttctctctttttccccatttatcgaaaattgttttgctgaatttaattcctacactaaatcacaacttttttccattattgtgttgttagttctgattaaattacaataagattttcgtttgtgttttagggcaacctttgttggtcttgcttatggatatgctacaattttatcctctagtgttgcggttcccatggcttctcatgcagtgaacaacctgattggagggcttttatagcggtacacgtcaaatacaccaaaccagaaattaaatgagtgattgccatcttcatggataagtcaccgcatctctatacatctaaccctccctgccccggatttgatgttgtataaaattgtgatacagaaatcagagttagagaccaatccaagaagtatgtttgcaaatgcagctactaatggcagcactgctctctcctccattgtttaaggaaaaattcaagtttgtatattacaacattatatatagatttctgttgtagttctcttagaaaacattccatgtaatttatttaccataaatcgataactgtactttataaagtggacggggtcacttggcttgcttaccaatttggttttgttagtctcccatttttggaatatggcttcattggcttgggacttaaccttttgaaggaatattcccctaaaaattaaacggaaaataaacagaaaaccaaatcacccgcgttttggacgagtgtggcaagcaggaaggtaagatctcaacaagcttgggttgcgctcctctttctattccttacccctttataaaatgctgcactttcaatactttctctttttccttttttttctttctcatctctttgttgtctgttccttttcccccgaattttgggtaactaccacatatctcacaaagcttcaatcttcatggcttcggtaagaattaagatcctcccaccatgtcatgtaatcatgtgtgttcatttctagccaatgattttaaacaacaacaaaaaaagtcattgattttatcaaaaacaaaatggaaatgaggtttagctatgtaccgaggtttccagcaattctttgttgttaatgatgagcaaaagggtctttttatttttcatcttctatgaataattaatctctgttttgacgtaagcatttatgtttgcatgtggagtatgaacaagatggaaagccactacccaagttcgggaaatgggatgtgaatgatcctgcctcagctgaaggattcactgttatattcaataagctaggccagtgacgagaaaaaaaactggaggaggaggatcagggggcattagatcacagcgaagaaataattcgcgcaaagatgatgataaaccctgctagttacttatcaataatacagagttatgctatttagtacgagaaacaaaagtatagatttctctccattagatgtacatgtgtttcattggtcatttgaaggttaaaaacagaaaatataaacttgtactatttcacagaaatcatgtgaatgtgtttctacgattgtttctttttgcaatgaagttcaatatttaataatattatacatatgattttgggtgcagaaaaagtggttttgctttagaccctagacaaggacaagggtataaggatgtgtttcttgctgcttgggacgtatatcatgattctcttcagtttttcttctgaggtctcatctgtctccagaccacggataagagataaaaagaaaagaaagaaaatagttgcagagccttctcaaaccatcgttgtagcttccagttattaacatgttttcccttctacttgttgtacgcaccggcacaaagtaatatgtaaataggagaatcaataactaactaccttttgcaaaggcattagttaaacagatatgtttttcttgctgttacttcgtgatgttgatgagctcagctaggcaattacttatttttagtttaaaaaaaaaacaaaaaattaagtatcatatattataaaaccatcattgcaatttatgaataataaatttaaacattgaaaatcatttccattaaaaaatctccacacgtctatcaataatttcaaaacttaaaatatttaataactaaaacatgattaaaatatacattaattaaggtgttaaaattaaaattaaaattatatatatatatatatataaatatgtatgtataacaatgttatgtgagagaataaaattgattaatctcaaatatcagtcgttaaattaaaataaaaaattaagattaaaatattttaaattcaaattaaaaatccatttatcttaaaattcttataagatttatcaaataaaaaattaaatattttaaagatttaatttaattaagatcctcaccacaactattatgattaaatgaagttttgatttgaatttaaaatattttaatcttgacattttattttaatctatgattgagattaatcattctcatccgttagattaaaataaaaattcaagattaaaacaatttaaattaaaatctcgtttaatcatacaatctttataagatttattatcatcgtcgttaccaccaacatgatgtcactgccattatcactgtcgctgcttgtgacattaaggctaacaactagtggtggtagtgatgatggcggttgacaattatgatgatagatttaagatattttagaatatcataaatcttacaaaaattttataattagatgagactttaacttaaatttaaaatattttaattttaacattttattataatttaaagaataaaaatgatcattctcatttttacataaaagaattattatcatatgatatatgtcctttatatatatataaacttaaaaaattcaccaatcacatgtataaataaatataattaaataaatataatttaccaatcacatgtataaataaatatatggataaaaaatgtaaaaaattcaactactacttatatatgattatagaaggaagtgtataaaaaaaattaaaataatatttaaaaacttttctagacgcaacctcactgaaacacatgcatcccaaatacttaattaaattatttatttatatattccatattatttaattacgacggggacagcttttattattaaaaagagacgatgtttaattgccaagcatggcaaatctaacttgaaccacttttttatacatcattatcagttatgatttcgctacacatgtagcaaataaatggtggtggtggctgaatgtattttggttttttctatttttacttaatttctaacgttctcaatgaaatccttaattaatatatccttatatatactcactaaattaaagatcatttaaaaattaaataaatttatgaatattaaaagcaactaaaaaattggaataactaaaacttgtcgatcatatatatgtagaaagattacaaatatatttaaacaaaaaattaaccaccaaatgattattctacttaggcaatgttaatcccatgccagcataacagttaactaatcctagaatgatgaaagagtaattaatgaccctagtccaatccagaggtgtaagacaaaacaaaatacaaattaaggtaaagcataaaattcaagcaataaagtttgattcatatgaagaatagcgttagctgtcaagcaaacatgcgaaacagaaaaacaaatcagaaacaaaaagaatatgaggttggacttaaatggcgaccattcctggttgttggaattcacgtgactcctcattgctcagttcaagcaaaacggattaggccattcaataattcaatttagaagaagttaattgaatcattaattcacaactgctagttgcttctactttgccaacttcatttgatcgatatagtaacgaacaagattagtagattatataacccctataatccctcccgctacatttgacgagttttgagtaaatctatctggaactgtaatggttaattaaattgatgcttaaaattaagaaaatagtaaaatattctttaaaaatgctgcaaatgtgtaggaagtctactaagagaagccttcaactatacgccaacacgggcaacaccttcaagggaattgcacatgcatgtctaaaaatttatgaaaacaatcttagccgaagaatgaagcaaattcttgttaattaagaatgcagcaagttgtacgtactccaacttaatagaacatgagaactgttttccttctaaatcaagtagtctttttcctccttacataatgtgataggatgaagaaggtcttaaagagactcaaacatttcctcttctcatacaaaaactgtagaattatctaaaataatttgaaatatatgaagaaacatatttaggcttgtctcctagctaaccatttatcagtccaatgtgatttcttatttgtcttgttaaatcatcaaaaaaccacaaggaaattaaaagtgtaatacactaaatttgaactccatcaatgactactatctcaatatcttacatgatatcatgttatgtaatatacaaactcgcattatatatatttattctaagctaaaggttttcatttattgttattgtactcttactaatcacaaaaaaaaaatatacaatttagacttttgtaaataatatactcaacataaatattgattcctttaacaacaataatcttaataaattaaatatgtattatattatttaattgtctataaaacacacaaaagcaagagtatcgtgttagttaatctaaaaaaatattgattttctgtatctactaattcttcattatttgttcataaaaaattatctaaaatataaaaaacaatcaatctcaacaaacttttttatactaattaataacattattttattaaaatgtataccaacttaagtgttaattaaaatgtgtttccaacatccgaatgcatcactcaattagcttataactaataattttgatctcagtaattcgatttcgatctaaactagaggtatgaacaaattggttcggtaaaaaaaaaattgaaccattttaacaattcagttctcaaattcaaatgtctaaatttttttagagaattggttcaaaacaaattgattttgtcttgaactaattatagaattgaatcagttatcaaacttattttcaaactactttataaaaacacaatttagaagaaaaacaattcactttactaaatttgtttagaaaaaataattcggttcaaatcgaacttattttaaaaattaattcaatttgttttaatgtaacttgcttgacaccaaatcagtttgattcaagctaggtgtaaaatcagtttatctcaaactttttgtttttcttcacaccctagatctaagtgtgtgtttgaattgatcttgataaaattgattttatatataaaattaatattaattaaaattaattttaaaatgatttagtttatgtttaaatgttttataataaaatcaaattaaaaataaaatattcagtataaaattttatatccaacacatattcctcaaagttagttcaactaggaatcaattataaattattttttaaagtaaaaccaaatatatatatatatatatttaaaatcaattataaactccaaattaaaacattcactaaaagatagagctacctcgatcatgaatttattgcaccagcacatcgacctttttcacttccgaagtggattccattccataactcttgacaggtaaaggtgatggtagcatagcagcaatttggtatgctcgggaaatgtttatgtggtttgttaggtgtaggaatgcttatttgtttcacattcattaattgcatccccaacctccgtgcatatgactgttatgtattcacctgtcacaatatttaacgcaacccatttctgccaaactaggaaaacccgcaaaaaactataggcaagaaaaagagacgacaatgccacgtatagttattacatgcagcagtgttgttgatgagtactacctcacagtactcataatctcatgcctcggtttgatcgtcaccctcaactgcctcatctccttcttcgcttggatcttcccaacctgtttccgatccgagaagaatctcgtccgaagctacggttcctgggctctggtcaccggagccaccgacggcatcggaaaagccttcgcagaccagctagcgcagagaggactcaaccttatcctcgtgagtagaagcttccagaagcttgggacagttgccggtgaaataaaagaaaaatacccagacacgcgcgtgaagattgttgagatggacttcgccggcggcgacatgtcggagggtctccggcgcgtggaggaggcgagcgagggtttggatgttggcgttttgatcaacaacgtggggatcacgtacccgagggcgatgttctttcatgaggtggaggagaaggtttggaggaacattgttagagtgaacatcgaaggaaccacgagagtaacgaaaattgttttacgtgggatgttacagaggagaaagggtgcgattgttaacattggatcgggtgcttctgtggtcgtgccttctcatcctctctttacaatctatgctgctacaaaggcgtaagctttcttaattttctttctatctaaaacccttccattttctttctttcttttatctttctaactgaaaaaaatgcttttacaaagtaagtaattaactgaaaacatgattattagcattgttcataagaatgacgtttttttcaggacaaaggtttatcagtttcctaaaaatattggctaaagaacctagttagtaagaatctttttttattatgaaaataagaacgatgaagaagcattaacttgcttcgtgttggctaattaaagtgagctgaatcaatatcccaccactaaaggacaaagctctcaaagtaaacaaggtgtaataatggtaacatcaacaaaaatgatatgtttttacatcgatcctttgtacatatatccatcttgaaaaggatttagatggagaaaaaaagaaaaaatgaataaaattatataaatactatcataagttatgtgatagtgaaatgagagataaaaaatataaaaaaataaatacaaaaagttataacctaatttttctttatcttgttatgatatttttacacttcaaattttatattaatttaaaattttcttctcttcttatttttcttctaaattcttaagtatattcatgcttcaacgagtacttacaaaaatttcagacatattctttagtactttcgtggttattatcactgatatgcgggtgactgtcgaaagttaatgagactgaactctcctttaagagagacagcaattctcacatcgtcactcaactatattttaatgagggcaatgttattcttaaatatattttttttcaaaaaaattcttttaatttaaaaagttacaaaataaaatgattgatgtaataaaaattaaaaaataattataaaaatattgtaagcataatattatattgttttggtatgatagtaatctgacattctgtattattttatatataaaaaattctaagagcttttcttttgtgaataaaaagttctaagagcttttatatatagagagagatgtgaataaacacagctaatattttttttaagaaaatgaaaatgacactattaaaaataatataatttgtaatgttatgtagatctaattaaaactcaacaaacttatttatcatacacatgataatttttttatcaaatgatagtgaagagaaatctttacagtattatttattctaaattaaaaatgttaatttttataataattgttttataagtcaaaatttaaatttaagataatttttaatcgagtaacaatataaatatacagaatatcagaatcaaaccaatattataaacataaaatcataagtcaaataaaataatatgcatatatagtgtctttattaattaacaccccaggcgagtactgaaaactaaagtgaattggacgatggaaaaatgcagttacgtggatcagttatcaagatctctgtacgtggagtatggacaatacgggatacatgtgcaatgtcaggtacttacaaatgtctactttaatttgttagactgtttttgttttttctttgttcttataacgaactgacattttataattaaggctacagactaaaggtaatgtgcaacacatattatcaagccttggatcagctagagaaaactattgtaaacttatctagatgtctaaagcagctacattataaactcgcaggaacagtgttttaacattcatagtatttttatttcatgtttaaagtcttagaaaagaatatcaactattggaaatgagtgatcaagtacagtttgcatgtgcttagtagttaattaataatatgcatgacttctgtattctgatcaatgtatgattaactctcagttttttgggtaaactttagtattcatgattaatatttaatactgatcatgaatgaaggtaccattatacgttgcaaccaatatatataatatcaagggatgagtccagtattgtgatgtaattcgtatgatgaattcatcattttctttttttgggtaaactactccatattatgattaaatatttaattctgatcacgaatgaaggtacccctgtacgttgcaacgaatatggtatcaagggtggcatgtattgagagagattctttgttcgtgccaacagctgaggcttatgcaagagctgcaattggtgaaattgggtacaaaccaaggtgcacaccttattgggctcactcaattcagtggtgttttgcaaacttaatcccagagacactacttgatacttggcgcttgtccatcggtatccgccgcaggaatcaaaagggagactgaatattaactaaggactatcatttctcactttaattttatttgtatgaattgttattataatatgttttaattttattttcaataattatatatagatatgtgatgtcatatactaatcaactgtttaatttttttttcttttactgtaaaacatggcttcgcttgtccctatggatcatgcacttaaatataaattcatgataaataaatatttttaacatacaaattatattttataatattataatacaagattatttttaattattatcagttaaaaaattattgaaattcagtttagaaataaagataaaaatgataatggaaagagataagtagttaaaaaaattaagtggttcaaataaaaataaaaggtaagtggtttgagatagttgagtagacatggcaacgggccggggcgggtgcgggtattgtattccccgtccccgcccccgcctttaaaacccgcctctgcctctgtctctattttccgttgggttttaaaattcagactcatctctgtccccgttgggtcgggttttccccgtcccgcctccgtcccacccctactattaattaaaaaaataatgtggcttttcttttgaaaaaaacggaaaaaagttgactaggtaacaaaaaaattaataacaaatccacattcaaaatatgagatcataatttaaaaattattaaagaaaatcagtcaatttaattaaaaccattatggacctacatatttaatttctcccaaaatataatatcatttaaatatatattgttccaaaattaaaataaaacacaacaaagagtagaggtccattgtagcaacaaagcttccaaaatggaattaattcagaaagttgttggtcaaggttcaacgccgtcgagaatgagaaatgaggggcagggttaggatttcgggattttattcttatatataaggctaaatttgtaatttaattatggcgggggcgggggcgaggcagatatcatcaataccaaacccgcctccgtccccgaatttttgtcgcgggacaggagctagcgggtatcaacaataacaaattcgagtttttcccgttaggtctcgttgccatgcctatagttgagaaataaattcttggagtaattattaaatcaaattaaattaagaaatatattttaaaggaataaagaattaaaaaaacattcaatatataagattaagataagacatgagactcaatcaaaataaatgttcacagataactcgtagaagcacttctatttaagaataacttctaacaatgttttacgacggccttctccttatatgatatataagtgatctataaaaatccattattttaaaaaaatactattatataacatagcttaaaatacacatgctggagaattcagcaaaaaaaaaaaaattacatgctggagttcttgtacaatgctatcaatataacgtattaattctatgctatcatatatccatcgtcccctaagcaaaatacacggtgcaataagcgattttgatcatcacccaccgtaacgatcaccacctctcaaatctcaatcattgagcaacactttaccgagaaaaaaagttcaaaataccccaaaagaaagaaagaaagagagaagaagaaaaacatcttaggagtcgtacgtaggaggagctagtaaccgggtcggattctgaggtcgttggtggtgttgacaccacgaatacgggtgggaagaaagaccagcaggggaattgaggatcaaaataaccggatattcattcaactgtttatcaagtaactgcatccatgatcaactaattcatcattgctttaatacatccccttgaaaacgggatttgtacggcaaatgcttgctccatactcctcatattctgcctttgtatgacaagcctgtacattggaacaaaaattgtaaaacttctctcgttttccattgagacttatcggaaggatttaagaaacattaagaaattatgcatactttcactaggagaacattatagcaagacaacacatcgcaacccacaacgatggcaaaccaaaagaaaaagaaaaaaactctgatgtcatatttttacattgttcaagtttcatatttcaacttaacaaacaataccagatattttgttaacatgtatgcaatcgtagattcgtttaacctggcaaagcatacaaaattcaggttatcaatgtcaaacaaagaggcatagacaaccaactacaaacgtgacattgacatgtaatccatccaccattgctttctcatggacaagaaataatctaaagatttattgtcaacaaataaaggtgcatctaaaagaggcatcgacaaccaattacaaatgtgacattgacatgcaatccatccatcactgctttctcaattctcatgcacaagaaataatctaagatttattgtcaacaaataaaagtacatctcaaacctataaatccaaacataaaaaaaactacgtacctcattgcctaaagatatgcgaagataagagggaaggataccattcaacaaattgtctcagaccaatgtgctcaagatcaaaagagagtttttttttttttttcagggtatggtacttataacttataagtcatagcaaggaagaatgttaatcattgaacaggtacccccaacccccaccccctttccaattacatggaagaacacactattagtacacaaaattagtgattataggatgcacgcattgaacctcataaccccccaaaaaatgctggaaatgcataccgtaaaaaattcaggtgttgatgcaagtactgatcctccaaaccaaactgcaaatctctggattggatggctgagtacatttacctccactggctgtgactgtaggctccaaattaatgaagtaaaaaaagttaatgcaagaccaaagcaataaatatatatagcagtacagcctgccataactatatcaaggggacaattttgttcatgcatgtgttggaccaaaagttaagctgatgttaataggaaacttgaattgtgaagaaacactttgaagtctaaagaattcacgttaagtcaaagcaagaccgagtatatgaaatgtgagttttcattggtaaaagataatgatcaagacttcatgcatctatttggtcaagaggtacccaagaaaaatgtttttagatacttgggatcaaatttgtaaaaaggtggagagaatgatgagaatgtaaatcatagaattagagcagggtggatgaaatgacgaagtgcatctgggttgttgtatgaccacaaaattctccttaagctaaaagaaaaattctatagaacaactataagacctgtaatgttatatagagctgaatgttggtcaatacatagacaacatgagcataaaataggagtagcagaaatgaggatgttaaggtggatatgtgattatacaaagatggataagataagaaatgaagatatttgacaaaaggtagcagtagtaccaatgagtgaaaagatgagagaacatagattgaggtgatttaggcacgtaataagacggcccttgaatgctctaatgagaattaaagtttgttaccaagagtttgacacaaagagaggtagaggtagaccgaaacttacctagggaaaggtagttaaactagacttaatagagtgggatatagattggcggacgatgtgtcttagaacataatagagaaaagttataaacttggtggagagttagacccgttattatctctatgttccagatggttctattttagttatttttctcttcatctcccccttcttctttccctcttctttgcttttaccctttttttttcaacctcctcgtatctatcattgggttcatctatcactgatcccaattaacttgggttaaagatgttgttgatgttgatgtattgagccataaattacataaccaaaccaatcaacaaccagcataacactgttttcaacgtaaaataattatgtgacaaaataatttatgtaattatttaatacaacataatgatgtattgatttttgattggtttaatccatacaacttgtgcaaacagatttacataagaatttctcatccatgtgtgtaagcgagggagagaatgataagtttaaagatggtttaaaggtgcctattaacttacttttatctccccatttaagcgtgcttcagacgaaaggacacgagcatccactatttttttaagatcacgttgcaacctcctgtgaaaatccttgaacatggttgtacctccagacaacacgatattctgaaataaaaaatacaaaataggcaagagataaagagatcaatcattaagaacaagtaaactaaagggcttgaaattcatatgataaaaaataaaatatcgtggctggactgatggactaatataacacttgacactaatgtactccatctgggccaacaagaaaaaacgcctcaagcttaacattgaaccttggaagatccctaattttatgattggaagtgatggttcactcaaatttaaaagcactcctggggattattaatatatacatgtcagtaaagtacttcaccttgtataatgatctccttgtgtcaattggcgcagactgaatgcatttgtctattacaactggcaaaggggtagtaaagtcactgctatatatctcaggattaaagaaagtctgcagaaatcattgggaaaacatacagatatgttaaattggctggtcctattgatataatgaccccaactgaacctatagattagctcaggaattacaccaaggcactactacagtttcatgaattattcaatagttaaaaaactcaagtggattccataatagagaaaatctaaacagtggccatagaacaaacctcagggccaagaaatcgttcataaccaatatcacatgaatatggtgcccccgtctttggtttaatacctctccaatgcttgatgtacttgcctggttctttgtcatgcttattaaattcctgagagaaattgagctaatgttatgtaggaaaactaaaaagtttaaaagatcacttgagttacatcccttgattcacaaaaagagaaaattaaagtatttattgacattagacatgcaaatggcagaggcaacaaaactattggcagaggcgcaccacaaactcctcaaataattctgtcaaagaactgagtattgaaataaagacaaccttcacaatgtcagagcaagtgtagcaatacatttccttcactttccgtgccacttcaaaagagtcttctggtggtacattttctcctctttcctgcacgaagcaatgtcaacacaacagtttgtcaatctagcttagcaaaatgcagtttgacaattggatgtggattattacaatctcagacagttcaacaaaaaaatatatagctaaatacacgaataagtttcataatcaatcatgaaataagtaaacttcacttttttatttattaactattaaaaatgtaacaaaaataccatcataagtgcatcacaccctattcatccagattagcatttacacattggtttcactagctagtgtaaatggtaatttatgatatctttcaacattaaaaagaggtttacaaaaattcacagatattcaaatatgggaacaatacaggcacaataaccttttaattttataccagaaggattacccacccgcataagctgttgaacaaaaagagtaacatcctttccagcaatgggaatcgatttgatgctactcccaataacatagccatctgcaataggtacaacatgagtagccccatctccaacatccactacaactcctgtcatttcacactaagaagaattccagatcatcctaaaaggaaaatattcttaaaataagacagatataacaagaaacaaaatatctccatagctcttatggtattgttattgtaataccccaatagaagcacaccagaatgagaaggattcaaaggttgggtaggtatgagactatacaattgaggatgacttgaaggaattaattggtactatcttaccaacaagatgcatctacttttcggtagtccatcatataggaacttcacaattaagtatgcttgacttggagcaattatgaaatagatgaccttctggaaaatttctcggaaaacgtgtgagaacaaaacacattgaaaagcctcatgttagtttgaggtgttacagttatcaaagtcaagtataattatgcagagtcagcttaacattttatatttaacataatgagaggagctgaagaattgtcctatgcactagtaataatgcaaaaccacctcaacagttcattcatattctacagtacggcttacttttggtttcaagtgaaagtatccaaaagtatcgaattgcaggggctgatgaaacatccagtgcattttgtgtttagatagctaccaaacttgttgctgctgagaccatactaaatatgcacagcattcaagattaatcatccaaatccaattctatattcaacataattgccaatctttttcgggtctaacgattaccaaccttggatgttgtgtatccagctgcaagagcaagcacagaattcacaccaatgtaaagtccaggcacattaaaagtctcaaacatgatctccccagtatactcgcgactctcaggcggagtcaatggactctcgttcaagaggaaatagtgatcctccggatcgcacctcaaataattgaaaatgcactgctgccagaagcgctccatggcatcccaattctcaacctggccatgccgaattgggtagctgagattgtaagtgctactagatcgagacttggtaagtgcttcatccccaatgaagaaatcaagatccgccataactccagcattgtgctgggccacccaattgcctttagaagagcccctcgattgattcagaaacgactcattaactgcaacaactgtcggagcaataaaacaaggctcaacgttaccagcaaaccccatcttcgtatacctgcaaagaaaacatcattttccaaattcagagtaaacccaattcaggtcaatcaacattaaagataattctagttataaaactaacaccagtggggcattcaacaaacacatggtgtccacaccacataagaaaaaaaataccacataaagctaaaagagaaagtgggtgatagaaatggatgaaaagggtacccggagccattatcgatgactacagctggacgagaagtggatgggtccatgagaaaaagcgaattagtagtggtagtgatggtgaacgctgaaggtggatctgcgactgagatccgagagcgagcgtgaggcagaggttcatggcagtaaagagcgctgtgagaagcgcaagaaggaggaggaggaagaggaagaagaaagtggtgtaggtgagagtaaagatgatggtgacgcagactttgatccaaagtgaaagaagatagtaaaagacaaatgggaatggttggtgattgttgttgctaaagccatttgaacacagcgagtggaagtggaagtgcaggtcccatttagtcgatcatcattctgttcgtttctcagagatgctttccttggcaaccaaacaacgactcttctcttctcttctctctctttcttttatttatatttaattaattataactatagtactaatgacggcaactacaattgtcgttgttggcgtgttggtatggtacgaagaaatgggggatgctttatcagactaagccgtttgatttcaagcaccggttgcagagacgcacacaacacagatatttaacttgtttcatttctttcttacacgccaacctttttctttcttgctgcctgccctagaccctagtacgatgaattcatgaacctctgttgaaaaaaactgtcggtagtttttaatttaaataagtataaattatatatatatattaaaagaaaatatttaaattataagagaagtaatagttcattcaaataaataatatatgcaaatttagatatagaattgtgttaaataattaaaaggataattttatagtttataatgattatattttgatttgaataaaattgttttttattagatatatataataaataaatgaggaaactctataaataagaccttaaacattattatatgcattctagagagaagatttatagatttttgtgagatcttttattattattgggattcatttaattatttcatagttattaaatgtgtataatatttggcacgacattataatgaagacgttggtttcccaagttatttgttcgtttccagtttaaatttcaagcctcaagtcatcggttcgaaactagcaacatccaaaatattttaatacaaattatatttaagaatattttgcgtgtaaatatagccaaaattttgctctataactttaggtggtcttcaagtggtaaacacctcttttctcaaacttgccatagtaagttttacaattattttggatatattggttataaatgaatatgttttgacgtagtcttttgaacatcaacaacacctttaatctaagttaattagagttggtggtagatgaattcaaagatagatcgaaaatgaaacaaaaagagaaaaagagaggagaagaaaaaaatagaaataagaaaagaactaacacaaggaaataattgaatatataattaataatggatttaatcatctaccaaacttacaatttttctctatttcgtcctaaaatataccgtctctgtcaatctatatcttactccattaggtcttgtttaactaccttttctcatataagtttagttttacctttatttatctgtatgtcgagctcttgataacaaatttttgtttttactgaagcattcattgagcatctcataacgtgtctaaattatctcaatttttatatagtttgttaattgtattttttattttaaatttttaattagagaattattttgaatttatgtgggaagagatgagggtttttcttaaattaggaattaatattattttaagattttgagtttattagtcactaaattttttttcggatttctgtttttaatccctaatttaaacttcgcatcaactaattgtaattgcatcctctaaagtgttgatttaatcccatgttaatcagtgatatggttttaaatagagcctataaaacttgcatagtcctaatttgaagggtcatttttttaagttgaattaggtctttaaacccaatctgcatttgttacactctagacaagtagtctttgagaaaaagtgttagaatgtcaccttaattgcactcatttctaatccaccttagttgtgacctcttcattaactaccttaattaaaacagtggtttagttccacacagctagaaatatagtttaaagagattgaacttataaaacttggtcgatcttcgtcataaaagttgattttatgaggctgaattaacttctaaattgaaattctaagaattttattcatacttcataatttattatgttcgttctgtatataaattatgatttttgaaaccgaacaaaacaaaactgagtaaaaatggaaaacaagtgaggattagagttaaaaaaaaaaaaacatttctctttctctttcccgttgcaaagcccagcaggtgcaaggcaacaattaatcaacctttcaaaactgcatggagcttatttgtagattcaacaacagaaagaaagtacaaacttgaactcaatcaatcagatctaaaaatcgcaaaagggaaggtacccacaacagttgcaacaaaaaagaaaccactggcttgcttgggaatggaaaataataaaaagaaagcggatatagcattagatacaagttgcatgaaaactattagtatgatgataattgatatcccacagcatttaagccccttcccaattttaaacttcacaaagatcaaatcactgtgatctcatcctgttgagctggttgagagcaggctgcaagatgttgtaaagcacccaagcaatagccggcgtaaccacaaacagaagaagctgtcccctgttgtcgctcgcagcagcagcagcttcagaagccgccgccgatgcatgcggcgcagccaccaacccagccaagccgccaagccccaagccaatgatcacgcctttggtgctgcgcatgcggttcagctggttcagcgccggctgcagaatgttgaacagaacccaccctattgctgggattatgggcagcaacagtgccagtcctcggttgtcgccttctgctatgtcggctatttgttgaacagcgaaagcggcgtcgcaggttccgagggttgtgaataatgcccctgccattgctgtcgcagtggaaagtttagtgctttcgggtgaggctatgaggccctttggaaggttgatctgaagggagggttttgatggtgcgagcttcgtcggattggggaactttaggttgacgcatttggcgttgatcatggccatcgctgatattgttgatgccattggtgagaacagagaagaaggtagtgagtgatggcagtggcagagatggggaacgtggctctgattgtgggaatagcaatttagcgtttggaaaaagccacgttggagaaacgaggtccaatgggattgtggtttctagattcttctcttatgcgaattgggggatatatcagatttcgacctcatatttcttgcgtttcttatcatcacttgcgctgctcaaatgccaatattttcttgtttttgttcgtgacctgtttgtcccaaacacgcgttttacagtgatgcaacgacacgtcgtttataggaaaaatgaaaatgtttgttgtacttttaagatgaaagcatctacaatgagaatgtttttttttttttcgtgttccttagagtatacatatattaagaggaaaggttatactgtaaattcataaattatcaatgcacatcaaactcagggtatccttcacagatttaatatgtgttatcaattaaattgaattcattgagttgacaaatctttatttaattatcaatattaactaggttgcagcgataaaaaaaaaaaaaaaacaagtacagataaaaacaaaaagataaagagtttaaggctatgtttgggagagggagttaggaggggaggggagggaaaggaagggtttagctggagtaatctccttgtttgtgagttataatttttaagggaaaggatttggggatttttaaaattcctccaaaaccctccaatgcttagaaattataatcccccctatttggggggtttttagaaggaaaattaattaaaattactattctacacatcaatgttttgtgatgaataattattagtgagtttgatgctaattaaaatttatttatcatacactttaaaattactattaaaattaattatataaaagtatctcattactctcaatttctctcccttcataaatttttaactcccaaacaaggaggaaggaacttccctcattttccttcctttccttcccctcccttctccttgaatctctttccttcccctcctctcctaactcccaaacatagcctaagagagaagtaaaaaaaaaaattataatactggccaaccaacacgtgacatataagttttaatatatattgagataacttttacttatactaaaaaggatctcttctctcgcctgtaaatttgttctcttccctcctcttttaattttcctgtgtttacaattaaaaagggttttaaatagactttttttgtagcctatattatgcgatgagacgaataagaggagagtgttaaattttattcagcaaacaatttgggatgactaaatgtaacaaaaggaaattgcaactgatgtacttggaatgaggtggtgcccaagtacacgattttaagtacctttcatatgaatcagagtattgttgagaaaatgaaaaattcaatggctaaatatttagtttagttccaaaaaatgggaggttcacattttagtttcttaaaaaaaattatcaaataaccctaccattgagtttagtgtgttaatgttaatgtttttatttatgtgacatattttgttcacatgtaaatgataagtgacagataatagttggtaggtgtcaattgtcatattttaaaaaattgactttttaatttagtctctaaatttaaatatttattatcatttttgtctttaaacttaattagttattgatattttttagtttctgaacttaattactaactctcatttaagtccttaaattttttttcaaattttgatttaactttcatatgaaattatttgcatatatatcaccatatcttctcactttcattctttatccttatggttttcaccttcctcttatgagattcagcaaattatattataactatgaaacttatttatgagcaattacataggaatagttaacagttaaattcaagataccattaacaagattctagaagatttaaaactcaatcttctacccaaaccaagcttctaaaacttatatgccattaaatgtgcagaatgttagaataatcatttttttcgaagcaaaaagaataagttaaataattaatctattttatgaaataacactaatcatgaaaaaaataatttaaaaacttaagaatcatagaagaaagaaaaatgaatgtgttataagtatttcctattttttttcattctttgtgatttttacatcattgttcaagggtctctgatattaggggtgtgtgaacccatgaccctctagtggcatgcaaagcagtgatgatttccattgttttatgacatttgaaaagttgtggaggaaacttttttagcatgagggaggtgtaagttgaaggaaggggtgacacaagatccatgtgattgttagcgaggataatttctaatctttggtagacctcttagtagtagtcgaatctagaaaaaattatgatcatctatcaaagaagaaaaaaggagtaactctgcatcaatggaatctcatcatctatatataatgaattggtgtggtatatgcaaatcacaacatatgaattgtaaaaactagtattttaatcaagactagaactcaaggatgataaccgttaatgttattatcatttaaaataagaattagtttcgatttttatgtgtaaaaatagtagaaaaataaaaaaaaaatattacttattaaaagttaaatatttaaaaattacaaatgaaggaaaaataaaaggattaagcaaagcagaaaatgcaaacaacgaaagttgttagtttgattaactactactgcaagttatatatagacacaaaataatttgaatgtaatagttatttgagagtgttaaagaagatatttgaaaaaaaataattgaataaaatgtaattttttaaagaagctagtcaatgtttttttaaatgtttcaattgaataaatatcaagcttgtcatgcagttgatggaggtgaaagtcaatatgaagtgcgaaaaaaaagttgaaaaatatgagtgataataaatgaaagtagggatatgatgatgattaagttaataacttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataaaataaaaaatttattaaagtttctgtaaaaatttcattgtaaaaaaatatggcagatcaacagagtactttatttcctacaaaggattcttttatgaattacatatatctttgatttcataagaaacaattacattgaagtcaaatagaatcgtatattttcaaaagaatactattaaaaaaagtagaatcattatgaataataattttttaggatttaacttagaaattattaattaaattagaataactttacaaatttatccacacactttcgtatgaatgaaggaaaattctgttatttaatacatggagggaagtaaaattaaattttgtagttattaatccnnnnnnnnnnnnnatagaatattaatttttaaatgaatactgcattattttttattttattagtttttctatttctatttaataatatttaaatatgataattataaaatagtaatatcttaaaaaatgtataatttcgataaaattaatttttcaaattcatattttaacacacctacttatgtcttatataaatttacaatttaatatatatatatatatatatatatatatatataacacgaaaggttgaattgtataatagtaaatgtaatgacccgtatgtatccggctcattaacatttatttatggtcttaagcgcaacaattaattattattaatcaatttggaagcgataaacaaagtgacgtcatcacaataacatttttatattatgtatcaaaataatggcggtaaaaaataaggtatcatataccctatcctctttacatacatcgatctctcagatatacaaaaaacacactaactatgcatcctcccctcaggggtacaaaatacaagcataaccaacagaaaagagtcatcatgttctcaaaatatatgcctaaggtttccacagaaccataccagagctcgctgagcatcacctgtaaaacataatccccacacacggggtgagatgcaaatctcagtaaaatcaggatttttggaggtttttccttcccctagttcacttccatgacacatagtattaaaattgacatatcacacaacaagccatcacgactctcatgaagcatattacatgtatatcacaacacaggtgtaacaatatatatacaaatatataacattgcctaagaaagattattcactgaacgacacattctctcaggaacttttcgcatcattatctgagaaagatcatctacttaagggcacattctctcaggactctgcacacattgcctgaggaagatcatccactgaaggacacattccctcaggacttcataccaatgcctgagaaagatcatccactgaaggacacattctctcatgacttacttggacatgtatgacacttccaagggaagatcatccacttaaggacacatttctaaaggaagtccataagtaatctattctactggtcagagaatctcatcaatcacataacataccatcacagtgtacatcatatacatgttctcaataaaagcagtaacacacaatttcaatacacatgcatcatgacatacaataaccatcactccctcggagtatggtggaacacagtcaataggaaacactcccaagaagaaagaacttacctgctctcagcgctatatcggctctcttggcttcatgatcacaaccaccagtagtatccgtatcacgccctacatgaaggcatacaaacaatcaataacggttctcaaccattagaatgaaaagaaacattattcttttccatttaaacctcttagtcctctaccttaaggttatcagaactaaccacctaaaagtcaactcacataccctaagcaggatctatctcggcctaaccaagtcactagagtctcccaaagactctgcatcaaccaattcagagaattcaacactatacaggccaaaacccaaggattaacaatatggctaaaacggttacttcaacacaactttaccgtttatatagccccttgagcacatattgtacaaacatcagggctcatgcatgtcatacaatcaccaatttaactaacattcttcctacacatacatttctcagagcaaaattctaaagtccataaaatcaatattttaaagttaaatcttcattacaacaacctcctaagcatacttttataaagaactcaagcttaattgcaactctaactccaatgagatactattcacctcaagaacaaattcttaaataattggtagaatttgtgtttcctacctctaaatcgacaaggaaggctagtggacaatttctccactagagaaaatgatatctctgtttgatggtttttaggaaaaagtgatgaaggattctagctcataggatgatttcctacaagtttcatgttgggtgtgaagtgttttggtcaatggttgagtggtctggagcttctcaagctctttaatggaggaaaacgtagtggggaggaagaagataggtttttggtccccaaaaacgcgtgaaatgaccttatatagtggtctagatcgtgccctagcgctgatcgtgctactctggcgctattcacaccaagttccagagaaaaacatgctttctggagtacttctgacggtaaccgtgccaacttccaatatatctgactctaatcacgtcactctggtactaatggtgccagattttttttttttaaactttagttattataataaattaaaaaaaacaagaattaaatatgtttgtataagataagataaaattctgtgtattctatttcctgttatatgataaaatatgtataagataagatgataatagaatcataagataagataaaatatgtattcaatttttcaaattacaatgatcaacttaaaattacaaacttccattaaatcaattttcaaattcatatttcaacaaactacttatgtcttatataaatttcaaatttaatatatatatatatataacgaaaagttaaattgtataacagtaaataaaaaaataagaattaaatatatttgtataagataagataaaattttatgtattttatttactgttataagataaaatatgtataagataagataataatagaattataagataagttaagataaaatatatattcaaattttcaaattacaatgatcaatttaaaattacaaacttcgattaaatcaatttctcaaattcatattttaatacacctatttatgtctcatataaatttaaaatttaatatatatatatatatatatataaccaaaagttgaattgtataacagtaaatagaaaataagaattaaatatgtgtataagataagataaaatatatgtattctatttactgttatatgataaaatatgtaagataagataataattaaattataagataaattaagatataatatgtattcaaattttcaaattacaatgatcaatttaaaatttagaggaaaaaatatatttaatttgagcaattaaaaatatatttaaaataaaaattcaaataataatgtacaatgtggtaggattttcataataataattcgaaccaagtcataataactcccttatttgcaggtggtttggagagggtggttgatgtgttgccaacctaattaaaatttttgcaaccatcttatactcttcctccatgtgtttattgatttaaaaaaaaatcataacagcaaatttgagtttttcagttttcaaattgttttattgttggtttgatcgatttcgatttatttggatctgtttgatagtttaaaagaatttagtttaattgtaagtaatgctatttatcaaagacatacttattaaacttaaaattaaaactaacatttcgaattattttgaatacctgaatacatatcttatctaatatataattataaataatctcttgtcaaatatgaaagagaagagatatcatcctatttgaaaaaaaattattcattcaaccacacactcccaaaagctatataaaactctcaccgctacgtcatttcattatatgcacactttcattaaaataataacttggcaaactctctccaggtaaatactcagtttgaggaatggtggtttgatccctctcatatgtaatcacggcttccacgtgcctgcctatgttttgaggagatcgcaacgaatgccattcaaccaaaactcttttatcatgtcttattttccccttatcctgattcttttttcttttttcaatttttttgctttaccattttttatagttgcgtatccatccaacgtgatctgggaaagtcgaaaaaaggatttttggtttctgtatgaaagagggtattttgtaatttgattcattttgattgggatgatcaacctttggtggtggcgatttcttcaactttgatcaggaaattctttcctttttttttgtgtgtgtgattgtagaatatcccatcatctgggaataatgtacttttaagttttcttctttggattccttcaccttatttccatcctcaattttcttcatatggttcacccttaatcaataaaatgtctgctttagattttttttagtttggtatttatgaaaagtaaaatctttttgcgatgatcctcagtttcatcactaaatatttgcctttgtctttgatttataatgccattgtaaatggatacagaaaatcatgtaattaacctgtgtttaaaaaaaaacaaaaaactatgtcacatattcttgaggtactaacttgtagagtttcagatgctttagttggagaaacagaaattaatttattaatgcagtaatccgtttgcacatattttcataattaccagaagtgctagatcctctcttctgctctgtgtgggcactgtataagattcgcagtgccaatggatgccactaccggtgaaaccccaactatccaatatcataacatccctgatcagccagctactaccattgttgccacccaattgccaacatttcaacggcagcaacgccattgcttcggggattctagtccaggagagtttcccttgtctgcgaacccctccattgtccttcatgtccttacaacatgtaacttgtatcctcaagaccttgctaaacttgaggcaagtgctgtgcttgtatccatttcagctcttaagttgttaattgaaacttgtactaattctaatactgctggtttcatttctgatgtggtgttttgcaggcaacatgctcctttttcaagcagccggcaaactttgttcctgatttcaacttgtccttgtcagagcttgctgcattggacatgtgccagaagaaagccatttttaatccaatgacaacagaacaacggcaacatttgaagcaaagatgtggcggttcttggaaattggttctgaggtttttgcttgctggagaagcatgtggtagaagggagaaatcacaagtaatagcaggccccggtcatagcattgctgtgacatcaaaaggggttgcttattcatttgggtccaatagttcaggacaacttgggcatggcactactgaagatgtatggcaacctcggccaatcaggttggaactttagttaatacattatcatactaatttaagtggaaagtgaactagttgaatttaagttaacataactcaattacgctgcagagctttgcaaggaatccgaattatacaagccactgctgcgactgggaggacaatgttgattagtgattctgggcaggtttatgcctttggaaaacaatcttttggtgaagctgagtatggaaatcaagtatctaaaatagttacaactccacagttagttgaatctatgaaaaatatatttgttgtgcaagctgcaattggaaactatttcacagccgtattgtcaagagaaggaagggtatatacattttcttggggtggtgatggcaaactctgtcaccaaactgatccagatgatttggaaccccatcctttattaggagctctggaacacataccagtagtgcaaatagctgctggattctgttacctgctttgtttggcttgtcaaccaagtggaatgtgagctacaacttaatcttcttatctcaactttttcaattctttttccacaataattgaattgggagttatatcatatgatgcaaattaggcacttttacatacttcatttttttgtatgcatattaatgtttgtagagtgaaaagagaacttttttgtattatgatttattccttgattggcatcatatatatcttccattctgttttcttcaattacctacatgtatttgcatcataagtccacggcttcaagatttatgaaagtttttaagcattgctgattttttattcttaaataaactagtatttacattcgatttcatttttgttgtaataactatctatacgtttattgattacgtgatccttctctgaaatcttaataggtcagtgtactcagttgggtgtggtatgggtgggaagctcggacatggcacaaaaacggatgagaagtatcctcgtttgattgaacaattccagttgttaaaccttcagcccatggtgattgctgctggttcttggcatgcagctgtggtggggcaggatggccgtgtttgcacatggggttggggccgttatggctgcttgggtcatggaaataaagaatgtgaatcagtacctaaggtggtggaagagctgaaaaatgtcaaagcagttcatgttgctacaggagattacactacttttgtagtgtctgatagcggtgatgtgtattcatttggctgtggagaaactggcagacttggccatgaccctgaaaatcctgagcaggtctacttgcttatgcctctccttgtttgatttgtgaattgcttgtttggtttggttcaaaggacacgtccttccgctgattttttaacaattatgatatgatgaactggttattgattactactttacaataattggaactttcagaggagttccaaactgaaccagtttcagaatgaagcttctagttgaagcatagtgaaccatagatgacatttcttgtaaatgccttagagacagggcacaagtagcacaaacctaattttatattggtgactctagtgcattcattctattaaggttaatctttccatgtcaattattagttagatacttttggagacaaaattgttcattcagaaaatcctaataaaaatgaagttaatcaacaatatcatgtatgtacttgtgcaggaagccatgcatacaatgtgtgtgttaactccaaagctagtcacttcgatgaaacagaactatgaacgggtggtacaggttagtacgaccaattccatatggaatgctcatacacttgccctaactgaatcagggaagctatatgcctttggggctggggacaaaggacaactaggtgtagagattgatgctgcctaccacactggaagaggaaagccaaagcgggttgatattgatctttgttaactatgtgccggtgtatgccaattatttacaccatgtcatcctttaatttatgcttaccatgcatagcatttagtgttttaatcctttgttgattatgtaaatagaaccaaagaatgcatcgataaggtccaagcttggcaacatataacaagagcttcactatttgtgcggttgttgatatcaacgtagacttcaaatagatcatcatagttgaaaatggtgaaggttcatatgcagtttagttgtcttgacttttgaatttggttatcctaggatcatttgcttagataaatttggtgaattttacagaattgtcattcactcgatatcaccacggctcgatttagtaaacttttattaaagtcgaagaggagcacttttcctttatttaaaaacaatggagatgtttaaaattgtgcatattaaaagaagaaaaaattacgagtcacattatgaagttgtgaaaaaataggtaattgagcatgattaagaaaagagattagaattgcgaagaatttatttgattttatactaggaactagaaaggtttatgatagaagtcgcttatattttatgggggctgatggaaatgtattaaagcaaagaaagatttgcatataatttttattgatttgaaatatattattaagtgtctaaggaagtattgtgaaagattttaagaaaggtgttattgtgaggtatatatatctaagctacacaagacatgtatatatgatagggttattattaatgtgagaacttttagaggcaagactaaggacttttctagaaggataaaattacattagacctcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgttaatagtagtgaactaaacttaatgatgtgaataatttgatgcattttttttaattttagaaactaaaatatcaaaaatctcattcttttaggaattaaaattaatttatattcaatgaatcatacttattatgctagattttaaaaccatggactgcacaagttcatataaataattattttatatttttattcatcattataaaaataaatgtacataaataaaatttaattcgtaatactatattaaatataatcatatcaaaattaagaaaaccgattgattatatttttaattgaacatatgttgcatactcaaaaataaatttatggtcttgtaaaatgattaattatatttgtaagatagagaatatttattttaattaattatatttaatnnnnnnnnnnaaattagttctaatattttaaggactaatttgtgtagacatatacattgaaaataagtatattatttaaaataattattggaacatttttatttaaatcaccaaatataaagaaaatatgaacatcaaatttattacaatttttttccaaatgtgttcatataattatgctaataaagaaaactaaatttttttaacttatttaaaattaatttaaaaaatattgatgaatcgtcgttatttgaaagaatttcaaataataccgaataaagttatcattgtgcaggatttatttgtagatattaagcaaaaaaaagtttttttaatattaatatcagagtttggagacgatactaagttttttgagtgtgtgattggaaaaaggtaattttaaattaaaaattaattaataannnnnnnnnnaacatattatatctataaatattttttgattcaaatcattcatttctataatattattttcatcttaaaaagaatttaatcagaatgaacaaataatataactattttttcagagttatttaattataaattattttatatagtaaggatgtttgactttttatattttattcatttacaaggtaaaaagtcttttcattttcatgttgaaagtgtattgaaattaaattctttttaaaatcttatctctttaattaattaatcctcgtcgtctaacaacaaaataaaaatattgattatttttatttgtagaattgacttaaaattcaaaagatatttatacaccccagaaaaaaaaacatgctaatttatgaacggccagcaaggatcgatgtcccctataatattctttgccattgttgcaacttgcaatgtcacttgaaagggaataaagatttatttggcacaccataaatatagaacaaccttaacaaacaaacaaatccaacaacgttgttgtgttgtttccctcttccatgcagagatcgatcatcacattcccatatatagtatatatattccttaccttaaatagcaaaaaaccgtaaccaacggcttccctcacacattaatagcaaacgtaccctataatatatgaaccctctccttacgacctttccgcaaccacaatatattccttgcattgcagagtttctctaatatttccccttccttagagaaaatctgcaaaacaaatcaacaaattaattaattatttttcttaaaatatggcacgtgcacgccgttttgtggttcttgccgtggtgatgttcgccatcattggcttggcctgtgctaagaatccagcaccagcaccagaggcctctgccgatgactatgaggacgatgattactccatcggagccctatccagtgaagcggcttctgctcccaacagcgtcgtggctgcacccattggtgggcccgtgcctcccggtgctttcgacaatgctaagggtggttctccttccagcgccgctgcctcttcctccctcggtcacctctccgccgtcgccggagctgcctctgctgctcttgccggcttcttctacttctgagttctcatcatcgccgctccgaaggttgcatgcaatcatgcaaagatagtgcatgcaaatatataagtgtatttaagtatattgtaattcaatatacagaagagttaatattaaaatgttatttcaccgaggtggcaagcacgcaagatgtgagattatttcaacttataaattgaaacttttcaatttaaatattaactattcaattacattaaatatttgaaaagaattttttcagtcatacacgggcttatctagcttgaaaaggatcaactaaaagtctaaaatatatgtgatgtaaaaaaatatattaaaatgttatcgaaagatttataattatttcttttgataaagaagacccgggaaataacctagattagttatgccaacctatcactgtatacttgatttgttatatatcacttatcagttattaattattgaagttcacctgtaatgaatgtttaaactttattataaagcttcataggcaagataaacaaaattgtctaaaattgagatagtttagggtttagagttattttatgaattataataacacgtgattattttatgactttcaataagatttagggtttagagttatttctcaattattaaaatgttatccaaaggtttagttaatttttcaaatgcatctcagattattaacaaaaagggcatctctattttttctcaaaataaaagaatatgtataaatataatgttataaaatgaaaattttattgcgttgtaaagagacattgaggctccctgacagatttctagaaaatattatcatgaagtatttgatttaactgattttgataaataatttagtggtcttttgaggaaaacaaattcaaaatgattattttttttataatattctcatcgatgagaaagaactatacgaacaacttcaaacttctttttattttagatatcattgtacacacatgaattaaatattccaaggagaagaacacaccttacatatcaagacatttgaggtcaatttctattaaaatcatagattcgtatgaaaaagttagatgaatttttaaaaaaatgcatgataattttgattaatttgttttaatcatctattattattataaatacctattaattaagatatttattcgatactgacaaggaattattattgctgtaaaaaaaagaattattatttgaattgaaatgggaatcatttttaccggcaacaaaaagggtaaaagaatagcaaattcaaatggctaggccttcagccactttcaccaacgggtcaatgtgctaccagaaagaaaaatagctattattatattataaatgttgggagaatgatttcaaattccaatgtggcaaaagaattatttctggctttgataataagtaaacaaaatacaattatacattatgtaaccaaaaatgcaaaaatatatgaatcacgatttagcgtaaacgtaaatctaacctgcactgctgcttattacaattcaatcaaaatgaatttaacttactgcctagaaaagtacttcatggtattatcagtcccatcaatgaacgacaaaaaatgcagaacttcatcaaactctaagctgaacctcaaaagtagcaattcagctcaaccagctttgtcaaagatcaaattctatcaaaccattaagtaccgtctggatctgctggcaactgtattaaccttgtgaaactgacggccaagtgatggaataaaaacaaacgcatattttcacttaatacacatattttacactcacttctgccaccctgaatataggtgggaagaaagcccaggaagtgaattgaggataacgataaccagctgtttcattcaacagtcttaccaaataactgcatcgataatcaactaatatgttgttgatttaatacattcccttgaaaacaggatttgtccggcaaatgcttgctccatactcctcatattctgcctttgtatgacaagcctgcacgttggaccagaaattgtaaaacttgcatcgagatttattggaaggattaaaagaagcattcagaaattatcgacactcccaaggagaatgacattatcacaagaaaacacattgcagtccacagggatgaaaaaataaaaaaactcggtcatattttgcactggtcaagttctatatttctaaacttggcaaacaataccatttattcaatcataccgtaaaaaattcaggtgttgacgcaagcactgatcctccaaaccaaactgcaaatctctggattggattgctgagtacatttacctccactggctgcgactgtaggttccaaacataaaaaagtaaataccaggccaaagcaataaatatatagcagtctgaccttccaaaatacaattaacaaccaacacatcgctaatttcaatggaaaataattacatgacaaggatttatgtaattatttaatacaacataatgatgtattggttgttgattggtttagtccatacaactagtgcaagcaaggtttatataaattataaagaatttagtatctgtctgtgtgtgagaggaagagaatcatctatgtaaatatgatctaaaggtatctattaactcttacttttatctccccattcaaacgtgcttcagataaaaggacacgagcatccactattttttttagatcacgttgcaacctcctgtgaaaatccttgaacatggttgaacctccagacaacactacattctgaagtaaaaaagacaaaataggaaagaggtgaagaattcaatcattaagaacatgtaaactaaaggacttgaaatttatatgatcagaaattaaatatcatggctgggattgtggacttataaatataacatttgacactattgtattccatctggccaacaacaaaaaatgccccaagcttaacattgagcctaagaaaatcactaattttatattaaaaattggttaactaaaatttaaaagcactcttggagcttatttatatacacatcaataagtaaaggtacttcaccttgtataatgacctccttgtgtcaattggcgcagactgaatgcacttgtctattacaactggcaaaggggtggtaaagtcactgccatatatctcgggattaaagaaaatctgcagaaatcatagggaaagcatacagatatattaatatgactgatcctgttaatataatgacccaaactgaacccatggattagctccacaattagaccaaggcactactgtattttcattaattcttcagtagtttagggaacaagctcaagtggaaccaatagctatacatagataagcgctatgaagactcttagagatggagactacttgatcagttcatcccagattcaaaccccaaccagtctacaatgcttgtacttaagcctcccttgccccttcccacgctagttcttcggcctcttttatttttttaccacttttctgtataacccccctctgttaagctggatattaatgataggaaatcaggatctaatcgagtatatatttaattaattcattagttcatgagataggttcaggtactcacaaaggaaaaatcatactaaaaataggtataaaacaagtagccatagaacaatctggaggccccctaagagagattcagctatccataatagagaaaatataaagagcagccatagaacaaacctcagggccaagaaatcgttcatagccaatatcacaggaatacggtgcccccgtctttggtttaatgcctctccagtgcttgatatacttggctggctctttgtcatgcttattaaattcctgagagaaaatgagtcattgttatgtaggaaaactaacaagttcaaaagataactttatttacatcccttgattcaaaaaaaagaaaagcaaattaaagtagtgagaatttattgacactcgacatgctaatggcagaggcaacaaaactattggcagagaaattcgacaaactcctcaaatgattctgtcaaagaattaaagtattgaactaaagaccaccttcacaatgtcagagcaggtgtagcaatacatttccttcactttccgtgccacttcaaaagagtcttctggtggtacattctctcctctttcctgcacaaagcgatgtcaacacaagacagttcatgaatctgactttagcaaaatgcagattgacaattggatatggattattacaatctcagtcagttcaacaaaaatttatagccgaagacacaaataagtttcatactcaatcatgaaattaaataagtaaatttcacttctatttattaactacaaaaaatgtaacaataatactatcatttttttttttgatcggcacaataatactatcataagtgcatcacacactgttcatccatgattagcatttatacatgattgatttcactagctatgtaaatggtagtttgtgagatccttcaacattaacaagaagaggtttacagaaattttacagatattcaaatatgagaacaataacagcacaataaacttttaaatttataccacaaggatttcctacccgcataagctgctgcacaaaaagagtaatatcctttccagaaataggaatcgacttgatgctactaccaataacatagccgtctgcaacgggtacaacatgagcagccccatctccaacatccactacaactcctgtcatctcgcactacgaagaatttcagatcagccataaatgaaaatattcttaaaataaaaatagatataataagaaacaaatatcttgatagctcctatggtactgttatcaagttcaagtaaaattatgcataaccaacttcatattctagattttatattcaacataatcgggggagctgataaattatcatatgcgcatgtaataatgcaaaacaaccacaactgttcatattctacagtattgttcactcttggtttcaagtgaaatcatccaaatgtgtcaaattgcaggggctgatgaaacatcctgtgcattttgtgtttagataactaccaaatgtgttgctgctgagatcgtattaaatatgtaaagcactcaagataatcatccaaatccaattctatattcaacataattcccaaaatcaaatttcgagtgtagctgtgtaccaattaccaaccttagatgttgtgtaaccagctgcaagagcaagcacagaattcacaccaatgtaaagtccaggtacgttaaaagtctcaaacatgatttccccagtatactcgcgactctcaggcgaagtcaatggactctccgtcaagagaaaatagtgatcctctggatcacacctcaaatagttgaatatgcactgctgccagaagcgctccatggcatcccaattctcaacctggccatgctgaattgggtagctgagattataagtgctgctagatcgagatttggagagtgcctcatccccaatgaagaaatcaagatctgccattacgccagcattgtgctgggcaacccaattgcctttagaggagtttctcgattgattaagaaaagactcgttaattgcaaccactgtcggaacattaaaacatggctcaacattaccagcaaaccccattttagtatacctgcaaaaaaaaaaaaaaaaaatcatttccaaattcaggaattcgggtcaatgaatattacagacaattctagtcctaaaactaagaaaactgcattggagcatttcaacaaacacatggtgtccacatattgacagaaaaaatagcataatgcatagaagggagattgggtgatagaaatggaggaaaatggtacccagagccattatcgatgactacagctggacgagaagtagagggatccatgagaaagattgaaaaggtggtgaacgttgaaggtggatctgcgactgagatccgagagtgagcgtgaagcagaggatcatggtcgtgaaaagcggaacaaggaagaaggtgtaagtgatggtgacagaggctttgctcccaagtgaaagaaggaaatagacaaattgaaatggttggtgattgctacatccatctcaactgaaaggtgcaggtcccattaactcgatcatcattctgttcgtttccaaaacatgctttaaacaactactttccttctctctctcctagactctcttgttttcttttcagctagatgatattttggtataatcacaatttagttctttcaaaaaaaaaaaaatcaattattaaatgtgtataaattatgataattacataatgtgtaatgataaattaatatttaatatttaattagttttaaaatatatattttattattaaattaatacttacatattataataatataataaaataatctcataaatttaataatagaatataattatcttattatttacggattcataatttttattttttaaaaaactaaattatgactgatttatcatttatatattcagcaataaaaatgatgaatcagtatttcttttctgttttttttatttttatcattttaaattttaattcattaatttttgggttgcctctgaaatccaacaataatatggatgcattgcacggcatgacggcaaattcatttttcgttgggaccaacaaatggggttacttgatcgatttgaaggacttgttgcgggggcccacctaaaacaaatattctaagtgctttgtaactttttttttgtttcctggtactttgacacgaacctccatcaagaaaaaaaaaaaaccgtcggtagtttttaatttaaataaactttcaaaaatataaattaaaagaaaatatcttaatcttaaaatttttattcctgttatcgaaaataaaagttttattcctgtcctatattataaatttaaatatttgctttaaaaaatgagactactgttcttttttttttcctgtcatttaattcacttttatattttcttttatcattatatagtagtgaatgttttagttttttaataaataatatatccattgacaattttcttcattatcatctaaagacaaatcattctattcactattaaaataattatcttaaaagttatattaaaaattatttctaatttatttacattttttaaaagaattacactaaaaattatttaacgtacataaaattttattgcaagatttaataacttttgtttatttttctatcatcatcatctttattattattattattattaaagtaaattacactctattccctttgttttgtccaaatttcactcgaaagtcctcctttttttgcaacttataaaatcccccttaatttttttagctcacattccattcagaccctccgtcctaaacaccatttaataatttaacagaaattagacacatattggtcatataacttttaataaaattttatgtctaaaatactctcatattcttcctcttaacctcaaaatattttaagacttttgcttctttttgttttctctgtaattgacaacattgcatatatcacttggttcgtctggttggttcgtaaagtgaatcgaaatatccacattgcctaattcaggacctatgtatttagttcatccattgtgttccgttgatctcaaacatcagcactattttaatcaacaataagaaacaaatgtttttccgttcattcattgtatttcataacatcaacactattttaattaacaataataaacatatgattttaaaaatcataagtggtctcaaattggtctcccattgaaactccattcagaaataggtaataataaacactttaagtacctagcaattattctcctgatcgattactacaatttaagactttaagtacctagcaagggaagcaataataattacaaccagagtattttatatgccctaagtgtgatatagacctagtgcagcgaacaagtgtcagggtatcacactatcaccaccacaataaaatatttcacttgtgcagcgaaagagtatacaagtgtttagagtatcacactgtcaataggtaattgcaatatacaatgaaacaaacaagtgttggagtatcacactatcactaccacaataaaatatttcacttgtgcagcgaaagagtaaacattctcagcactaaaatacacatgcaatatagacatcagacatccattatattccacctttgcactaggtagttgccatacactagacaacgagagaagagtatcgcctctatcactgatcgctagtaaagggaaagagagaaatattctatggcaaaatgctaatagaacctgtccatagaaatcaacctatcgtcttatttttacttgtaccacagaaactaggaatatccataacaaatacatgattccatccaataggtaaaatctacataaaaaaaattacttactgcatacgtgatttaaatgtagttaccttatcataacattaaccatcgacagaaaagcagacgactcaattagctcatgactacatataccacagagaggaagttggtgtctctattctagaagttcttatgtacgagtaacaattcagtccaattaaattatagcctgtagcgtacataacaatacaggtgttggattgaatttcaaatattatttaacaaaacctgaatttggaaagtactacttcagtgttttttttgtaatagatagaatgcaaacaattatgccacacagttcacacataaatactcaaattatatataaaaattaaaaaaactcaaaattaaacacatattcatcattagtccgtagcctaaacacacaatcatcataaatgtaatgcataactaataactaagcagtagcaagagtcatcaacttttactatgcacacttccgtaaaaagtactaggaatgacagaatagcctgcaaagtgtgtaaacagaggcaggccagaacagagaagagaatgcaaacggaagtgctgaccttggccagaaaatagaagggtcgaagattgatgaagatgagcaactgggtttagtcaaaagtcaacataaaactaacagggttttgaagaagagaatgtgaatcataaaagtaaccctaaaagtggattatggatccgaagagaaggtggaacaatcatatttttgccacttattggtacagctgtgctgtctactgcaattcagccactatccacccaaagctaggagttccctgaagtgtctggcagccacaatgcgcagccatagcacaatagtggcaccccagtattcactattctgtttaaaatcttctatcatagactgcaaaagctaacaagaacatctacttgtattccaagcacttgcctatgattgcaataaagtcaacaccttagcaagagttaaacatgtaaaacatcattttgatacttgcttattccagttggtattgccacttcttcataattcctcaatggctcaatttaacctcaaaaatcctgtaggacaagtatgagaaagaggttgatgaaagactgcggacaatggtttgatactgattctccactcttcaatttacttttaaacaggccaatttgtccagttatacttgtatatctgaataaaccacaaacaatgagggaattgtagagcaagtaagactatattcattattcaggagaagcaacagcagcaaatgagttatgcaccacagtcagatcaactaactagagattttagagacttttactccagtcacttcaacacatgatccgatggttgaattccaaatctcacactttcaatgaaaaataaaaggttcaagtatgactgcaacaattcatcaaaacgcttaaaatctggttcataaatcataacctgagtgaagtgttccaacaattactgacacatagcagtttatgaaacaagtgcatgtgtagaggaacacaatagaaatccacgcaattaaatatgaagtgctcgggagtaccagaatttattcgagcacaagaccattgcattggaaaaataaaagcaaggaaaattacaaagcaaaaggcagcaaaattacaacattcgaattcaagaaagagaatccttctgactggcctgctgctgcaataattcttctctaacccttctgatctccgcttccttctccaacctctctttctgagacagattaccatacagaaagagggtaaaaaaaagtacaaaacaaatagcattcgtacttagagatacaggcatacagcacagatagatcaaataacacgaaccattgctgaaaggttcaaaataatgtatctacgaaatggaatcctaaaatagagttaaattgagttaggtaggaaattataataatcatatgttagaagatatctcgggtttttttcattggaggagagtgaaattgagagaaaggaatgaaccttttcgtcttgacggagagcgatccagacatggagcttgtccatggactgccagaacacgaaggctcccagcgtcatcgcgaagtacatcgccactttcaccatctttctttcttcttctctgcttcgatttgcttttagtctcagaatctcctttcttttccccttgtaatcaaaatctctgttttcccctcttttgcgtattaagatggaacgagaacgagaatgtgacgtcgggatccgcagtttgcttggcctcgtccttactgtgtggcccaaatcccatgcgaagcccggcccattattttcagtaacatgcatctgtctcatgttgcaatcgggactcgggaggatccttcataaattgatcgagaaatcaattcataattttatcattttatgtttcttctattcaatattagtaagtaatacaagcatgattaaatgcaattttggattcttcattttttatattcgtttaattattttttaattgaacaattttagttcataaattttatcattaaatttaaaaattaaaaccctctcttagtctcataacaccgtaattgatttgtgagtgcatttcattttttacataaaaacgcagttaaatattacaaggaaataaatgtaatcaggaattagtgtttagtcaaaccagtgagcgtaggaagatagtaatcaaatgttctgatctttttgaagatatatttcttgaatgaaaagtgctagtaatttataatgacagaataatagattataaaatatattgtttgtgaggtgttttacgtctggaccgatgtgagcctgtttgcttaacgtcaaaataaaggtcatcctcttatccaagtaaattaaatatatctgcgtgatgaaatcatgaaaagttttctaataatttggaggcttgtgcctgttttaatatcacgtttggggactcccattggcggagtgtccggtcttttgtctcgactgtatctacaagactgcgagtgtgcgaagtgtaaaatatggccaacttgcgctttgagatggtagctactcatcaatttttcttatgaggtgacattgcatagaataattcaaaaagagcgagcttcccagccaatagaagaagaaagaaacaaaaagaaaaggaatcaattgttttggcgttttcccattgatgctccggcaccacccacagtaaatgctccatctgtctcaatacacacttcaaaatgcaatttaaaaatcgttgatcgttccctcctcttacccttttttctcttgttcgtgtcaccatttccacccgcttaagcaaacttttccttttctcctctttgtgattctcatctttattttgcagtgcctctctaaccacgttatctaaaacagaatcatgcggatccaatggtggctaaagacatgctcctccgccaactgcgccaccgccacccaccactcaacaatctcatcactccccaaacaaaagcaacatgcatgtgatgattctatcagccactcctccatttcagaagcaccatcttcaacaacctccaacaacagcacttcctccctcgaaagcaacctctccatacaaaccctcccatccgttccctctctccaaaacctctctccacaaaccttcaccttctctgtctcccaccattgcgtcaccaccctcacgccacacccttctcaccccgtcacctccctcgccgtcaacaacaacctcctatacgccgccaccgaccacgaaatcaacgtctacgaccgccacacgtgcaccaccctccacgccttcaacacccaacccacctccaactccaccaaaaccatcaccttcaacaataacaacactgtcatcaccacccaccaagactgcaagatccgcgtgtggcaaaaccacaagaaccaccaccacagcatggtagccactctcccaaccgtcaacgaccgtctgcgccgtttcctcctcccgaagaactacgtcgcaatccgccgtcacgataagcggctctggattgagcatgcggacgcggtcacggggctcgccgtcagtaacggctctatctactccgtttcgtgggacaggactctcaagatatggcggctctctgattttcgctgcgtggagtcactgaaggcgcacgaggacgcggtcaatgcggtcgcagtgtccaacgatggaaccgtctacactggatccgcggacaggcgcatacgcgtgtgggcgaggcccgagggagagaagcggcacgtgctggttgccacgttggagaagcacaagtccgcggtgaatgctttggcgttaaacgacgacgcttcggtgctgttttcgggtgcgtgtgaccgttccatattggtgtgggagagggaggacagtgcgaaccatatggtggtgagtggggctctgagggggcaccagaaggcgatactgtgtttggtccacgtctctgatttgcttctgagtgggtcggctgatcggacggttaggatttggaagcgcgcttatgatggacggtttggatgtcttgctgtgctcgacggtcaccggaaaccggtgaaatccttggcggcgattccggaggagtactgtcatcaaacttcacctaaatttagcgtctcggttttcagtggctctcttgatggacagataaaggtttggcaggtttctatcaccagtcagtcatgataatgatcgataattgatttcctagaaaattgatgatagcagaatagggaaaaagtagagaacaatgaagaaaaaagtactgagtaagaaaatatgtataagaatatgacatttctgtcatgatttttgtgatctttatgatagcagctataaaaacacaaaccaattcttttacaacacttttttttttgttgtctttccattatttcttttattgtaaatttcattgaataaaggcaaaatttctctttttgtaaattttggaagttatgttagatcaattataccttttttttaaaacctattttaatattgacaatgtaaaatatgatggagaattgaattcctagattgcttttgtcgacgttaaaaatttagggaagggaatgatgtaccaatttaggacaagaaaagtcttcaaactcaaaaaaatgtttaaaatttgtgatttttttttcttacttcactcaattactcttgagactaaattcctataaaaaaattagtgatagatgaaaggaaaaataatgaaaaaaatattgtgtcgagataggggtgaaaataggtcagaccatatttgattagaccgtgatttaaaaatataaagattgatataacctattcaaaagtttggtttgaattatggagcctattaaaaaacttattttataataaatgttatatataaataaaatttaatgattatacatttaaaactttgaaaatttgcatagtactttttaaaatttaatataaataaagacgcatacttttcttttaatttgtgtatgaaaaataataagttaaaattaattcgagcacttttaagtattcaataaaatattataaataaaataagcaagttaaataaaataccataagttttatttaataatctagtcttaatgtcaaatactaaaataaataagaaataagaaccaaggtaagttgaagaacattttttaggaaaattaattttacaaaacagtttaaatcaatttatgaaagttaatgaaacaaattttaaatagaaaatatctcaacttcctacttatattttcaaataagtaataatcattttataagattttcaaggtgattttttgaagtggttcatcattcactttcataataaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgttaagattgattttcaatgtgaatttataacttgaatttaaaaaataatactaaaaagtatagttataagttagtggaaaactatttaaaattataaaatcatgtcactaattggagcatgaaataatttatgaaatctttgacatattttatcattcaattatcataattttgtaaatttatcactgaagttatcttttatgaattttatcacctattttttttcgcattttaccattatagttttcaattcaagcacattttattattttgttggtgacaaaacaacatcatttcttgctttcttgctttctcctttaatttttatgtcatcatatcctattccagttgtagttattgtgagagtagactcaccatgtacaagtttaagtcgagacacaatgtattcaatttctgatccatgttgatttagttgatatactttgacttgccaaacaacaactttgcttatggtgattggattaacaaaagcttgtgatcgggatggagaaactaagaccacaagaggatgagctagtaagctctcatggctgtggtagagggcatgagatgatgaagagagagggcacaagaacactaacgtggccctcgattgcctcattttcatccatcacatcacctaccatgacagcttcctccttcaaatctgaaatttccaaatcaacgattttcatatctaaggaatttttgcaacttggatgtttgttgttcaatgttttgggtttgttgggagttaagtttaaggggttttgaaatacgtgttgacttattgagaaatacgaagaacttatttggtgattaagtttcagtgtctactttgttgttggatgtttaattgtcattttgttattttgggagtgttggtattggaaggggtttaatgacatgcttgtgaaatatgtcgtatctaacgtgtttttcttcttctttcatttaatggtttttaactatcataaattataagttaaaattataaataaataggatagttgatgagttgtagaagattgtattttaaaatttttaaccgacacagttaatttacaacataaatttaaaagaaaactttttttattacgactcaatgcaaacaaaaaattatagaagacctgaaataaaattcattttttataaaatattccggacattatttaccttatttcttgattctgacacttactattttcatatgctatttttatacttctttttcatgcaatgtgtatgttaggacttctcacaattatttaatggtgatacttttattgttgttggttggttgagcaaaggcaatgtcatgtctcgaacttgggatcaattgtgacattgtaattagcaaaccattaaattggaccatagatagacatcttgatacttttattggaagcctataattaggtaatttgtctttatcacaacaatcttatggactttaaagttttttcccctgatcaattaagttttgaaaaaataaataaatagttttgtcttttaaaaaagatgttttttcatgcacaatgaaaacaaatataaacaatttagttaatattgtttctattaataaaataacatcacttacatttttagtataacaggaaagatgatttttgtgaatgaaatgtaaaaaaatgaaataaattatatggggatgacagggtaagttgaaattgccgagtcaacttgcttaagtaaaaaaaaaaataaaaaataatagaacattttagacgtttcaacccactaacttatctaacctaatgtgttgaaggcaggtggagagacagactaaccctatattcaagtcaaaattaaaagaatccaaacaaaaacaaccttatgttataagttccaaacaactatttaagtcacctctttgacatctattgacacctttcttcctccagcactatctcttctagtcattttgtcttggttaataatcttatgaactggtttttctttggatggtgcctgttcctttttgttttcaattccttttcatcagtcgattatttttagcaacgtttctcagttcctctctccaacattgttcttcttgggtgttccttctccagcgaggacaagtatgattatctttccattctcctcttttgcctccgcgttcagacattttggttttgggttgattcacattcacatgcaaatgttaaaaaatgatttagtaaaaaataaatagattttcacatctctaacataagaaaaaaatatttctataaataaatgaaatgtattattatattggatacagtagataaataatgaaaagcatatgaaaaaaatagattaaagaataatgaagatgggatttaaaaagcagggtttaaaaattattgaaaacgaggtgaaaaatagagtgtacattgttttttttaatgaatgaataatttattgataatgagattttgtattttttttatataaaaatgcatttttgacgaacaaattaaaagaaaatataaggaggtattttcgtaataggaaggtgtaaataacaacagcctggaacccaaaattaagttgattttttcttatttaaaaaatccattcggttaccaattttttggatctcaacggggcctaggcccaatttggctaccactagtttagatcgtaggcttggttctgttttttctttataaaagcagaggcagaaccccctattttcttcaattaagggataaaccctaacgccgcgaggccaagggaacactcatccgaatttctgcatcaaacattgcttgaactttttgaagtatgttctcttctctagggtttactcgtttctcatttcttcctgaactagttcttctgctattgtcgcttttgataggcgttgcgttctttgtcagtttctatcgccgaaggacgtgtcaacgaaagcgtatacgaattgcaatgttgacctcttttgtcacttttgtgacttgaacagctacgcactatttcattcgtagtctgttccatggtctcgttgtgccattcctttaattcaattatttatttatttatttattaacggttgcttcttatggtgaactctccctgattattccatgggggttgttctagtttccgaagcatatataaattaattcgtcttgaataaccagttttaaacagcgtggtgtaatcttctctaagctacactatgctacctgtcttctggtacatacaattcattactatatattcattttccacaattaagagcagtgtcaatgacgttctaatgaaactaatttttagatttcagaatctgaaaatgagaatttgaaagattagagtaaagtaataaacactgacgcttggctattaaaattgtagaaatggaaacgcctaatgtaacgatacctaaagttggacctaaaccgtcgaggaaagtgaagcttccgacgccgaaggagctgatatcacactatgaatctcagggtatggactcgcaagatgcgtcgttgaaggtcattgaggatcttcagaaggctctgtttggagtcatatcctctggcaaaggtaagcacgacaagctattgactgaatcttctaggaagattgattcaattagcaatagactcactgttattgacatgaagctcgattccaagcctggttatgttgagacttttgcaattgggcttgcctcaggagctgccctcaaaggtattggtgcagttgtgcctcatattattgcccctcttgctcagatatggaactctgtttccactgccattaaatcttccccccaatgatatattagtttgtaattattagttagtttgtagaaatattttttaatgaaatgactatgctaccattttttatgtcattataattcgtgtttccaaaaggcaacatagaggatcttacagaatctaatgaagaaatgacttgaacaagttttgcattaccattacaagcctttacaatcaaaccataaatatgcagatgtcatgctgtctgaattgaaaacctagattaagcaacacttggaattcatacaggaattcaacacacttatgcagtcagtgaattgaaattgttggatgaagatttgctggttcaagtattgaatttattttaagtctaatttactagttagtgtataagtgatatcttcatccaatagtttcaattggcatcaatgtgttaggttccctgttaacacacaacttattaattgaaattgttggatggagatttgctggttaaagtattgaatttattttaagtctaatttactagttagcgtataagtggtatcttcatccaatagtttcaattagcatcaatgtgctaggttccctgttaacacactacttattacacattatacattaggtgatgtgtgtgatgttaggagtttactcgttgcagcagtgatacatgtagaacttttccattgtttggccacattcagcacaggccactttgtctggtatcctaaactggttcctgggagtatcaagcaattgcagtggtgaggggtttggagttcttttatataatcatgcattgctggcaaaagccctttatcttttgctgcatccctccattgctcatgttcgtttaggcactttagaaatgcttctcctttgccctgtgccatctttcctgttccttgactaatcacagcccatcctgggtcaccactatcgtaggttaggattctcattacttcatgcattatatggtggttctgtactgttttactctgctgtgatttagagtgccacatgctctctagcctaacccaaaagaaccaaattatggctaggtcaggaagtatgttgctcaatttttctgcttgtatggcattgttgatttcttgaactttcttccctggattgcttttccccacataaatcatctctagtggtagttgcagagctcttgccagttaatatgcagtgcttgtgaatttagggatccactctatatcatccccttcatacgagcatatatatttgcctttgatatctaaaccaagtatatgcattagatcattgtacattcatcatggttcaaggagtattgatttctgtaagagttctaattgttgctttttatgtgatcttatcatagacttttcattgctcaactttgaatatgttatactagagtgctagttttgcataaacatattattcacaagaaagaaaataatgtaaagattactaacccattccaaaagcgatggatcaattgaatctgccaatagtccaagttcccatgtttcctcattccacagtgcttcctcccttgagctagagaaaggataagccaagcttccccaaatccacatcatgggtattgcattaagattcacaaccttccctagcggatccaactctacaagaataggcttcgttttgaacagccatacctctttaatgtacctgatggttgcgggctccaatagagaagggtcataaagtgagtaacatgacatcattggttgcagcttctcaaactttggtttcacgttagtccatgggattgctttgtccacaactggaatccaaacgagttcgtattgactctctaacctggttgaatcctgacgtgactcttagtacatttgttcaaaaatcacaagctcttgatcagggacattatgtaggtctgttatgtagagtagcacaattttcctcctcaacacctcaatgctaacatgaagacaaactacctagaaggttggaacaggacagctttccccttattgggtcatttgccaaaagttttgattcatgtttggattcaccttaaattatccaaaatcacaacatgtttgatcccaaaggagttaattctaagtaaaattgattgagttaaaacaaccattaagtaacttttgtgtttgataaacaaacttatcctgaattttattatagattttcttttagaataaaaaaatctaaacacaaatcccttcaaattcaattttaaagaaaattaattttgcaagtcattcatcaaaacaatcataaccataatattcgaatttattgggggttgaaaaaacaaagtcaaatagtcttcctgacaatatccatactcgagtttatttgtattacgtcacaagtaactctttaaatatagtataaaaaatgttctgctcctgtatcttccaaaaggaataaagatctctgagagctatttcctggatccaagcgagagtgccctttctgacacggctgcgtcctcacgaatgccaaacttcgtaggcatctaaagccaatccattacaagtgaaatcttgcccaactccaactacaaagaaaggggtgaggtgctcattatgtataaatgggatctcttggcgccaaataattgaaatttaatttcttgatctttatcctcaatttttggaaacttaaaaagcccttctggtaagcccgctgaatagaaacattaaactaaaagcccatacaaaatgtgcacccaagaaaaaaagaccatatgcagataatggcttacctaaatgctgatgacaaatggtgagtgcattggaaggtgagtatttatgttatcaagcttatgggccaataaagttaaaaataatgataacaaaacagacatgttcaatcaagagtttgattaaagttcttttggtaaaaaaaaagagaaattaatcggagttactaagataaagttgtgatgattataatatgacattaacaatggaggcatacccttgacccaagccagttatgcctaaaacatgcggtgcacaggatacaatactccgaatggtccaatagacagcaccgggaataagattggaagcagtcaacatctctgggacctcagggtcaatgtactgagagtgaagctcaaggaattggacaacgttattggttacatcgaacattgccttgagaaggttgttgattgtttgaaactttggtcccaaatcatccacttgttgcagtgtttcatggatgtgcttcaactttgcaacagacttagcaagacgattggtggcataaagctgagccaccagccaaaatgccccgaagtttgctgcaaatgctgctaacgctatcaccactttggcatcccatgaatagcttgagagcatgcccagtattcccatgattgtggcatgtacatctccaccgctcgaacgcttgtaacatctattacacaagcatgagaacatgaataagttaaaccacacaatagataaaatagtactctctccggttctttttcttataaaaagaaccggaggtagtattgttgttgtaggcgtttaaatagttgtggctattatcaatatttatacagagggagatttagaattgtaagaaaagatttattgttaggaataagaaaacctcgcagaaaattttgttgattgcgtggtacgaaatatctagcacattagctaaatcagattggtatgcactgctcttcatggcatccatctgcccttgttttccctgtgtaaaatttcaaaaacaaccacactcagaaaccaagttaaccaagaaccaaaatgcaaagtgagggaggagagaaattattgtatgttccacgacaactgtatatggtttccattattctccacttaatacagctaagtttcattcactctttctaataaattgaaattttgactatgtactaaatcacgtaaagattaattgagatcatacaataatttctggagagagagagagggatgagagaggctgcacggtgaaaaatgtcttcaacaacttgaaaaagaggtctaacgtcaatgtgtccatcaacgggagcatgagtgtgtttggtcattgtagtgtcatctgatgctgaataaatatggcgcctaggccccgattgcatctcccgtggcaccattaccataacggaaattaaggatgcaagaaaggaagaagatcaaaatagataatgtttaggatcgatgaatttgggcttggttattgctagactgctagttagtgccagtggcttcttatatagctattgatgccaaattttggtgaatctttaccttacttgtatttggtttcaaatcacaaagtaagaaaggaaattggaatatcagataaaggatttgtcgaatttataccttcatcatcggttatggctttcttattttattatcttgtgtcagataaaaatgaaatcacactagtgctgtaaactttttaggttattttattcgtaactttcatatattcattatattggcaacctgttagtctatcagtagttttttcacatgcacttttaacctaacacgtttcaaaaattaccaacacacaaaagtataataaattcacaaagacgaatcacaagctacgagttattgcaagaaaggtataaatctttcgtaacttctatgatgcgaaagaatcattgctatttattaaagtgtgaaaatagtttgcaaggatatacttgctgtcactttaggatgacattgacagttcgaaacttgcagggtttaactggaactaaagctctgttcaataacttaattattggcagcatgtaaaggatttgcgaaaataaactttgttcagttttataagataaagttttaggttgggtccacaacgtaagttgccaccatattaatatttgtgttattgaattcatgaaaatttcgttcacatagatcattttatccaagtctttatcacctcctaaaacaagattctccgcaacacattattgattttggtgttgggcaacattcaagctccttaagccaaaaatcctcgttaacattaataaatttatacattttcactattattatactatgtactgaatattcacacggatatgcttatttactgcatcatgttcatgcaattaaaacgtaagcaagggatacctttgatgagtacaacatatcgacccaaattcttaaaagcaacttatattgagctcaatgatttccacaaaaggtccggtgaattcagcatggataatgtcgaggttgtcgagattgacctccttccactgtcgataagtttgaaccattggcttccagggtcacatgtgttatctttgctcaagcatttacaagcattggtcacaatgatgttgttatcatctacatctagacataaaatagaaccgtcgcttaggttagatgaaaggtgcatgttcgaatctgatatcatttcccatttagagttaggatctgagcatgtcatgctaagtgttgcaggctttctttcatcctctgcatgtatgcagaaatccgtgttgtttaccaatagggtcttttgagatgtgtatgtccaggcatcagaagaagagcaagcacccaacgttagtgatgttagctgtgatttacttatgacacagagacctgtcaaagggtggaatatcagtttgtgtggattgccttctatgatgcctggtcctgcacaatgtcaaacaattaagtgacaaattagtaataatggtattttctaaccaactaatagtgcacagtttggaaaagaataattgcgcaaattttgtgaagtatgtgcaaaattggattattcaaaaatagctttaacagaaaagggcgagtacaaaagcaaaaggcacaagagaaaatgttaggaatgttataatacacttttttgaacatattcttttaaaaacattcttttttattagttaaatttattagaaattacaaaattttatgagtcttatatcttatttaatgaattttatctcttttttttttttaaggttaatgaatgtgtttcttgattttgtaattttcaataagttttaaccaataaaaaatatgttaaaagaagtgtataaaagagtgcattgcttatactacaaaaacatgaattaaggaagtacaaaaaagtcctaattagtggttatggtcgcagcgttacctcgaaatggaatttggagggcagagattctgtttaagaaactggtactcctaacctgattccaatcccaagtgagaaggccataaaactcttcctttcctataaccccttctcttaagtagtaactaccaacaagtgtccaataggcccaatccaagtcaagctcagctaccagtgccagaaaacagttaaggtatcggttgtcattcacattggtacctctcaagtccccaccaaactcactcacaaacaatggccatccatggtccactaagaagccagatgttttctttatattcgctgtcacttttccacatacttggtttgggttctcatcagcccaagctccaccatcagtgaagccatacctgtgcacctcaaatactagtttccctttgaatgtcaggctcactggtcgatcccgaaggaatgacaagtctgtgtcaaaatttaggccagatagaatgactagaacatctggatttgctgcatgagcagcttctgctcctttcaccatataccttcaattcagaataacaacttaattatcatctacacaggaattttctttcttcttttttttttttttttttttttttaaaactattcnnnnnnnnnnnnnnnnnnnnnnnnnnnnnnnnnntttggtgttgcaaatcatctacatagccataaatcttaccaaaactatgtaggaaattgattccgtgttgtaaaacaagccagcgaacaatgaaggaattgtaatgtttggaaattgttttctgatgacaaattttgtatgcttaaatatatttttcatatctataatataatttattttaattttactaccataatttcaattttattagatattttagtaattatgatcagtcaagacctattaggtaataatctgacatatttcattagtttatcacattatcattttaggtccatttcaagatgaggttgtagttgttagcagttacttacttgtaccaatcattaacattctgtctagatcctcggagctcattcctcaagcttatgcccacaactgctgtaactcccttgaaaagggtggtcatcttggtgaggcccaatatccactgatttgggtcaaaaaatttgtcaccgaagaagccattgccgtccgtgttaccgcagcaccatcctggctgggtcacgtggttgtccaaaatcaccatcacatcgttgtccccgagactcttcaccactgcctggacacatcacacaatattgcaccacactcaactcatggccatacaaatattcagaataattttgggtccaaagttaaggattaatttctaaaactatgattcatttcgaggattgatcccttttaacataatttttatattcaccacatagagattaaactctatactatatacttaaaacacattattatctcttaactatgtcacaccataatctctttagtttcattatagtttaattacattttaaatctctttagtttgaattatgtgagattttagttcctcacatgtgctttgaattaatttactaattaagtatctttagttttaaaatctttgaaaatttaatgattataaatattcttttactcaaaactcactcactaaaatatcaaattttgtccgaaataaaaaaatcaatttcttaattttctctttaaccttaatcattatccttttattttaaatttttcactaaatcatcaacctctcaaacatttgaataaaaaacaacaattaaaaaaattcaagtagaagaaaatcaatagaagaataaatttatttaattttaaaaacagaaatcaaattagctcaaaccaaattatacatatttcaaataaaacgatcaacaaatgtaattaagtcaaaaaaacatttttacagagcaaatattttgtattgttgaaaattcaataaaacaaaaaaaaattagcaatttaattatgcatgcatgacgtaataagaagctaacggaagaaaaaaaaaaataggttagcccactgttcacgtcaacaatgatgaatttaataaggatattgcgacatttacatggcaagctggcccatagcaaattagttgattgaagcactcaattatcaaaaaccacaataagtcaatcgctatcggataagcgtcaccgatcgataacatcaatgatcaagtgcaagatttaataactaaaaatacacgtacgatgaggtagttaaaattagtcaacgaattggtaaggttgatttatgaatgaactgagttgggtaagaaatagaagtaattaacttaaacttacctgaaaagcttggatgagagaaagatcgatgatggaggggttgttggtttggacaccagcaatggattcaaggaggccaaggctctgaaaagatcgtctaacggtgagagaagcaagagagtcattggtgaccaaaagtgtgggccaagtgagcctgacacagttgaagcccatggactttattccctttgaaatcacatccacgggctttttgctgagcccttctgccaccgcaacttccaaatgggatacccaattgacacaggctagtttcaccctttggccatcttggttgaggatccatcgggaatccgtgtgaagaagacccgtcacaggcactgtgtgatcatcggaggagagtaatgctattattagtattgatgcagagagaacagcgaaaaccaacgtgctcgaccaccacttacccatttccatttcatatgatatttgatattccacgcgagctaatgagacaccaatatgttgtttattgaagacataggaataggatgtctatatatacatgtggggaatttgtgtttctgtctactgttcttttgtcattgtctttcttaaagtattccctttccgagctatatatcttgttatgtaccttccaaatctttctcatatgagtaactcctttgtttcacatgattttttcacattcagaaatcacataccaaaatatattgtactaaaaaatgtttaaataaacttctgaagaaaaaaattaaaataattaaactttttatatatatataatttattttatacttaaattaatttgtaaaaattttattatttaatttctctaaaaaatcattttaatttatacatataagttatctaggggtgtaaaaaaaattgattcaaacaaaacatgattataattgaattgaaactgaagcgatctttatccaaaattattttgatttttatttgaaaaaaatcagttcagtgcgaaataagtttgattcttataattagtttaaaatcaatttggttcataaacggtttttaaaaccaattctaattctgaaccgattttctaaattaatttgactatttaaatgtaaaattaaaccgattcaaacaatttgaaaccacttcagattagtttttttttttaccaaatcgattttttcacacccctgaagttatctgagcttatggataaactttatttcgttttcatttataaatgttaatgaaagaaagtctaactcgctattaagaaagtaaatgtaccaagtagctcagtagattgattcccctaaagtatatgcaaccatgacgaaaagaaaaagtgtagtagttattaagtgaatataattctttctctacatatacaattcatcttatacaaataaaggtgaataactcttctttattagctttggaaggttgtgcaaaatcaaggactaaaatctttttgtcaaggcggcgtataggtagtaaagaaacacgcatgtaagaagttttcaacttcgtactaattgatagttttaaaatgagtatttaaaatttattaagtaaaattaattaatattttttacaacaatcttttaggaaggttgtcttgatttttttataatatttatttctatataattacattgaatttttttaatgagaatgtttttaagaatacttattgaataaaagtatttttaggagatattatttaatgataacctttttcaggagttattttcattgtcattgagtcacgtgttatctcaatcttatatattaacatttatttatttttaattatcctcttcaaatatatttcttaattttattttattgattacataattgaccatccctgctttgatcacaatcctgaaataatattctctatggcacaatgtactatgttgactttggtgtcgtttagcaatggtgccctggtcttgagccaaaaatcctagccaacgttagtaaattctgtacatattttaatagtgaaataatatgtattgaattcaatagtcatatatatggacatgtttaatgcatcacttccctgccattaaaacataagtacatggttagagaaatttacggtaatattcttaaaacaacttatgctgagcttaatggtttccataaaggtctgatgaatttagcatggatgatgttgaggttgtcaacattgatctccttccgctgtcaataagtttgaaccattggctactagggtcacatgtacgatctctgctcaagcatttgcaagcattggtcacaatgttgttgttatcgtctacatctaagcatacattagaaccatcgctgagtttagatgagaggtgcaacttcgaatctgagatcatttcccatctagagttaggatctgagcatattatcccaagttttgcaggcatcccttcattctctgcttgtatgcagaagtaagttccttttattgatagaattttctggggtgtgtatttccagccatcagataaatagcaaggacccaatgtcaatgggtctagtaatgactttcttatgacacacaaaccggtcaaaggatggaaaatcaatttgtatggattgcctcttgttatgcctggacctgcatgttgtcaacagagagaaatgtagttcaagtttccatgaagtgctaaattggcaatttattttttgttgaacaacatatacatcaatggtagcaaactcaatactttttttagtaacatgaacatttttatatgatatctctatcaatgtgtaatatggttaacagataattgatccttaagtatataattaagaattcgatctccagatatgtgcgtacacagaaacatattttgggaaagttaatattttttaaatagatctcaatatctttaagtgattagtcgttaactttggattaggattaaaaaaaaatcatagctttatcaaagtttccctaaagtagtaaattggtagtgatatttttcaaccaactaatagtgtagagttaggaaaagaatatttgcacaaattatgtactacatacctcgaaatggaagttggagggcagagattctgtttaagaaattggtatctctaacttgggtccagtcccaactaagaatcccataaaactcttccattcctataactccttgtctaaagtagtagctaccaacaagtgtccacaaggcccaatccaagtcaagctcagctgccactgccaagaagcagttaaggtagcggttgtcattcacgttggtacctctcaagtctccaccaaactcactaataaacaatggccacccttggttcactaaaaagcctgaggttctcatcatatttcctgccacttgtccacatacttggtttggattcccattaacccaagcttgaccatcagtgaaggcataccagtgtgcctcatatactaatttccccttaaatgtgaggctcactggccgtttttgaatgaaagacaagtctttatcaaaattcaggccggataaaataacaagaacatccggatttgctgcatgaatcgcttctgctcctttcaccatgtaccttttgttcagaacaacatattagtcacatgaggattctctctcttttatttttctttctttctaattttaaataaaccatggttttatccctcatacagttacaagtaacttaaaattgtatttactctagcaccagccaccagctaattttgaaaaaagagagggagagaggatgttttttttactgcaagtaacttatattatttcattcagaataatgacatcaatacaacaaaatattgaacataaaatctagatgctctagcaaatattaggggtgacaaaatggattggtcttatcatgtctacttattttggctttttttaaggtcaagttggaattttaaactcattccatttttgtcagtcaaaaaacgagctgagagaaaatcaggtggatcaatccaccaaccgttttttattaaaagatattatttattttgatattttgtacatatattattaatttttaattattttttaaaataaattattatttaaaattgaagataataaatttaattttttaataagtatttattatttaatatttataaaaaataaaattaattaaaatcaattaaaatatatttattattattttaatatttagttttggcggactattttactttaattttgataattgcatactgttcgacccacaattacaatattaatatgattccttttagattatagaaatagagaaagtattatacaaactttgacttttcttaaaaaaaaaagacactttgactgtgagcacttacttgtaccaatcgttgatattctgtttgggccctcggagctcattcctcaagctcatgcccaccacattagtgactccattgaagagggtggccatcttggtgaggcccaatatccactggtttgggtcaaaaaatttgtcaccgaagaatccattgccgtcggagttactgcagcaccaccctggctgggttatgtggttgtccaatatcaccatcacatcgttgtccccgagacttttcaccactgcctgtagtcatcacaaaatgttgcccacactcaactcaaacttgaacaaactcatactatacggaagttagttgagagtgtggttcggactcttaaaaaatatcacccttaaaaatacccaccaagaaactgtccaatataaacataataattttataaaaaaaataagagaaaaatgaatttagttaataaaattattttataataaaataaagagtttaatgtctacaatataaaatattttttagtatcattcaatcacaattgtgtaaatataaattttaaaataattatcataaaagtcaatcaatttattataatgatgagagatataagattagttaagtagttaagaaggaagaaattggagaaaacgtgtgggtttgtatagacattaaactcataaatatgattatttaaaattaaaaaaattaaattactaattatttttaatgctcaatgttgattggaattagaaagtataaaacgagagtttgtttgtaaattaagacaaataacaaaaacatattctactcactatatgcaacataaatggcaattaataaggaagtaggttggagctgttttcaataaccaccaaaaggcaatcgccatcaaatatgcgccaacacatcatgatgataagattaatagcaaagaagataaggaagatgaggtgattcaaattagtcaacaaactggttaattaggcaaagaaaataattgaattgaatatgataacaaaaacaatttacctgaaaagcgtggatgaggggaagatcgataatggaggggttgttggtttggacaccagcaatggattcaaggaggccaaggttctgaaaggagcttctaacggtgagagaagcaagagagtcattagtgaccaaaagtataggccaagtgagcctaacacagttgaagcccatggactttattccctttgaaatcacatccacgggctttttgctgagcccttcggccaccacagcttccaaatgggacacccaattcacacatgccagcttcacccgctgcccatcttcgttcacgatccatcgtgaatccgtgtgaagtggaagacccttaacttcaactatgggtccggagagcaatattattgttattagtgcagagacaaaattgaagaccaaagtgcatgaccaccttcccatttcgtgtttcttcagtagtatcatctgttgtttgcctatgccatcatattccgcacctgtgagattctctgcacgcctgaacaagcccaatatataacttgaggatgtgggattgtacatgtggcaacaaaattattttttaagtttaagcaacttgtttatttaatgtcattttgtcgtttatttttaaagtaatactttacaaaatatttatcatcttaaagttattttatatttattaaaaataataataaataaataaaaacaaataattttataaaattaatattttattaccattaattcatttttagattttataatttattattattcatatataaaagatacaagtaaaaaataataattaatattatattaaaattaaaattattttaagataatttttttcttacctaacaattataatataacagagaagtatatctttatccgttcctttcattaaattattccttataacatatatggatcctacaatctatcatgatagattgcataagttctagttgataaataaaaaattgtgtcaatttttctctctttctgatgtacataattatatcatgttactcaataatataagagaattcaatttctatgtctcaccaggtgaacaaggtgactagtttaaggtgagggctacttgcatatttattaattttcatgataatgaattatatatatgtgtgtgtgtgactaagtttaatatctatatattattgtgagtcagtgtaaatagtgagatccagtgtttgaaagtttctgaattttatttcactcctaaaaaatacactggtgaagacaaaagggcattttaattttaattttaagttcaagcgaaaaaaagaactatatataagttaccacacatttcatcctacaagtcatgcaatgttaatttaaaaataagtaaaggtaaaaaaatatgtggtcatttgattattgagatatgatgtaacctgcacgactaatcagattttttaacgcatataaatacaaacaaattgattctcggatccttcaccaattatatgtgttgaactggtccatttgaaaatcctgactccgtaaatatgattttctcttattttcctttctttgacggttaatcagcctcgattagggttcataaaatgggtttgatttaggtctaaaaaagaaaattaaacaaattaaattaaaatatattagtttaatttttaattttttaataaattaaatccaaactatttatcaagaatgggttggtatgttttagtttattagattatattagatttgttatatatattatattatttttaaaattagagaaaaaatttatattacttgattccgatcctaattattcttttgaaccaaaatggcattgtattatgcatataaataaaaataaataaattaataaggaaatttgagtggttggttaaggaactcaattgatattttttcttttttatgaatacctctaacttcaaaaaacaactttcacttcacatcttcattaaacaaggcatgaaacacacaagtgaatttaatgtcagaccttcaactaaaattcttatggcattatgtgtgagtctttgttcatattagtgactccaacaattaatatgacactgcttttcctcccataaactttatgtttaacatcctactaacttttatagtaaaacaatgttgttgattgcttcttcttcttcttgtatactttcttttttcctctaagaagagatgataaagtgtacccgaatcataccccgtatccattaaactatttacaagcgaaacggacaatgatccacaatattgaaactctatactggcggatgtatatttacaaacatacgcaattaaaacattaactttaataatcaatatgttagatgattatctttataattttatttatttataactaaagtttagatgtatcaatattatatttatttatttttaatattatgtgtgtatgtattttaatgttatgtttgaattatttaagaatgaatttttattataattatagtaattattttaattatttttattgatttattattattaaccttgtagataaggaaattgtggatcacatatacatacataaatatataagtatccaatgaatagaaagatgaggattaaaattattacttacttaaatatgaagttagatatggatattatttttaaacagaaatatacgaacgaatattatactatcttatctggaaaccacacattatcatcccattctctaagtgttgttttgcattattagcatcgtaaatgcaggaaaaatgtatacccacacttcattttggggtcgattgagacaaggaaggataggaagataaaaaaaaaatgatagatataataagggatgtaataaaaaagttggaaaaaaaagagataaaaaatgtagttttatatccgaaatgcattatgtgattgcattgtaatagtaacgtagacgtaccgtgactccatctagttcgctagtttgaagtttaataaacacttgaacttaaacgtagtgctacgtaataattgggtaggtgatatatatcacgcaacctttggcaacagtctttctttctgcattttctacagaaaattatgacttattaatttgtatatatcgtgcgtgcactcaatagtttcgcttcgagataaaaagaaaataacggctaacaaagttcatacctgaattgcggggaacactgcaacacttgcaatgcaaggcagtggaataaactgcccattgcttcttattttggtatggctattggttactacaatctgtgctgtgctcgattttgttatacaattataccgtgtctttgtatgattgcgcatctctttcttcgtagcttttttttcttcttgttgttggtgtttgaaattttaaaaattaaaaataatttgatttagattttagaaatccacttttgtgtttcaaatttaaaaaaaaaaagttttttttatagtaatttacaagtttcgaatgtgtgtcagtctgtgacagatgacaataaacaagctcttttatttagtcgtgttttgttgtttatggtgattttgtcaaaggaacaccagtgactgtcaggctgccactgataaagaagtgaactgtgagaccaagacgtgtataatttacatacaagaagaaaacaaaaacaaatagtatacttaaaaaaacctaagaaattttttacaagcaacttacatcaaaacatgaaacctaattgggacgcacaaacttcaaatgtacaatgaggcaacgcgcattcacaactcttcctagctcctaccctggcatatatttatttttgttcaaaattgcgaaatgcagttttggttaggcaaaaatctaaaaacttatccaccaccatgagcctggctaaccctgctcctctctttgctaccctgcctatgatatatcacgttagtttttgacttatgataacaattaagcactcagtttatgacattgtttaaactttaaacgtaactaaccttttttctgcaatgcaaggttaactagtaaagctttattctggtagtgattgtgcttcggcaaatggggcaccattctaggttttctccacaaacacagcaagtctgccaaatgtgagaaaataacaacagtggaaagaaaagttaatataatgtcctaatcatatagtcttagattcatcaagatgaatcggtagaatataattcaacttggtacctggtgcccgcaaccaaatgccatatccttatcattagtaagacaaatcgggcaaacctgcggttaatcatgtcatatgtaaaccattgttgacttcttgtgacacagaaacatcatgaatcatgatgatcacgtcatatgtctcgagattatatgaaagtcacatcttaagttgaaaaaagaatggtctaaatagtaccttattatcatataagtttcttgaagatgattctgcgttaacattatcataatatgttggtgtgttctgttgaaaactgtttgaaggaagaggtattgtgctgctgctggaagccatctcataatgaggtggaggtagaggaaccctgtctggtgaatgtcctctccgtgcactactttcatcaatgaagacacgaagcaagttcagttaatatctagataaaatcttcattaatatgctataagtaccttgtttttctatataatattcatttattaccccaatatgccaaggtctatggttgccttatattgagaaggtatctccatcaaagctgatagtgcaaactctgtctcttctttgcttgagtctatactctctgacattatttccgtaaaattcacaaactacatgcagccaaaaataaaatgttcacatttcagcttaatatgaaggactatgaagaagtaaccgtggcaggtcaataggactaagtgaattacaccaaacctgaaaattgtcaaatgctcgagctgggatgttatcatcaaattccctcatcatatcccatgggccatctccaactcccaccaaaactattgaaagtggatactcactgcaatttaaagagtatgagaatgcagggtggcaatccagaaaaaagaaaactacaaaatttacctggcttttacaattgcatcaattgtcttctcttcctgtggacttagctggccatgttgtgtgtcaacacttctggtcacctgtcgcaatattttaagtatcaatgtttttagatcttatagataagaagaaaaggaatttctacagtaaaagattaatcattgttgaagcactgacaaaattaagggcattttaagttaatcttttgttcagatgtattcatgtatccaattaatcttagcaaaatattgtagtgaagaagacagacatatttcagaactcacacattatgctaatctaacaatctaacaattagcagttttcttctgcagctatcaatgccaagatgtttgtgttaaggtagatattattattatcactaacaaaagaaaccaaacaaaaaaatgctttcataaacctataccattttagtttttttttatttaaaatctatgatacttttagagtcataatcatatagttagtgtgataacggccaatgaaacatttgatgactgatgcacgtttacactagtttaaaaaaatcttcttttcaattttgtgaaatatgtattaaaaatacctgtccatcagcaattattagcaggacatgatattggccgccactttgctcgactatagtcatggccatctcaataataggggcaaatgaagtgggtcctgtcacataaatgcaatgagtcatgctgagcctaagtcaaaaatgcaatgaaagattattggtgaaggcaacacctgctagacgcaggcgagggagaatatctctatatcttgacaaaacttcctcaaatccattgcagaacctctcgtctgaatagaaactgaagacatcttgatcatgtgttgatgctgtcagaggaaaaagacaagaaagaaacacaatcaagtttgcaattttgaaacataagcaatctgaaagcatgaatatttatatatggaattaccatctccaaatccaaaacaaggaatcaagttatcctcgtcaaaaacacttaaagtttttccaataatcgagattgcttgttcataaggattttgaccacttcctatatgatgtaaactttttcggttgaatgacctcttccctgatttcaaagtgatttatgcaaatttaattaataccacaactcactacaagaaatccaagcatcaagatatgactaagagataaaacctgtccactcattgctctttgtaaaatcaatgccaacaatgagattagaagattccaggccagcatgtgaaagagcagtggtaacctgtgcaaaattatttcattatttgacaaaataaggtgttcttctgtgagtaataaccgtaagaatgaaagttttggggagtgaaacaaccaataagtattttctcatgctggtcttgttgcactatgagaaaagaaaaaaagtaaaataaagcaatctactctaagcttcatccaaatattttctcataccaaccttgttgcattgcactcttggactagtttggacatatcagacgttgataacatgtttactgctactcatattattaaatgaattaagggatgctctgctgattcatgcatgcatgatcaggaagaacaataaaaatgagagacagttgtctcttttcgtagcagcttttcttaagccacttcatttcagctgaacttgtttaactatattctatggcttggatttaaagctcatgccaacttcaaagatctgctgaagtataaaggtctgcttaaaagaaactttacaagtatatataaaggttttactcggagttgtagtaaaaatatagcaattctaagcaagggtctcgcaatttttttttgcaaaatccagcatttctatacatttttttctcctggaacatggtccccaatattggggaaaacccaagtcccacatatcggctagagatagcggcaaaatagtatataagtgggggacaactctcatcctatgagctagcttttggggttaagttaggtccaaacccacattctaagatgatatcaaagtctatcctaaatctattaacgggccacccactgtattatccacgcaccaagcccaaaagtgttgggcgtgaggggatgtattggggaaatcccaagtcccacatatcggctagagataatgccaaaatagtatataagtgggggacaaccctcattttatgagctaacttttggggttgagttaggtccatacccactttctaagacacaaagccccaaacagatccatttgatggttcagctcggcacagattttaacactcttttctgtggggaaacatgtttgttgttagattgaatccttattaagacttaagaacctcaatatttcgattttcaacgtggaccatcatcataggcagaaatttgaaggctgatttcagaaagaacataactgattccctttctttctttcttctcctcccttttgtgttgactgatgaaatatcgatgccgttcaggtaggaagtagatagacatactagttcaaatcaattcattatgtccctaaccccatttcttaccaaacacaaaaagtcaatgatgtaaacagaacaaaccaaaaatgatgaaaaaatactcatatattcatacaaaaaaaacacaattatatctaacctaagcaaatgacaaaaacacaattatacgtaagcaaatcacaacaattacctcatccagtgaatggtaatcatcagctattcttgaatatctcctatctatcctcctttttggctgtgaatagtcgtggaatggagcttgtgcacggtggtgaagaggcgtattataaggattttgttgtgggtatgcatttggtgattgagggcatccatagctatcccgtgaatatgaagaaccagcagatccatatgatgaaacatgccttctttcagacccttttgaactcttacctcccatgatcgactcctttagaatcaacaaaagcaaaaacataacaaccaaagctgtccaagtctctagctgcaattgcaaacaatatgttaaactaaaagcatcgcatatatatgttcacggataatccaatctggaacactgaataagaaaacaaaaccttacaactttgactagcagtaaaatacaaattctgggaaactaaaagtaaatgacgcatacgaaaatttgttcaagaaatttcaaggccaaaaaaaaaaaaaaaaaannnnnnnnnnnnnnnnnnnnnnnnnnnnnnnnnnnnngaactatggagcaatgatgactgaatcaaatgacacctttccacaaatgatgactgtatcaacctttcctcaaatgctacaatgaaacttaaaactcagaacattttttttttccatacctctagaagcattgtttccacacaagaattgcaaatgaattgtgagagaattaacaacagacgctggataataatcaatgtctcacgctaatcgcgtcaagtagaatagcttctccttgtttaactaaatagaaggaagaggacaacgaataagctcctgttggaaggaaactagctagcaaggtcaagtcaacaacaactgattaatcttttcttcctattcaaacaagcctaaagagtttatatatagtctatgattataaaaatatgggaaaagccttaacatcatactccaggacaaattaattaacactttagttgagaagctttgtttacatcggcattcaataagtaaatgaatgttctttttacaagtaagcaattatatatatattgtcaatttggaatggtattagcaattgagacaagaaattgcctttgtatttatttatttatttattcattcattcattcaatagaaagtggaagtcacttgtgtttttcctcgatccttctccgtagagttggtgttaagaaatgtcaatatacattttgctacgttgacgagtcccactgttcaaaaggaccgaaacttccaagaaatacctcgtaaaccaaactaattaaatcaatcccactattaagggctttaatgcaacaacttaacttgagttattaactctattttaatggatctgttattgctacataggatttaagaatatttttattctaatttgaaaaaatttaagattttaatttaattttaacagatcttattttatctctctagatgtgactccacatgcatcataaaaggatgaaatctacttactagtataatctcttataatttcactaaagtctcttttgttaagtaattatgctaataaatgacttaacacataagcatctcattaatttatcacatcattactacatacatttacatttttttataaattatatttttaaatattgtattaattaatttgatgtcatccattattttaaatagataaaaatttcaaaatataatttacgaaaaaaatatacacatcaagggacgtgcacagtaagtcaatgagttataaatattattgtaacattataatttaatattgctaaagtaaaaacaggaactaaaaaaaatctctaaaggactaaaatcctattatacagtgatattcaagagagaaaaaactataatgattatgcgttccgtggcatgaaggagcagtctcaaatctcagcccacgctcgttttggcctcaacgagtctctctctgtctccgtgtcatcccttgcaaacgaaatttccttcctttttgtcccacctaccatcactccaatcccctgccctcacgcctaccattgccatcttcacttccccaatcctaaatcaggcccgtccaatcacatcgccgggccgtgaaacacacttccccacttgctcacctaggatggtaaatcgagtttgatctaacgggtcagtctatttggcccgcaagaaagtatggatcaaggttaaaattttgaactcacatttaataaacgggtcagaccaaatgtgggccaggaccggaccagcctaccaggtcgatcagcagtccaccaataaaaaaatataaaatataataggtcattaaatgaatggtttagaataagagtgactaagaagaagtgagtgattttgaatctgtaaccctaatacatttttatttgaaacctaatgatgagttatactacgtgtataaatatgcttagattgcctatatcatgttgaaacaaatttctaagaatatgttaagacttaggagctagttgaaaatcattgttagacatgtattctctgtttgcttttacttctattagatatgtattttatattaaaaatcattgttatatgattaagttagtacattattaatttttagtataaataattatttgaattttttataatttttttaatgttttttttaaatatattttttattttttaaatgaactgactcactgatcgactaactcactttaaagtgaaacggactaataatttcaacctactttataaaaatggatcagcccaacctatttttggatagactgatccattttttcatccttatccccaccacccatattcctttctcttctattttatttttatttatttccttgacttacacattcgtcaatttaaaactgagataaacaatcatttttattttaacaccacaccacagcagcactatttttcaattgaaattgaaattcaaaaaatagacaaattcttaattatcaatccgaaattcttcagaggctgactgactggtaggtccggtgtggcggtgtttcttcatcaatcatcggcaacctaagacaaaatcacatttcattagagttcccactttatactcccatgttgttggttcgctccaatttctagggtttatcacatattcgtatatatgctattacattaaatggacggcaccggcgacctagacgccgatgcggtgctcagcgacgtcgaggacgacggcggcgatccgattccgatcgccacgaagcctccctcgccggaagacgtctccgtcgagaaattccgggaggttctcgcggagctcgatcgggagcggcaagcgcgcgttgccgcggagaatacgaagtcagaactacaggtttcgttcaaccgattgaaggcgctggcacacgaggccataaagaagcgcgacgagttcggtcgccagcgagacgacgccgttcgggagaaggaggcgacggcgacgcaattagaagaaaccgcgaaggaacgcgacgcgctgcgatcggagattgggaattcgagccacatgatggtcaccggcatggagaagatctccgcgaaggtgagcagcttcgccggcaaagcgctgccgcggtcgcagaaatacaccggcatggcggctgtggcgtacggcgtaatcaagcgtgcgaacgagatcgtggaggagcttttgaagcagaacgaggcgaccacgaaggctaggaacgaggcgagggagcagatggaacagcggaattacgagattgccattgaggtttctcagcttgaggccacgatcggtggcttgagggatgaggttgcaaagaaggtttcgattgttgaggatttggagagggatttagctgttagggatcagaggctgaatgaggtttcggagaatttgagcaaggagcaaagtgagactttgcggttgaaggagtttgttggtgagtgtgaggagaagttgagtaagttggaatctcggatggaatcacaaaggcctttgttgattgatcagttgagttttgtttcaaaaattcataaccagatttgcaatgttgttaggataattgaccacggtagcaccgaagagctgtctgaatcgttgtttgtcccacaagaaacggatgttgaggagaatattcgtgcctctttgtctgggatggagtccatatatgagttgaccaagattgctgttcagaaagctaaggatgtgcttgaggagaaggatcgtgagattaagagtttacatgagacggtggctcggttagttagggagaaggatcaaattggttcttttcttaggagtgctttgtctaagaggattgcagttgatccgtcttctagaaagagtgagctgtttcaagctgcagagaatgggttgagagaggctgggatagatttcaaattcagtaagcttcttggagatgggaaagttgcagcttcaaatgacaagtctgatacaacggaaaaagaagaggatgaaatatactccctggttaagcattcgtttctctttctagtttttaatgaaacttgttcccatcgtactttgcattttgaagacccatcaatgaattctttgtgcatgcatgcaggctggtgctttggaggatgttgtaaaggcatctcagcttgagatcattgagctgaagcatactgtgggtgaattaaggtacttaacatcagaattaaatgcatagttgcttgcatatttgcaatttgcagttgtgttgacatcataactttttttctttgcatattgcttaactgcattaagggcagagttgagcttacttaagcagcatatagaagctcaggccaaggagcttgaccatagaatgcatcgggtagaggaacttgaagagaaggagagagtggcaaatgaaaatgtaagcttaaatttgtttgagtttaatttgatctagttccttaaccataaacagttttatctttaatatttgtatattgtagaacgtagaattttgttgtgtatcctaggctgtggataatttgtaaggcacatttgattgtttgtacttctctgtcacaaagtaacaacttggcctatttgtaatgtagattgagggactaatgatggacattgctgctgctgaagaagaaattaacagatggaaagtggcagcagagcaagaagctgctgcaggcagaggcgtcgaacaagaatttgtggcacaggtatgctattcattaccaacatttgttgacacgtttgctatatttggaggatgtgaccaaaaagaaattttcagttgtgcccaagtattcttagagtttaatgtttttaaattttgatttattattttttttcagtccaactttgattgtgcaatgttttggtgtgaaaaatcaattcttgcacttttcaatgaaaaacacatgtcccaatgtaaatttatgacagattaattggacacacatcctaattatgttcattgattcaaattaattttatcaagatcaattccactcaacattaaaacaaatgggctctaaatacattagctagtagctggttgctagtggtcatgaaccaactatctcaaaagctttagatattgggtggaagcctatgaatgattttatatatctaatgtgtcccctcatgaaagaaccctttgggcctatagtgtggatagtgtgcaggctcaccgataggaatctcagggagaagaactgaatgatcacatgaatagcagtagttgttagtttgttgtgactgagtctagttagtcatttggatggttagaatggctgcaaatgctacccgctgagttgttacgttcgtgtgtataaatatgcataagacaagcttatgcatgcttttcataatgaccaataagaatagttcatgaggccgtggctggagtgaaagtcctcttcctctagattctcctattcctccattcattgtcccttttcagcatgtaatgctctgatacccaagagctatcacttgtcctaccttgagctgaaatttatttagaagaatggggactacaacaatcgaactctagaccctgtttccgtaaacactttagtacaccatgtcatgagctaattatcccaagaatttaagtgatcagtttggtttgggaaaatgttttctgctttttacttttaattataagaatgttaccttattttcactttgttttctgatttctcaaaccaaacagcttctacgtttttagttgaaagctggttttattttatatctactactaatgacatcctttttccatgaattccgttactgcaatcccttggctctctaacattatcatctcactcttaaaaaaaaattgctgtaactaagcaagttgatatcatagaaagccacctgttggtggatttttttttcaatgctattgtattttttcatcgaattttcctagtgataattgctgtctgcaaatctgcagttgtcagcacttaagcaggaatttgaagaggcaaagcaatccatgttagaatcagagaagaaactaaatttcaaagaagaaacagctgctgctgccatggcagccagagatgcagcagaaaagtctcttaagttagcagacttgaggtcatctagactaagagacagagtagaggagcttactcatcagctcgaagagtttgaaaacagggaagattcaaggagcagtaatcgacctagatatgtgtgttggccatggcagtggctcggcatggactttgttggatttcagcagcgtcccgatacacaacaggaggcttctaacgaaatggaactttccgaacctctattataattgggccttattcttttctctctttttttgtgtatttatgttgatttcttcaaattaatgttacaaagttgtagtttataccatcaacatgttccaccatctcttggaatgccgtcatggtggtcactggttgagcattaggctactgtaaagtgagaaagtctctgaagtctgaagtatacaagtgagggtgtgttcacgcttgaattaaaataagttaagttcatcaaacactttaattttaattaacataaaatgcatcttcacttattcactttagaggttttctcaattcagatgagccgtttccctgcattatgatgttgcgcctgcttccggcttgagtagctagctattgtactttggttgttttgaacgaacatttcatgaaagcaataaacaaatacactgtcattacattacagtaagcgtaaccctggtttctgtatctgctcaatatagtgcatttttatgggtcggtgccctatttgtcaatcgagttacagcattgtcggcttctgtatggacgtttcttccattgaacaaattggtttttgggggatctatgtattcgtcaatgtctccctagcaagtctatattggaacaggtggaacaagtgggctggacaaccactcaacatgtcaaatctctagaaactatagcggtttcaacgtcgttggacgacattcaatcgtccctctttttgttttattatcaaatatattcaatacaattttactaataaaattaattatgattcttttttacctttattttgcttctgtaccgattagatcctgacattttattttgcataggaaggtgtagaacaaatatcctaaaagagactgcatattaagggggtgttcctcaaccgggttagatcttcacttagtcttgaactttcacgacattagatttgaagaagtatggaaatatacgggtttaactaaaattggacctaagtaggacaaaactaaattagtggtgtgactaagaaaaatcatgtcttgtaatctagtcgacatatgtttgtttaatggcaagatatgttgtttttattttgctttttaggtgtagacattgttgaaacaattttttttttatgagcaaatgttaacaattaatatgtcatgttaattggaacaatctttttaaactggtagtaatgttctaaacatatttgatgagccatctcaagtcctagcgcaacaccaaagatgttgttgctcatgtatgcatagattaacatgtttggaaacatgttgagaataaaagaatcgcatttgagacgtgaaagttataattattaatttttaaaaatcatatcctaaatgtgaaattaaaaacgctaaagcatgcagtgaaattacaacagtggcggagtcatgatggtggagcattaattaaacttggagcatatgttataatttttcgctgtgcaatttggtacgataaaatgtaacgtataagcatttcactttttaggacaaatcttggaccagctggtctgtgccttgtgggatataagataaaaaagcgcgatatttattggccattgaacatcgatcatacttggcgtgaaaacttaaaaagccacacacccttaagaaacttctactacttaatatagtatgaactaatgttaaagaagctgttactaatttataataaataatctctaataattctcgagaagaaaaaaaataagatacaaatttgtggtttaacaaaactacatgtggtggggagggaaaaaagaggctagccttcaaagatgttatttttcaggaggaataggcaaattaagaaagaccaaaaccccccaattttcaaggactaaaaaaagaataccaatgacatatagaatcatcatctgtggtgctaaattattgcttcagcgctttgttctgcatttctttttgagcaaaataccatcaggagggcgtgttagcatgacactgcaacggccataaagattatatgaataccttaagatgcttcccaatttggaccttgccctgaaaactcccctcacttcaaggataacgccattgccttccatttgtttcacaagcctctggctctctcttaatggcagctgaacttgactagagaccatgtggatatatgcaaaccttgattgaagccttgcagcatagaaaggctcaacatattgagtggcaataagggtacttccatagtagagataaattatcactgagctgaagtccacatgcaccttcttgtttggatttgtgaagttagccagcatggttagatcagcattgagtagatatccaaggtcaaggtatgcagcatttaaggtcacactagacacatcaaaatgaggactttgggggcgaaatacgaagtacactataaggactattaagcctcctatgattatgatgagccaaaatatcacacacaagcaagcacctaaccatgtcaagggttgagacttttgctccttgggcaactttataccactgaggcggggatcgtggcgtggctggtgccaatgctcggggcgacggttcagcggtggctggacatcagccgagggaggtggttcttgaaaatttacctttgacttaactggcaagaaaccttgattctgtctacgtggacttctttgcttgccacggcgaggctcttggagaataggtggtggtgggtgtggatgatcttctaccccaggttgcaatggaacatggtcttcatgctgaggtcgtgttcgtaatggaacacgatcttcatgctcaggtggcaatgcaactggtataggtggagctacttgtgtggatggttggtctcggcgttttcggcgtggcacaagtggataaggttctgtatcacgattatctatatattcaggttgtgatgatctagaaaaatgagggttggtttctcgacgagacatggtgtggttgtgcaaaaatgtatgaggaaaatgaagagaaacagaaaggcagtgatacgagaatattattaagctaatggaaacgagcacaaatcaagcctaaaacaaaaattaaagcacattaagggaatgagaatgacttcatgggaacttcaaggatgattcatataaaggcaaagaatcaaacataagccacttatgtggggcaaaatgtttcaattctttattttagatatttaacacccgatttgagtttttcaaacagaaagtgatatcatgtatcacttatggatgctatgattagctcaagccttggagtggatgtgtgaaatttagacttgagttgccgagcttattattgtcctatgatatagagaatttgaatccacattagagaacaagaccttgtgtgaatttacaggcggcatggattcttggactatgaaaattgtaaaggttagggaaaagacctgatcatgcaaggggaaaacatacattctaactaaagtctaaagcgctttcagtttcttgtaccacaatttacattcacacaaacaagactgcggaagatacctttcccctactttggtccaaaatacgtggaccacaaacacagactgcgaattctagcacactttaaaaagttaagaacagccgattgaagagaggaactcgttatgacttaggagtcaacattcgatcaatttaaaaagaaatcaatattttcagcttaaataaataaagcaatgtgttaaatataagagcagccttaacatactcatttcataaaaaagagacaagtatatgaaaccatttcaaaattggcaaaaattaaaggtatatatgcccataatataacactcatttatcggtggcagcttaaattacattgatgaacttcaggcggttgagcatttttttaacttttccagcaactgaaggaagctataattttcaacagatcagtcaaacagcagccccacggcactctctctcaaaaaaaaaaaaaagaaccaaagttcaaagggaaaataatgcaatagctacaaaacaactacacaaaagtttctgattcatgtggctaacatcaattccccaggctcatgtcacggtagtaaatgcctcaattcaatagttggaagaaattttctcttcaattttggaatggagatggatgttattcttagaattctaagtcaaatagaaaaattaaagccagggtcttttgttgccttcaaattttctatattttccaagatctggtcagatgtattgttaacagtccccagatgcagacaggccacggtttagcaattgcttttctccattttgtttcttttcaacacttccatttactccacctcaccccaaaacagatgtaagtaatgtgatcagccaaacccataaactactaagatttcatgatcaaatgtcaataattagcattctaactcctccattcttacatcggataacctagttcaaaagagaaaaaggctacccaagacagtaaaaaacttatgcaagtagaagttttcaattgaacaggatattaataatttaataggttgttagtgtttacgccactagcacagaatgtaaatattaatcacaagttcaacttgtggaataagcctcttgcaaatgcaagataaggctgccaatggttattcctggtctaatgatgttcaaaaccggagggaaaaatccatttcttcttctaaaatcctatattcaggcaagttgaaatccagtttcattttgatgacctgggattatattagaagtggattctcaataaaactaggttaagagtttctaaaattggtgtaatatgtgtgaataaagaacttgagataccacatgttagagaaagatttgttattgaaatgaaaatctttgagaaacacaattgaagagagtgagtgagtgaatgaagaaaggatttgtcaacccagtttcaatactgtactttccaaactaattctaaaatgtagcagttttgaaactagtttcctaatacacgtctcatttgctgacatttagccaccaccatggcattttcttaactatttccatttttaatttcatactccggaagttgcttggatggtggaccctagatgattcatttctatttgtaaatcatcaagaatccaggcgtatgtccttcatctgtacattctctttgccctcctttgttctttctatttcttctccaattttccatcaaaccaatctgcaaattgctagttgtgctggttgtagttgtccttcagctagtcctgttccaaggtgcaacattatcttgggtagaatctattggcaaggaaataccagcatacaatgaaccagggtacattaatatcattatataaaaaaaaagactaaggaacttattttatttcatagacatggggattgataccatgcaaaacaatacatataatcaaagttgcgtgaaaccatgttctgactccttaggttcagcacaactgcagagaatacacatcactgtggcactatcaaactaaatgtaacaactacggaaagtgttgttttaatataagattctcctgcataaatgcactataaactatcccaccaacaaaagtgaaaatttattaagtaacataagataaggcagtttccagtcagtctccattgattcagcagccttcagaaacactatgcaacatttaaatgattcatgcatccattttttttcttacattatattgtttgttttctttcatataggggttagcaaaagtggacaaaatcatattatatgtcatagttctctaataaaagaacgcgctgaaatttaaggagtagaaacatacttcggataaatcaatgtgtaatgatcatggtgacatttctttggaaaagcttgaggttccaagctgcagatacaggcagaagcatcataatttaccagaaaataatgttaataaaggtcaggcaagttgaattttgtaacagtataatcctacaaatatgtattcttgcatgctaatccaaatctcagaaggaaaacataacttgtgccagcatcacagtttttcagaaactaataaatctgaatcttgaaacctaacaaggctacctagtgaatctttttttcacatccacaactctccactgagttacatgtctagatatagacacaaatagtaaaccgatgatctgttaataaaggttccagagtttattgttcaacaatttgctaggatatagcaaggcactaggcataagccacaccaaggtgagatcaccaatgaaaccatatcttcatagttcaaactatgctctgcaaccacaaacttcatcttgatgaaacaagacaacattctaccaacatcaaggagttgttaacccaagaagggtgctatactattattgatagttagaaccataaaatattcattgattttctgctatgcaaggcaggacatgaatccatctgaattgagctgccactggtcaaagatttactcaaatagtatgaagacagcataagactaactcaaagccaccctcaatatgaactcttaagaaacaacaattgggatttgaataggcagctggagtgattccaaccaaatcatcaattactgaaattagttgtgctgggtgagaaacaaatccatagctctcaatgtataacaatcgccaaaagtaaatgaatgttctattgtattgacatatacaatctgccaagtgcatagtctgttcactctgttgacattatgaaacaaaacttggataccgttacttcattggtagcaagaaaccattagagcacagtcctctgtatggatcctttacaagaagctggcctgtgaattagtatgttatacagcacataagtatataggagcatagagacacataaaggtatgggatggcaccacgagcgtcataaaaataggataaaccaatttacaggcgccattacctgcagataacgtttcaggtcaggtcaggtttgctaagccttggtgtattgtatccagaaaaaactttttaagtcaggtttcccatttgaaagaaaggtgtgatgaatttgagtggatcaaaacacaaactagtgtcatgttgtgccatcacttgattgaatggcattgactagagtctcagagagatgtctgtcaagtgtaaagcctctctccatcatctgatcccagaccctacaggccagtgaaatcttttttccccttataagccctccaactatcaacttgtaagttacctcatcagggtacaaacctttgctctgcagttcatcaaataggcgcatggcatccataactctagaagccttacaaaacccatttacaagtgcattgtaagagatgacatccggatttaccccattctcaaccatgtcatgaaaaacactatgagccacatcaaccttcccattcttgcacagatgatcaactactgccgtatagaatatgcgatcgggaagaacatgcatccttgtcatttcatcaagcagcttcttaaccacatgggtacttccttccctaagaaacgcatctataagtacattaaacgtcaccatgtctggcctaatccccttcccatacatctcctcgaacaactcataacccctcctagtccggcgagccttacagaaccccgtgatcacagtattatacgaaacaacatcacacatccctttggtctgcatcctctccaccatcatcaaataagccctatccaccatatttgccttgcaaaaacccttcaacagctcattatagctatacaaatccggctccaccccactactctccatggtctccaccaacctcacggcctcatccaccatcccctcatcacaacagtaattcaacagtatgttataagtaaccaaatccggcacacacccattccggctcataaacgccttgatcttcatggccttgtcaaccctccccatcctacaaaacccatcaatcaaagcattgtaaactaagctattaaccttcaccccacccttgatcacaccaacagcgagctcataagccaaatcaacgcgcgccccaccgcacaacccgacaacaagagcaacacaggctttataatcagggctcaaccctctgtcaattaaacgacgccaaaccctagcagcctcgtcaaagcgtttagctttgcatagcgcgtcgataataatcgtgtaggaaacgacgtcggggtctcttcccttggaggacatggagtggaagagttcgagggcggtttctaagcgattttggcggcataagaggttgaggtaagtgttgaaggcccaaatgtcggggacgaagccgagagcgtccatgtcgaggaggaggctgtggatgagggggaggttaatgttgtcgggggcggagcagagggcggagatgaaacgggagtaggtgaagggcaggagggagaagccgcgggggatgacgtggcggcggtagtagtggtgggcgaggtggaggcgggagtggcggaggaggacgccaatgaagcggttgtagtcgacgctgaagacgcggcaatttgattcggtcatttggtcgaacaggtggatggcttggttgatgagaccggctttgaccaggttcgatatctgagagcggtatgcgaggcggtgtgcgccaatgctgctctgatacatatcaatcaaaatccaaaggcatagcaccagcaatcgcccaaatccttattcattcaccttcacctccaatgctgcctttaataatattatgcaatgcattccttcattcattgcacgttgagagttatgaacgcagtaactaaagttataaagaggcacaccacacctactgcatggtgcgtgcgcgcgtgagtggtgacaatggtggttgtttgttttccctattctcttctcgctccgactgcaaccggagggaaccggaggggatgggagggaagagaattttttattttctttttagttttgtcttcattttaatgctattttgtctctaggatttttttcaattttgtttatctctcttaggaggactcgttttgctaaatgttgtattttgtattaattatttttaaaaaaaataaccttaattacttaaatgatatgaattaaaaagataaatatattttctttttttaaaatgggagaaaaagactaatacatattaatcaattgggtaaaaaataattaaatataaagaaagagaaaattcaacaattttaagaataattttaaaacatactatataaattactaataaatttaatattattaactaaattaatttatttttaaaaaataatcttatattgagatattagtatttaagtagttaactactaagaatgtttttaggcaatatccctcaaccctcataagatgaatgattgtttccagagtgccaaaacacattgggcacacctcagtatctcccatatatgccttcgagatctctggacatacattagttaaaaagcaagttccttgacactatccaaatatgcattttgatcctttctggcacctgtagtcaccagatcgtttcaaaaaatattggttagcatcattgtttaattttaagttcttataacaagcttttatataataaaaacttgttggaaataaatcttaattaaattattttcccgaatgaaccctaaatggctaaaaatcataacgaaaactagtcgtaatacaaaaccgaaacaagctttcgttgtatattcaagacgtaatacacagtggaaatcaatttttggttgcagttaatttgtttttttatgcgtgcaatgttctttatttaattatgggttaaatatgatattggtcctccaaaaataatagattgtaacaattgaaagatataaacaagaaagcaatgttcctccaattgttgaaaatttgagaaatatcctaacattgtaaagaaaaaaaattcaaaattgaatgagtgatatgtaagaatggtaaagaaaattaaaagtgggataaaaaccactttcatggcatatagaaggaaaacatgtaccataatgtcaattgaaatttaagaaagtataaatgtgatgtgttgcaatgtgcacgataaaagaacaagggcataagaaaagaacgacaatggataccaaaaaaaactatacgaacatgttgtaatgcttacaattaataaacatgttacttcatgatttattgcattttttgtagcaaaacgtgttttttgtcgcgacaagatgattcctggaggagacgaagaaccacaacactctaaaattaatggagtgcagggtgaactcaccaacttggagatgaactcatgattttgagcaattctacgtgagtttatttgagttcataaaaaacgtttccacaatcaatttaactccatttgcatatgtcaatttggatgaaatttacgagttaatactcgactttgacaacaatggatgaaccaatggtgatgttgggtcattttcaaaacttgttggtgtttttaggctagaaggtggtatgtatgccctagaagaaaaaaccgttgctctttttgaagaacttttcgttatttcaaatgtccttttcaattcatcttttaataattgtcaagcatgcttaaatttaaatttcttacggtcatttaaagaataaataacatataacagtgacattatcctctaatcttatgtttttctttctgcctacaacaataaacagttgtaatttgagaacaacaatatagcaagaattaaaattaacttatagagaaccaataaaatgtaacttcagaagaataactacaccaaataatattggcttgaaaagaattgtgagttgaatgtaatttgaagcacaaattatacactcaccagaactcacaaattcaatcgcaactgtaattttgttacaaaaaatattcatattatttttagctaggagtttcaacagtaacttttcctaaattatgttaaattgtgcacaatgataattttgctaaaacgtttatttcatgtttagcttctttacgttttcccatcaaattttcacattcatgttcatttcataacatcaaagtagtttattgtgggagagccaattaagtttcatacgatggaaaaaaaaaattgtagtcatggaaagtttgtatttcttgggataagtgttggactacaataggcctgtacgcaccagattttttttttttttttaaaaaagacatcccttttagttgcaggtccgatctatctcctattccctgtcgacatcgttgcgctacttctcatcggctttgtcacactcttcatttccggcatcgtcgtagtttggttctacaatggcttctatatcctcgacaacaacttgcaaagtctggattaacctccattgtcctcctccaaccattatacatgtgtgggtttttttttccccagatctagttgttgttgatgtatgttttctcatatatgttcatgtgagtgtttgatttgtagatcaattatgggttgaactgttaaggaagcaactctgacagagagagattggtggtgcgaattcggatagccactatcaaagcgtcagtttcacgacggtataaatggcagcgaagtatgtctatgatgacaaaagtctttgtcagtgagatgtgtgcagtggcatcactagcagtggtggttgcttgaggggaggaaaaggaaaggaacgacgggagagaggttgttaagggaagaactttgtcaccgtcattgcaaaagtcattgtcagtggtggttgggtgagtcatcgggagcaggaaaaggttgtccaatcttaaggccttgtcatcagcgacaaagggagaagagtgaatgtggcgacgacgatggaggaggaatgcaacgatggcaatgaggagaagaaacagagacaataagaggaagactagaagatgggatgttttttctttaaaataaagaaaaagataatctagtataggcaaatctatggtggaactacacttatctcagataaaaatcctatcctacggaccacttatgtctcccgtcgtgggagacttaaaaaggtttaagtcccatatgttagcttgcttctcataatgttcccttattctttttccatattcactttaagctctttttcaaaatgttatctcttactttctttttcactcaaaatggtttttcactcaaaatggtattaggcaaaattgcttctctccattatgcttttacttcaatacatttgtttttttaaaaaggcttttgagtttaaccatttctcttggtcacatctatgatcaagataggttcaacttgttttcaattcagtatctttatccattttttaagaaattcgaatttctaatgtaaattaggtttaataatattggtgtgttcaagtctcttaaacatctctttacaagtttaagtttctctagcattgatcaccatcaagtatcatgttgtaaaaagtgagtttaattttttatttttgttgttgtgattttacaagtgtagatcaagtttgatttgtcatcaatgtatttgagtctccaacattagagttttttttagaataaatcatcaccaagttcatcattgcaatgaaagtgagtttaattttgtgatttttttttttgtgactttaccatgaatgaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcaagaatattaaaaccgtttaaaaacacaggtaatgatcaaatatatataaataaaaatatggagcgatataattatatttatgttctgatcacttttataatttgatataaaaatatttttattcattaaattattgaattgtatttatatattattaagatcatgtatcaaattctattaaaattgaataataataaaaataattaaataattaatattttaatatattttaaaatttatattactatttgtcgttaatctatataaatgaggtattcaattattttagattcatgtgacattttgcaaacataatatgtatataaaaattaatctaattaaatggtaaattttaaaaatatattatttaattataaaataatataataattataaaaaattatgctgttataatttgattcatctacgataaaaatataacgaaaattaaattgggtagaatttccttcactagttttttaatgcacattacaattgcaccttatataaatattattaaaactgatgatataattaataggggaggaagaaagtcaattaaaaataaattaaaatatgtgacaataaatgcagttttaaagaggcacagtatttattattatatttaagaaaaaagttccaaaactgaggtggcactttgacgcattatgtctaggtcaaactgaatgaccatgaccactcagccccgcttttatttccatttctcggcaaactccaaactcttcttcacttccctctgcctcttctgttttacacacataccccaccgctttctctcttctctcttcaagatccaaactttaagtgcctttgtgtgaattctcctctctttataacaagaacgagtcagaagtgggtcaccgtcaatggttttaggtgagaaaaaactcgaacctagccgcaacacaacacctaccaataccataccgtaaccattttttttttaccgttccaagcttttgctttcaacccattattacttctgttaatgggtttgaaacccaattaaaaagttcgaatcttgtcgattatccatgttaggagaagagagtaacaacaacgaccgcggcggcggtcaccgtagaacaacacattccctatcaatttcctggaccgaccggtctccggttacccggaaaccgccgcgtccgcttaagcctctcgccatcaacaaacgcagctttttggagtggccgagcgccggctgcgacgatctcggcgattggtctcttccaccgaccccaagaggttccaccataacgccagattcgggttcgggtaaagtatttcaattcaagaaagactaccatgcgttctacgacaaggaatgttcgagaatcgcggagcacgtgtacctggggagtgacacggtggcgaagagccacgagcttctgcggcggcacgggatcacgcacgtgctgaattgcgtcgggttcgtgtgccccgagtatttcaaaaccgacttcgtctacaaaacgctctggctgagggactcaccctcggaggatatcaccagcattctctacgacgtattcgattactttgaggatgtccgccaacagggcgggcgcatgttcgtccactgctgccagggcgtctcgcggtcgacttctctggtaatcgcgtatctcatgtggagggaaggccagagcttcgaggacgcgttccactacgtcaagaacgcgcgtggcgtcacgaaccccaacatgggcttcgcgtgccagctgttgcagtgtcagaagcgggtgcacgctatgccttctagtcccagttctgttctcaggatgtataggatggctcctcattctccttacgaccctcttcatcttgtccctaagttggttgatcatccttccccacgcgcgcttgattcgcgtggcgcgtttgttgtgcacgtgccctctgctatatacgtgtggattgggaaggattgtggctccgcaatgtgttgcaatgctagatcagcggcttctcaggttgttcggtatgagagagcaacgggggagattgttagtgtggttgaggatgaagagccgaaggagttttggattgctctttctaccaaggaagtggtggtggagaatggagaggtggagagaatggagattgatgtggggattcgtcccaggagagttgaggagtatgatttggattatgggatttttcataaggcgcttgctggtggggttgttccacctttttctttgtctaatgctggatcagaaaattgccttcccgctagagaaaatgggtgggggagattgacaaggaagcttgctagtggtatcatgaaaggcttgttcacatcctctaagtgctgtgaatctagtgtgaacatcattgaagaggggaatcaacataagaatgttgatccttttccaccttcttcgaacaatgtgggtggctcgcggggttcctttgagtgttttgtagataatggctcggagagggtaaaggataatgttcaagtcagggatcagtttgttgtccctagtgttgttggttcatcaatgccgccaccatcgcctcatcatcgagcatcggattcttttgcttgttttctgaggagcagccccaaattcagttccaagtcgccaacactgtctcccaccagttcggattatgcaagttcctttacattttctccttcatcgactgaacccgttcatgtgaaagacgcatcttcctcagagagtcgctccttagttaagaaagaaggtgaggcatttctggctaatcacaccttggtaggagcaaagtccagtttgccgcgcaaaggaacttccctctccattgcagagcgcagagggaataacccgccacctcgcatgttgctaccctcggccaccgaatcatcccgtgccagcaaggtccgggtaagatccaggtcattctcattgcctgccttggatgatactctgatggaggatgttagttgcaagcaaatctaactatgaaaacagtgggaaaacggctaatatgagatgttgatattattagtatagctgttgagagtaacgttaatggcagaggatcattgtaatatggtactgtgtcattttaaggtaggttgttatgcttgaagtagaagacttctaagagaaagttaactttattacagtggttcagtttcttcctgtatagataatatagccatagttggctcaagtgatctatttttggacgtgaactttcactcctgtttgaatattggtgcatgcctgcaaggtgtagtgtaggctgagcaataaaaaccacacaaaacatgcaggcaatgcactgatagcatctcaagtacataacaattatcaaatttaagtgaatataaagtctatttttctctttggctgttcttgttcttgtttgttccagctactagtcagtatgaatgatataatattaaatgctacattttttaataaaaaaaattcatttataatttcaaaatcattatcctttgaaaagggcaatggttagcaaaattgatataaaattagtgcaaaagatcacctttgtagggaatcatgtagcagattaccttgttttagatgtaatcatcttcctttattagttactgtttccactaaaaaattaaaaccaagtttcagaaacaacatttcatttacttgatggtgccaactgccaaatggtttattctaatttcgtggtttatatgaatggcatcaattactactgtacgtccaaactccaataggattctctaacttgcaggatataatcttaacagtaaatgtatgtgaaccagtcatctcagtcaaagtgaagcatttaatctatgaacacgattattctttacttatttaggatacactgggagactttgtatagcagtggattcgatttcctacttaattttatcgggcatgcacctatagatattccaaagatgtattataatactccaaatttctttccaaatatatactgatatcagaatctgataatgagatgaagcatgcacggtaaagggtcatgtggataatttgtcctaacgttgaaacatatgtaatctgtgcaaaaggaacaaacagagcagatatagcctttgaaagtggcatcatgggaccatttccttcaaagagaatcacacgacgcgacgtatttgtatttctagtgtgaacctttgttagagacatgcgaccttttacttaagatgtagtggaatgcaacttccttcagcagtttgatttcccaccagttgtttatcaatgccaccgttggttgcttctgttgcatcaatcatcaaaagtgaaaacgactattttgctgaatcttagtttccaaccatgtgcacatttggccgtttccaagtactttgttttttttttgctttttgtataaatttggcccctttaatttaaactctgtgcttttttaatccctagaaatatgtagttagttagagaagagtggcctttttacagctgcttccactgcaagtcaggttttccctaccgtgcttattcgtttagtttgaagatgccaagctaaaaaaatcagtgcaaatattaataattaccaaccaaatgtagagcattttacactcgactgtgaggttcgtagccgttattatatgggaatgctgccaacctaccgttgagtctttattttggtcaataggaatcataacagtatcacaacacactcatataccctgttaaaccagttagactccgttgatacctacggttgaatcttattttagttactgtatcactagtttttaaataattaagttataatttgtattcttaaatattttgcaggtgccaaaggttcttccatacaaatcaaagaacagtggctgaacgagtcaagattccattcttcatctacttggactacctcttctattttaatactggctataaattgaagatcaggacaggaccgtacaaacaagatgctaattaaggtgaatgttactgtatcacaattggtagggagtgatttgctccatccacctaccttcttttcgtttttagtacaactaaagcacaaaagtttataaacataaaatatttaacaaactccttatgctccatgatacatcactaaacttcccttggcaacttaacctttctactttttcttcagtgggagagaaaggatgacattgcttagatcactccacaactcaaatgccttctttgatcatagtccgggaaatgctttacgtgttaagtagactttgcctgcatacagaccacatcaaccacgtcagattaagattctagcccttataggaagacgtaaatgaaaatcatcttttgcaaaaggaggagaggtggaaataacaacaacaataaatacatagtttccattattaagtaataactcaaatgatatcatgatatccaaatagtgctaaattttagttgggtaaaggaaacaaatacagaatgctttaccaacaaaaattgtagaaatgtagcatcttgcctcaagaaagttggattgaaattatttcaagtgcaaaaaacctcctagatagttttagaaaatcaggtaataaattcaaaaaacattcccaaattccgtttttttattttttataatggtttgggatccatatatgaatgacagcaaagagttttgatgagaaagggaaaccattcataaaatatccataacctggacggtgatcctaactcattttgtgttgacaatgtcaacactcttttcactgaaattttagtcccaaatctttcatataattcaaatctgtattggatggagctgagtattgcgtacatgcaaaagcttctccgagtaaactcttctctttgcaagcatgactgttaggatgacaggaaccattgcagcagacaaatgcttaagtgtgtgaccactgacaatgtgaaaagtcagtatataaatcactctatcggcagcctcttgcagcatagctagaagataaaatcctgtcaagatttaaaattgaaattcagggtaattgaaaatactatctacattacatagaaaaagctattataataccaaaagtacaaacctgaagcccagagccaatatgttgaatgcgtgtacataggaggcaataaagtagccatgagaggtatggcaatgcatgatgcactttgggccagaacatataaacggatgtcaccaaagaaccttcattataaatgaataagtgagaaaagtagcaactattctcaagagcaaaagttcagtaaactggatgctcagttaccgaagggttaagaactagcctaattttgacattatcttaatcaatccaagatgtttccactcacaataaatcctatatctttatgataactgcatttatagaattgacaattttttagaatagttagatgcagtttggtgatgcttttactgttattttcacattaaaattggagtatcaactacagaactcacacaacaaatgttgacgtgatgaaactccaactttgattaaagaacagccctaaaagcatctaaagaactggaactaagttttgtccaactttttatccgtatgaagagcaattttgttcacttatagaaggactgcatgtatgtatcaatgaataaatatccaactaatgcaatagggtaaggggaaaaaaaaactcatgcaaatagaaggaatgaagaagtaggcttgcctccaatacacattgctcattatgcctgccataattagaggtacaattgaaattgttcccttctttgtatcaatcctttcaatgatgaggattgccaacagagacgcgaaagcagcagacatctccaataacaaacaataatcaaggaatcaaaactatgaaatggaagaatatagatttctacagcaacaatggctgaattgaattcaacttctataggagcaactcaccggcaacctgtcccacacaaggcctgcatcatctgggccaagatgatagtatgaagacccaaaagcaactgaagtcacagcaacatagaagcatgtccaaccccatagttcaccttgcaaactgatgctacatatcttaattatataattgacaacaacaatcacgtaagctaaagaaaccgatggtgacaaaatgaaaatacctgatattaaaatagttcctacggtggcaaagcacaaggccaatgagaccaataaccatgaatgggaaatttgatatcacgttaggtgcattgggaatgcctgaagaacaataaaaaagaggaaacaaataataattttaatattctattatcgcaaagatttttacattgtgaacttacaatgatgtcataaaagattttcacgtgaaagatttttgaaactggcaactaatcacaaatacaaacaacattatattatatgaaaagtttgtccgtttttacattaagtatattaatttcatactcatgctaaccataatttctaattagttgatggattaaatttaaatagaaattgaactcttttaaatttaacaatattacattatacgaaagtttattattagaaatccttataagtttgttcactcagtgtaatgtattctatttaaattcggaaaaagaaatccttctgtttgtttttacttttcaaaatttgccaacaaactgaatggaaatggaagaccctcatctgctcagttgacataaactcctctacataaccaagtttacatttttaaggttactttactggaaatgaaaggctaacaagtagtttttcgtaaggaattaccaaagaattcgcgcttgtcagcgaaatcatggtatctctgaggctgaggaatggacggggttaagaggatgagtaaaaggaagaaagaaatggcgagtcccaatgcctgctcagtgcagtttctcatttttgttgcagaatagatggaaatgcgaggaaagagaacgaattatagagtgagacaggtgagtgaaagacatcaagtacgaggaggaaggtgctggcggtggcggtgggcggtgtggaggtggtgaatggcgccatcggcaaaacattaatatattattttgatgtagatgaagtgagtagaactttccccaaaatccttcattttattttgagtaaataacaatgcaacaaaataatttcttgcgtattattttccaattaatattgatattatacgcgtgacaaaaaattatcacttaaattttgatgagaaaatcatactaaaaacactttaaaaaattgtattttattttcataagagtaacttccctccaagtaatttcaatctttttttttataaaaaaatacactttagaaaatttggatttgtttaatgagaacatctcattttaaaagataaaataaagaaaaagaatacttatttttttactaataaaaatgtaaggatgacatattgatataatgaaaattttaaatttagttatcaaatatgaaaaagtgtaataattttatgaaccaaattgataataagttatattttttaaggactaatttagtattaagttataaaatttaggaatttaattatcattaaattgtttgtttgattaatttgtcataaattttacatatttaagaactaaatttattttttctatttttaaatgattcaatgtttcatgtttttaacgacaaaaattgatatttaacttgaaattttggttactaataaaataaatagttgttctatcaaaaataaaataaatagttgttaatattatatgcagaaattattcaattcaacaaaatatgaagataacacgagtaacaaaatattacttcaagttgattaacgtgtggattcaatgacaataaatgcttaaccaattaaccaaacggacttgttattgattccaatctcatttgttattgatccctacaaacgtgagaaaaaactttcttatccctctctctgtcccttcaccttcttttcaccccactcaacccatcaccaccacactaagcctgcgtgccaccaccttactgtgtgacatattggcctcactgtgccaccatctcctcaaacggaacccttttcgtggtattatttgtgggtgaaaataaattacacagtcatccatggcctacatgagggtgaaaaaattacacgataaaaatgcaattctgtcatataagtataattttttattacaaaatcacaattcttttatgtctatgtcaaaaggacattttggaaatattgttaaaagacacacagagtgatagtgtcaatagcaattccctactactaattttgcactttgaatataaaagcggttccttaaaagttaaaaaaatgaataaaattttatattaacaagttatttaattcacaaatattttttttctctctcttatatttaatatagttaaataactatcaacaatagttgcttcttaaagcaattctctttacttttaagcaacttaaaatcatatatatactaattgtttatttttaatttttataagcaactcattaggcagttctcaatgtgatgctttcaggttggagcacattgttcgcagtaccttgggtgaaaatgcagaacggccccctcttaatttcggccattggccctgcgtagataacggcatgcaagaaatgagatttaactgtaagtttgtaactatctttgcggaagtttttcatctttaagtttgcatagaacgcgtaacatttccccgcttgtttatatgaagaaaattgcgcaattttttttcattacgagaagtagattgattaggagagcaaatgaaccatatgtaatgtaaaccgcttcgtgccaaaattaactcggtttaagctatatatagcattggtctgttcctttccccagctactacatgcatttttttatttttttttttatgttaggtgactgattcagttcctatttttctcaatctaccaagaaaaaatccaacgaatacaatgaaacggtggttggatgagactctatcacgtcatatgtcgcagggttggacaaaaaaactcttatccataaaaaaatttatattttaattcaatttaatctattttaaattcattaaatggattagtttcatatccaaattcatttttttactttaaatccaatccaattaattagatatgaaatggatatggattggatatttatttagattttcaaatctatttttttgccaactttgattgagattatttttttttgtcgacgtcaactaatgatgattttaagccgtcatcgttgagggtatattttcgttaatgttggtaaggtttctttagtaaacattgattgagactatttttttgccaacatcagtcgaatctattttttggccgacgtaagctaggttttttttgttaatgttggtcaagaatattttttatcgacatcaagtaggattttcgctcgacgtcgtctatggtttttttgtcgatgttgagcgaaaaacctacttgatgtcgataaaaaaaaactcgacaaacatcgacgaaaaaatctagttaacgtcagccaaaatatttccccaattgtcgccgatcaaaaaaatcctaattgatgtcaacaaaaaaatccctagctaatgtcaactaaaagaaatagtcatggttaatattgaccaacaaatcctagttgttgccaacaaaaatatagttttaaccaacatcagcaaaaaaatatagttaacgtcgacaaaaaaaaagtcctgacgaatgttggcaaaaaaatattaatgattgacatcagcaaaaaaaaaatcttatcaatgttagttacaaaaatcttaaccaatgttggcaaaaaattagtcactatcgatgttgataaaaaatctgtagtcaatgtcagccaaaaaatgcactgactaaaaatctttgccgacctcaaccaaaaagtaaccctacctaagatcgaccaaaaacaccattggtcaatgtcgactgaaaatgtactgactaatgttagccaaaaaatagtcttggttgacgtagatctaaaaatgtctggaccgatatctgttgaatttgctttggttgaggtatgcaaaaaatacacaatattgatcaaaaaaataatcttaactaagatcggttgaaaataactcttaaatggacaggtactaagttttcactttttagcatttaataactaaaatctgtaatataatatttaagtggatataaattgaatatatccaaatgcatatccatttaaatagattgaatcttaaatctaaattgttttcttaaaaaaatatgaatatggatttaaaattcaatccatttaaataaatataaattggatacatattggattctaaaaaattcaatccatgctcacccctaataagtcgtaattaaattttgttaacgtatcattaaaatgatcatgttccaattttaaaactttacctatatacagaatctcatttttttattcgtattagttacccctaatacgtcgtgattaaattttgtgaacatatcattaaaatgatcatgttccaattttaaaacttcacctatatacggaatctcctttttttattcgtattagtagaaaagttttggttaaaaagcaacgatcatgttccaatttttaaaacatcacctatatatagaatctcatgtatttttatatattagacggaaagttttggttaaaattcaaaaaaaataaaaaacacccaacgcacctcactctaccaagataataaattatatgagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaaaacatcacctatatatagaatctcatgtatttttatatattagacggaaagttttcgttaaaattcaaaaaaataaaaaacacccaacgcacctcactctaccaagataataaattatatgagaataatttagatgaaaaatataaaataattttaagaaaggagatttattttttactttttttagtgtgagtacatattagttgttggaaaccatttcggttcgacacacaggatcaagtcttgagaaaaactttatcaaaagtgattttatataaacagtaaattctccttaatgaacactgtatagagtactagtttttattattaattaggtccataggaagaggctaattccatacaaaatgataaatcacgattcaaatattaagagagacgctttttttttcctcaagaaggatactttgcatgcgaaaaactaaaaagaaaaaaatgaaagagaagtttttcttcgacggttagaacacggattaactatgacttcggtatcatatataatcataaaggtaaatgctaacaagtattttaaagatattggttaaaaaaattaaagtaaaagtatttttattgaaagatgaaaaattgtattatttatgtttattttatattttcttatgatttacacaaaaatatttttttggtttaatatttaaatcaatgtcttcatgagtaagacccaaacataaatatagtagtaatttataaaatgtttagcatttaatgagttgagaaattatctagaatagacaaagattaagattaagaggcaaaaccaaaaccaaaggaaaggtgttttactttagctgtatctttgtctgtgcggaggaatctacgcccacgcgctccaccccgcaaatttatagacacatgcccgacagcaaaccacacatgatatcatgttctcacatcgcatgtgtgaaactgacccctcttcaactcgtcaatttttattaccattttcttttctctcttcttttttttctctccctttaccatataacaaaatttccatttcaaactacaaattttcgtgcacttttttaatcaccgaaaccgttcttcgttgatcgtcacgaacatgcatacaaatccgaattttggaatgaattgcaaaatttttggaggtggcagatacgtttactcctctgcaatcgggatcatgcgcgtagtaacgtaaacaagtgtcaagggctaaacaaggtcgcgacaaaaccaaaatgcgcatcccttcgaagaaagccacgactgtgttcaagtaaaagtctgaaacagataaacgtcaccgttattacgttgctttcaatgtcatgtgataattatgcatcatgcacacatatatatggttcacaacgcatcaacgcattatcattactttattctattatatttgttatttcgaatttaatttattataacttataaataatgatgtactacgaagttggagattttatcagtatttaactgagtgggaactgttgtttggtggaacagacgtgcccacaatgatgaagggtttctcagtgtccttatcctccttatgggttctccttgctctctgttctctgaggtatgcaaccatggaatcttttgcttctcttgctattgttttgttggttctgagtttcgcttgtgtagtccttaatgctacattttggatattttttaagatatgcttgattgctaatttctggttaataaattggaggctagaatccagagcctataaataaagtgttctgcttttttgttcattcacattgccattgcttgctgcttgagcttgtcaaatggactgattcacactggtttcattactctggtggatctgtgaagtgtgaacagaagtctgccttgtgagtgaacagaaatactagtgatttaccgagtattcaaaatttccactgccttttggaattattaaattgaatatgtagttgaagtgctgctgctgttgttgattagtctaatgatactcggataattcaactctgattttgcatttttagtcattgtaaattcttactcttaaagaaaatatctacttacatatttggtctcgaacagaaaatatttttattaataataataaagcactgttgtcattatttcctgaatttatatgaatacgaaaaggtatagagctcactcacatttggggtggatttggtattgctgggtgattttcagaagctggttttatgcattgctttaaatatagtatttggtagctaaatgtcaaaagctgtttgcaaaacttgcattgaatatcgtctatggtaatcatatacctatatggcaacctttaaaatcagtaacataataatgcaacttttgacttagatccacgatgtcaaatccaggaagcccaagtctggttaatttcaattagttaatttggagaagtagacttgaaactcagcataggttttaacattaatgtttactatttcgaatgtgattttgaattaatatagaatataaactagcttccactagagcagtgtgtgtggaatgacttttaaaccttacaagcaagcttcaattatgtccaaattaattgcagaaaatataagttgaaagtatattaaattgaaatcttatgttgttcaatcatatcctaagtgcaactagtattccttaatcttattcgtcacatattagacaataaaagtaaagaaagatataacataatatatatctgagtgtgtcatttcagtgtgttatctcaaaatatatctgagagtggcctacagcaagctagcctcccaccaagaggttggaattcctatgattccttttgctggacaatttctgaagaagaattcttacaaagtgctgaaatagtttctcaacgtctcaaggctcatggatatcaggtatagatactgcaaagaacaataacttatggatgatttaactgtgttagcagtgctttggttagatattgactgatttctttccatcaactcgtagtttgtcgtggtggattacctctggtataggaagaaagtcaagggtgcttatcctgattctcttggatttgacgtgattgatgaatggggaaggatgctccctgacccaggaaggtggccttcttccataggcgggaagggattcagtgaagtagctaatagagtacatagtttaggtttgaagtttgggattcatgttatgagagggataagcacacaagctgtcaatgcaaacacccctatcctagatacaacaaaggtgttgtttgcatttcttctatgacttgattatttttctttacttctgtattagaaatttgtagtgatggatgccttacataatacattttttttctctaaaaaaaatacaaaatggcaggcagaatatgagaatattgttttatcttaattggaagttcttgttgaccttgatttcctcctcgtgcaatttcctagggaggtgcttatcaagaatctggtcgagtgtggcgtgcaaaagacatagcaatgccagaaagggcttgtgcatggatgcctcacggtttcatgagtgtaaatacgaagttgggagctgggagagcttttctgaaatccctttatgagcagtatgctgcatggggtgttgatcttggtaccagttcaactaatttataatctgcttattatgcactatcaggacttgcatcatgtcacagacgacaatcatgatgaatttaaataatttcttgctctatcttaatctaagtttaataactcaaacagttgtactgcttttttcatcaagagactaagcagacagaattcgtattttagtggtccaatagatatcaagtaatgttatcatatcaaggaacttctattttcactaaagataaaaacaacacagcctacttcattgggccacacttgtaaaagttagtttactgcaatttcctttttcatccattctaaacctctaaaattgtgtcggccttttaaacattgttatctctatgttctagatggttcctttttagtccttttcctcttcatctcccccctcctcctttcccccttcttagcttttaccatttttgttttttcaacctcctcgtatctatcattgggttcatctaccaccgattccaattagtttgggttaaaggtgctgttgatgttgatgttgacataggaaaaaaatgcaatagaaattagttagtggactcttaactggattttcattatgatctatgagaatacatatatcatcattttggctatgctttggcagctatgttgatagattttcttctgtccttgcagtgaaacatgactgtgtgtttggtgatgacttggatttaaatgaaataagctatgtgtctgaggtattctgcagttccctctccctcttaccctctccactacctctcattctcacataaacactgagattggtaatatttttccaatgatttgttggctaatcgtatggcatgtcatgacaggttctcagtgagcttaatcgccctattgtgtattctctgtctcccggaaccagtgtgacaccagccatggccaaggatgccagtggactagtcaacatgtatagaataacaggagatgactgggatttatgggaggacgtcaaggctcattttgatgtaacaaggtgattaagctgtctatatttctgtttaagattttttttatcagccttgcagtatgttgcaatcatgctacttctctgtatacattctgtcataaccatattacagaactttagttcatttaattctgaaccagggatttttctaaagctaatatgataggaggaaaaggtttaaagggaaattcctggcctgatttggacatgctaccatttggatggctaactgatccaggtaatgagactaagctgctactttttcatttgcccattatgaatgtcaatatgtcataaccctcatactgtgcatgagttgtttattacttttatgtatgtattgatccagtaactgcttttatctattattcatttgtgtgaaccagaatcctcatgttattggaatatggattatggaattatttcttatccccctattctatctgtaggatcaaatgaaggtccacacaggtttagtaaactcactctagaagaaaaaaggacacaggtattgataaaaaaaagaagaagcataactgagttgctttcctatatattcatgtatctattttgatctgcgtacgtgcattatgataatagactctgagtgaatcaattcttatctggcagatgactttgtggtctttggcgaagtctccccttatgtatgggggggatgtgaggaagatcgatccaaccacatatgaagttatcacaaatcctaccgtgctagagattaattacttcagctcaaacaatatggaggcatgtgagccatctaattttttagggaataataggcacgtgaggcatagaacttatcatgaatcatttcactttactgcaatgacagtttccttacgtcacaagctctattaacttgaagcaccctggagggaaaaaaggaagacctaagaaaggaataaaagcatcatatagacattcattgggtttgactggctgcagtgaatcaaaggcgagtggttggtctattgaaagtcttaaccaagatcttgaaataatctgttggaaaaatggtttagaaaacaagcatcaggccactttctgcgtacacaaaagagaacttcaattcagattgtaatcatgctttatctttctattttccatttatccaacttccatttaaatatttgtgttgcagttaacaatagaaattgttacattggtattgttacagagatggggtgagtatgtatcaggcagactatgtatcaggcagactatcgagggaaacatcaattagttgcaactgacagaatgaagttttgcttggatgcttctccaaaacgaaaggttacttctagagagttcaagagaggtacattttctccgtgcagatgggattcaaatcaggtatgttgcagtccatatgtcatgtacaagagtagcgtgtggcccttaatctttaggaagaaatcctgtgtgtgattcattaaaacaacttcgttatgtgcatattattatttttacccctattgagtaccatttgccttggccaatttgtattttattgattctgttggaagctgatctatccggtcttctacagatctgggaactgaactccaatgggaccatggtaaatagttactccggtctttgtgcaactgtagagtatgttgaaggtaaaattttgtaatcattttccactttttagaaatagtttccagggttgcttttctttttccccatttccttgtgtttatcactcataaagcaaattggtcattcatgcagctaatgttaattctggtgggattcgctcttggatcgcaacaggaaggacaggtctctctctactttctaacaaacacttggatggatgtcaagaattttcttcttttctgcaattgcaaagcatcaaaattggaaaaatgctaattgcttaaataatcatgagtacataagaacttaaataacagaatttgcttaatcacgagtaccatctgactcttaaataagggtccaatcaactactataatttcatccacttcaccctctaagaggagtcaaagtcaaatcctatattaattcatttatattaatcttatatatctattcaggggaaatctatcttgctttcttcaatctaagcgaacagaagacggagatatatgcaaagacatcatatctggctaaggttcttcctgacaaaagcatcacttcatgcaagggtaaggaagtgtggagtggaacagacgtaataacaacgcaggggacgatatcaatgaacgtggaaattcatggatgtgcactatttgttctaaattgcaactagtctggcatggcttccaattattttaaacagaaaaggataagaaaatagcatctcattgttgaggcttcccccccctctatttaattattactcttcctatggtgggggttaggtgaaatttgtatatgttaatgcagtgtggtgcggtacgtaactgttggatcgcaccgtgtttagacaaactacataggaaattatagttgtatgttagtcagcctcatacctttctaatggttactttgaaagaacacattttattttttaaataaaatcgtggcctaatagggtaatgtacctatgtagtggtgttgttacttgttagggctccatagatcagtgtcatgaatgtacgatgacttaaagaacatgatggtctgtactgtagtgaaaaccaaaacgaagtatctaaactggaaactacatgcagttaggaaataaaaaatgctcgtagtgagttaagcaaaatgaccatcaaaaagtaacaacagaacagagtaaaaggccaaaagcctacttgccactaccacttaccattcagtgttatatgaaacttgcatctttttgtaactaaaaaagaaaatttttgtttatgtctgttagaaaacgattgtttgttactttgtggcccccttgaattaaggattcgaaaaaaagaattaaggattcgaaaaaaataaaactgcaccgaaaagcaatcggattgtgatattcacggccttttatgatatcgtcaatatttgagattgtggtaagttattgagagtgaaaaattcaagtaagagttttcacagaaaaaattgttgatgagttatttttttataggcatgagcagtcaattaaataaaaaggaaacaacacaaataaaaaaagaaacaaaataatctgttatcgaaaaataagattgtttaaggtaaaatattcttcgctgttcttcgttaaggtaggaaaattttatttcaaatcaatatttttaatttctttaatcaatactttagttttctgatgaatattaaacatgactaatacatttataaatttattaaaaaaatgttggtttttttagtataagttttatgtaccgtcaatattaaatttgtacggtcaactaattaaaaattatcttaattataattttaaaaatattttttataaaaaataataatcttattatatatcatatttttaattgaataataatatagtatttttacgataataatataatattaaatagtgtatctgactaaattatatatatatatatatatatatattttttttttctatttacacataaatatgcgcgctgatataagttattaaaatatcatattcggatggactaaatggacttttcacgtacacagcattagggttccaaaacctgactggtacataaacgactcgttcaactcaaattgccgcactgcaactttgctctctgtgaggcttcaatttccaattagggtttcgctttgagtaaccaataaccatgggagtcttcacctttgtcgttcgcaaatccggcgccgaatggagcgccaagcaacattccggcgacatcgaggcctccgccgactccacctacgatctccaacggaagctcgtgcaagccgctctcgccgttgattcctccggtggagtccagtcctccttctctcccgtgtctcctacctccgctgtgttccaggtacacattttcacatccctaacgattgtggtttcttgattcggagataaaacttcacggtttatgtttatcctgcgttcaacttcgatcctttttatttgtattattttgattttctagaatagtacattttctatgcgtcattgcactgtgcctgtttcgagtattgcttaggctttcgttaggctatttttcattgacgaatgtcctgaatccgagagagtttgctagtttggttcttgttattcatttgtgagattctgttgtggaattaatagtttgactttattattattttttctttattattttttggtttttcattcagattactctgagattatgcgctgacttgaagagaattataggttttagtgctatgacttgcaaagcttaatcattgttcattacctgaaagtatataatttgtgcacacataaaacaagtacaaatttagatctagttactttaaagcttttagtgcaattttgaaaatttgaagttttactctggtaacatttgctgatattttttagacaatttagttggtattaattttaaggatgttcttagacatgggactctgttatttacagagttcagcttctgtccattatagaaaactgactcttattttccatagttgaagctttactctggtaacattgcttagatgatgatcgaaatgaaactaattttaattggagaacaatacttaatacacttgtccgactaaatgaattattgtgctattgatgattgatggtggcatttctgccttgctggtttaacttttggattcaataattaagtgggtcactgaggttatttttcctttgttgattgttttgttcaggtgatagtgggtggtgctgtattcgttggaggtggcggtggtgctgttgcagctgcacctgcagggggtgcagctgcagctgatgctgccccggctgctgagaaaaaggaagaaaaggtggaggaagagtccgacgatgatatgggattgggactgtttgattagagtttttctgctttttattgagttttgatggaaaagtgtttttttagtgtttaatcttataaattgtgtttgtgtattgcttttcaccagttaatggtacattgaacttcgtcagatagagttatgtgctgtgacccaaatggttcttctgtattgggttttagtaggtattttctttttcaaacaaatgtctcgctcttcttttatcactggcggatagagtattgtgctgatcaagcggttttgctgttaatacgattttcttcttacatgttactggacaaacacagccatacatgtatgagaaatagtcttaacaaatatatttcctaacacttttgatacattggtaaaatttacgtatgtttaaaattgctttttctttctttcttttctcatttattggtagggtgctactaggacccttctaaatataattgcttgacataattggatcaaagaaattgggtggtttgcaagcagcatccaatgcattgaaattgagtgatacgccaaactaaaataccaagaatcaaactaaaatattttaataatttcaaattttggtataagtttcatatttacattctactttaatttaaaactttcatctcaattttatttttttggaagggaagatgaatttggcaatatgcattagcatatataaaaatattaggtgagaatggaaatccaaatgtataatttaaatgaatggctaaaattaaaataattttgatattctgatgcaattatatggttaagatatatgtataaggtggcaatgtccttatggagtatttggtgtcggtggaatactaagctctgggaaggaaggatggagacaagctcaatggtaatatctggagctatgtctgtcctgaatgatgggcagaaagctaggacagtgcaggaaggaaatagggagttggatatttcggaggtaatcataaacccgtaattaaatactcatggttttctcaattgctatgtagatacagccattttcgaagaggataataagactggagtgggtctctgcctaagggatgaagttagagtttttgttgcagtgaagacagtctggttttggttggaaactgattctaaacttcaccttcatgctttctctcatccgaagattgtccattggacactttacactagatggatgaattgtaaaaagttcactgacaattttaacttcaaaattattcacgtttatcataaagacaacttgtgtgtaaatagagctgtctcttttgggtatacttggtgggatcctctaccattttttgtttctcacgagtttcttaggtatagacaaaggctcacattttatagattcccttagtgttattccttgggtacccaagtgttttgtattttcgcttctaatgaatatatttagaggaggatcttttttgggagattaaaggttgggatgtcaacccccatctgtccttgatccttcgtctttctttctttacttttttttttttttttttaaaaaaaagatagcttggttnnnnnnnnnnnnnnnnnnnnnnnnnnnnnntagagaagggaaagcacttgccctcttgtatgcaagtaaatgatgtgctgagaggggtgagcaacaagttatcttcaagactgatagcaaagtagtggtagaccaactgcaaaaagaagcaagagatttatctgaatttggctcgatacttgttgattgcaattgctcatttacaactttttctagttatcaaatttagtttattaggaggcatatgtgtatggccctaacttagctaggaaatcggcttatgcagctaatccgtagatttttcattttgcctttgattgtaatgcaaatgatattttaataagaatgatatgatgtacttctagtaaaaaaaatatattcttttcacatccaatgctaaatatataacgtataaataaatgataatataaacagtatcaaataaatattgatcatacaatatacgaatagttaagattgttagttttaattttaactatttatttgaattatacaatttacattgtttcttcttatattcttataaggatggtgtatttttaatcagaaggaaggctcaaaggtcgtacatcatcaggaacaacattgggcaattggtgaggaatgtcatcaatcaaagatatatcatgttctataaaagtaaggtgggctacacaatctgtcgctttattctcaactctatttacaaagcaaaatttgttctattcagcaacagagctcagtcttgaatcacacctgcaaagtagttgttgtcatgaaaacggttattattcgaagcatccacgagtcttttgcaatcagattcataccggacagattataaaaggaggtccgttgcagtttcaaggcccagccacatgtggttcataacaatgacgactgagtatattttggcaagtcctcaatgccaagttgaagcacttaggaactgtaggaactgtccacagcttcttccacaaatccccattcactgagctagagcagaaattcttgcggagaagaataacaagaattttgccagcaactgactcattgcctagactcatggtcaatcagaaacataacattgtgaaaaaaatgttaaacaaacataacttttttaataaaagaaggatctaatttttttagtgtgaaagaatgatataatagaaatgcaattgtagtatgaaaaatagaatacacgtgttcaagaaatcaagaattgttaagttcttaaaaacaaaaatggttaacattttctatcactcctttcaaaaacaaacatagagtattagccaattgattgatattgtgaaggaaaaaaaatgaactacactaataatgcattaaaatcaaacttataaaagaaagcaaaattactttgacaatgctattattattcaaatttaaactcgctgtaccatttaattgagaatagtgtgtacttatattagacatagactctgatataaaaaaatagcgtgtacttaagacattattattgttatttacaataatattcgaatgtcctttcttgatgaaaggttgaaatcttttttttttatataaaaaggttgaaatctttctttgcgcgtgaagcattacattgcaattacttgacaaagtcttttcaaccaatcccaaacatgtagatatttagagacaagtactaataagttagttgagtgccaccaaagtagaaaatcatagtttatgatgtgttatgctaatcattcgctaattagattaacaagaattaagtagtcaataatgatttagttttgacattaaatagacgatggacatagagagggaccaaaacaacggacgacctttatgggaggccaatttaggccaagttagactcaataaacaaaatttcgaattcaatcgaatatattttgatttattttttttagatttatataaatatagacaaaaaatttaaagtgggttaaataaattgatccgagggttcattgaacttgactgaccaaaaaattagaactagtccacttcaaagtatttttcacacttgaacggatgattttcctagtggaatcatatcccaactttgattataatttttgttttggttaccttgggtcaggcttcatgtcctccaagttatcttgccgtgttctttctatgaatttgggctttgctattgaggcctgtatggtgtcaacctaattcacatcagtataatcacttatttttttaatcggcaaaagtataataattatatatagagaaagcacaagctgtgcaaaatatagtgtaccaggcatggacacctataagtttgcagcaaatacaacccacccataactatagaaaagtattctcccacgaacagaggttaatcactattactgattatacaacacatgaataatgattaaccaaatgtgaatatacccgcagaacaaaaatcagcaagtttatccacataacctcaagaaataccaacaaggacttcatcgcccatacatctgcaccatctatcaagacctcgagatgcctatcccaacaccactgatcgcaaccacttggtcttagcttagttttttttacgtaaaaaaaaataaatagaaactctacttttgattctttcctcaaatgctagtaatatttttctttatgttttatacgtttatggtaaatacagcaacagtgaatgaaagatttattatgatgttaaaaatattttaatataaataaaaatattgattatttcttaatctgtgtgctattatttgaaataaacatatgtttttttagactaaatattatttaatggtctttattattactttcctaataaagtttgaattaatactttcatcattttgatgattgatttgaattttaaaagatcgaaatttaagaagcataactttaaatgaaaaaagaactattacttcatccatctattataattattgtgtatatgagaaaaaaaattatccaaaaataattgtcattttaattaaccaattttaaacttaaataatgatgaataacaaaatttataaataaattaataatggtataagattatttttataaattttttatccatttattattatttttagcctgtatcaaataatttaggacaatagagggagtattatttttcatgtaaaagaatatgtaaagtaaattgaaatgatgcacgaaaaaaattgaaatggaagaatacaacaaaaagagtaatattatttacatatttttataaaaataatttttttaacatagtatttatttttaaaatttttatttatttcatttacataaaaatagttgtgaaattttactctataaataacaataagctacagaagaaggaaaaaaacagaggtcaaaacataactggtaaggtagtaaagtacacagaaaaagaaagtcaaaacgaaaaaataaattaaagtgtgatagctgcgacggcaagtgcttcaactagggttctagcgtacgagcgaatctactactgtattttataatataaaattaatttatgaaactctatttataattaaattaaaaaaaatgctaaaaatatctatggccttttgcactgaaaaattgcctaaaataaaacattaactaaaaagaaggtgggtaacacgacgacgcattgctccagggccatgaatacccaattggaatgaggccgtgaacccctcatccgcgcgtgagcaattcccaaacccacgcgcccacgctcccaaatgaaacacacactaatgttcccttccttcccattctcattctcaattcgcatcaacgcacgcacggacgctctcctaatccccttcctcttcctcttcctttgcatgttctcggagctccggctccactagcggagccccggctcagttcaaacccatttgcgaaaacaaaaacaaaaaactaaactccattttctcttccctttcgagatctcgaaatgtcgaaaccctggggcaacatcggagcctgggccgccgattccgagcgggccgaggccgaggaggctgaggcccaggctgcggccacggcggtcgagccccaaagctttcccagcctcaaggaggccgtgaactccaagcccaagaagaagaagggaaccaccatcacgctttccgagttcaaccgtggaggtttcgaccagggccttacgcgcgacgagatgctcgcccttcccaccggtcccaaggagcgttccgccgaggaaatgcagttaaaccgccttggcggcggtttcaactcctatgaccgctccggcggtcgctcgcgcgaccgcgacggcggcaacaacgaaggttcgtggggcggaggaggcagaagatcctacagcggattcgacgaggagcgcaggggtccgaatcctagggtttcggaactcgatcagccgtccagggctgatgaggttgaaagttgggcgtctgtgaagaaatctctccctgccttcgattccggtcgccagaatcgctttggtggcggcggttttggtggtggtggcggttttggtggcggtgctggtggaggcggcggcggcggcggttttggtggtgcgtctagggctgatgatgtggacaattgggcggttggtaagaagcctgttcctgttagatcttccaatttcggttctggttttcgcgattcgggagtggagcctgatcggtggacgagaggcggtccgcctcgtgaggttgaccggacggagcgaccgaggctggtgttggatccgccgcgaggcgatggtgtggtgaacgagtctccggcgaaggcatcgaataaggcgaatccgtttggcgcagcgaggccgcgggagcaggtgttggctgagaagggtttggattggaaaaagatggattcggagattgagacgaagaagacgagccgtcccccgagttcgcactctagcaggccttccagtgctcagtccaatcgttctgagggtcccgggttgcagggaaccgatgctgtggtgaaatcgaggcccaaggtaaacccctttggggatgccaagcctagggaggctgtgctgggcgagcgaggcatggattggaggaaaattgatcttgaattggagcatcgctctgttgacaggttttgttttgtttgtttttgtcaattgatgcttttatatttcttctttgatctgttttttgaacttgtaaatgttgctttgtttgtagtggatgattggtaatggtcttagattggcctctaggctttttgtttgaacttgaatttgtgtctgatcataccggatttgctcgcattattcaatagttgcataccaaaagttcttttgtccccattatgcaatgaccataaatgtgcttaagggtggattgttgtggtgtgttgaattagtttgatttatgggaatatttacagattaggcatatcatatgggcatgatttgtaggtaaaatttaatcaagagtgtacactaggattggattaaagcaatgacatttcattagactgatcaataaatggttgggaacggtttatttagagttggaaatgcttttggtagagattttggtcgtgttgttttatatagttcatgtattgttcaatggttactactctaattagacggtggtcgtttttttactactctaattagtaagattttaatgggagtaagagaagagtgtgaacatcattattttttatgatttaatagtaaatggttactatataatatatattctattcctagatcaagagctaattgtgagtgtcatatagtggttatgaaaaataagataggtatccatgtaataaattactacgttaatgaagcttccttctatttttctctgttaaattcagaactatatggtttgtaaagctatttgttgttatttcagttaaatcttatgaaagaaatcaaaccttcttaggatgatacatgaattatggatgccatagagaacttctgacttcccagtcaagttttatcatgcctgtaaaagacttggtatctgtaaaataattattgcctcatttctttagttattgaaaatttattgaatgaggacaatgcccatggtagatgcaccacaacaatcatgtgtggaatccatgtgaaaattatgcctgggattttatgttggtatatgtatacctctcacttttgattatcattgaaaggtttttatagttggcttctagtataaattctggggtttatttgtagtgaatactaggtcatccaagggagtgatacctagccccaccttctatatcttagggacagaatgaagcaaatatatccattgatattttttcaaaacagaaatgagttgagaaataaatatctgttggtgttagaatattaggggcatgtgttggatgatgaacactttttgcaaatgttataatcgtaattgaagagtcgagaggaaataaatagaagtttgggatgttgagacatgctttggattcacattgtcgattgctcttgtttaaataaacatactttttaggagaatcttgctttaggttgtttatttgggcatgtgtggagaagaccctattaggagagtagattagatgaggggatcctaatcactagagacaaaaggaaactgagaaaactatacgagaaaccattaagaaggatttagaggttaatggtttgtctatagagacatgatttattatagaaaattgtgttgtcatttgatccttgtagctgattagtgggaaaaggcttgattgttgttttatttagttctagtgttgtagagttgagattgtacttgcagaagtagtacttcttcaagttaaaaaaaaaactacgtatctcattgttcagaggttcctcgctatgcgaaggtaaggaagaggaatattgtatgcagtcttacccttgcatatgcaaagaggctatttccaaattcgaaccctgaccaacaaatcaccaacatacaactttaccgctgtgtcaaggctcaccctcaagtagtacttcttcaagttattggtataaatagtgtatcagacttatttttggttggttactactgtttgttaatttattttccccattctttttcttcgaatccggaaacaacctctttgcatgtgcaagggtaaggttgcgtacaatatccctcccccttacttgtgcatagcgtggaacctccgggcaatggtttttttatttatttattattattctttctcttctaattcttaacctataattccaacatgatattagatctgtatcttccttattgataaggatctgtcttttttgcttcactgagcttgtcaaagttgtgttttctgatctatgattttttatattatatttttaagtctccaatccttgttgtgacctaagttcgtgtcctaaacacggcagaatcaaccttggctggtgccctgctgtttaagtgaccaaaggtgggtggttgctggtgtttgcaagtcacttttggtcagcctgggtgagataacctgctggctatcgctaactggctgtttttctggctgcattctgttattgaaagctgtcctaggattactaagtttcagtgttatttgccttgggcttgtagtagttgtaccagtactagacacaatttctagtgtaaatagaagtattggattgtggtattgtatggcagatatttatcaatttcagtatattggttatctttctatctttttcttcttccttacctgaaccttatatttccaacaggtgaattgctaatagtttaatcattgttctatatcatttactcctaatagtttggcattaatcaggacttgctttcataaatctctatcatctctttgtttattttgttcgtcttgccagattatgcacaacattgctacataattttgtgtaattaattgtgaattgttgtctttcaaaagttctagttaccttgttgactcctgagttatttcaggcccgagacaatggaggaaaaattattaaaagaagaaattgataatttaaagaaggagcttgagaaagagtctacaataaattcaaacaaggaatctgcggatgaggctggtggagatcaaaccagtacacgtgcaatattacaactgaaagaaaaggagctggaacttcttatccgtgatttggatgacaaagttcgttttgggcagaaagccattgaaaggccaggttcatcggcaggaaagtcttctactttttctgataggccacattctagatctggctcctttgaggattctagaagtgtggattttacagacagacctcgatctcgtggtacaggagatatgtggatgcatcctagtgatgacagaagacagtttcaaggtagcagggaaaggggatggttttctggcagcagagacctaaataggtgagtaataagtgttattcatacattatttatggcaactggttgattttgaattcaattttgtttattctcttgtattatttggcatatatagcttttacattttgggaaaaagtgtttgagaatgttgatatttgttgtcctacaggtcaacgtcaagagatagatggtgaacagcagttttgtgtggattaagagttatcttcaacttttgatgaccagaacctaatactactattttattacttgtctttctaatcgttttgctcattttactccaggcaattggagcaacaatcattgagtaatggcactaaaacttttgcctaatctgttattgcatctcgaaacattgtaaatttgttttcccccttctggtaattttttgggtgtctggatgaaggcagaaagcctgtaattttattaggacaaaatttttattgagaatcttgaaacttactagttaatgttaatgtgataatgttctgaattctgatataaaatgatttttcttcaattttgcgtctgcacggtattgtccagtttagtgccgtaagattggtagcttaaagccgctatcctctacttgtaacattggccagttttagtatcatatttttgtttgaaaatggatatcccagtatttatgtattatcctgtgctatccttaatattggaaagtaccttttactccctaaaggtccttgactatggtttggagaatgggatgaaaagtgcatgctaagttatgattttattactggatcaaacaacccctaagagtttttaagtttatctgctgaatctgatatcaccaaccttgggaaaaagttttaaagagtgatatttgccatctctatgacaaaaagttaatagttatagtcacgtttagtgttgtgtttgcttttccataaactggttccgtaacattgtttcattggttagtttaaatatgcatcttcatacctacttgaaaagttgaggtgttagtggttcttttcatcaacggtggtcaaagatgggaagcttaacgtcgttcagctggatgatttctgacggcctgtggttcaaaggaaggggaagagactcgaggggcgggagattttaagactagcgcttcttgtttagattttaaaataggagaatttaaaatttagcttattaatgttttaatagtatacaaataaaatcataagttcaagcaattgaaattttcaaacttattattagtaagtaccacgaataaaatttaatatttttcattctcttcaaatatcttttatatttagatgaaatgcaagaatggatatagaggatttttggtttactttcattgtctctaaaattttgaactaaacaagaaagttttgtaaaattttcttatcatctctatgttttctcggggggggggggggggggngacaagatgaagctaattcaatttgctgacatgatatattagtcttaatagctaaattatagaatttaaaaagtatacaactataaaaaaaaaagtatataatatcatgttaaacaaaacattatttattaagtcagaaacttttaatattaatgcatagaaaactatgccttttaagaatgtataacattggaccaaattaggacaacttattaacttgaatcagtctttaaatacattggtctaatttcttaaacccaaatttgtcaaaagttccctaaagataggccagattggtggaacgaaatgcgtcatgaacattcctagttggaggaaaatgaaggagggataggataattgtttaattttttataccttatttgatttaaaaatttggaggaaaatgaagaaaaataaacaaagagactaatatttttcttctcatatttttatttttccttgaatattgagaagaaaagcaatttataatttttgaattatatagactaaattattccaagattgtattttctcttatccctgaataaatacataataataataataaaatattttgatatagtttatgagtatacttgaagtacacactcattaatttagccatgcccaaaaatacggtaagcaacaaaaaataccacatgcatagggttatgaaattttcttttgttgttgttgcatatttaaacgtggaaaatgtaatgaaatactcaacatgcaatgttttgaatggaaaggttttgaggagggggtgatagcatgctttggacatggtgagaagtcggagtagataagatagatatacttaattgaatctcttttcttaatacaacttcaataatacagagagatgtggagcaaccaagagggtgaatggaacagagatcatacccaatttcatgcaaagatccaagtgtgaggattatttgggacggagtccattgcaccgaagctgctaataaatggatcttccaacaaatagtcaatggctccttttcagatccacctaactctttaaaaaggacttgttatggtaaatcatccatccacagcgattaatccattaggacacataaattcatgttcttgtaagagtgaatttcgatccatgtgcttaaactgacaggtcttatttagtgtttaacgaattatgtttggcaaattttatttatcattgatgtatatttaatgacatttagcatgttaattattattattacgtgttaaacagggtcttattaacgtgctaaattaagattttaacatatacaccttgcaaagaaaataattcatagaccttatgaaacaaaaaagagaaatataatcaatactataatttttttttgttttttttttatttcctttattcttgtgagttttgattgctcctatttttttttaaaatttattctgatttttattctttcaaaattagtattttgggcgattcatgattgtttctgattaacgagtcattttttcgcaaccatgtaacattttataattttatgtagacaatttaattaaccttttggtcactctatttatgtttggtctttatgtaaatacgtaattaataaccaaaaataaaaaatgtaaacactcagctttgcctttttcttttattttgttggtcctttctttttgtactaaagaacgaaatttaaattttcctcttccttgtatttgcttgtcctttttatttttatgttaactagagaaaaagaataaaaaataattagtttttttatctttccattcagaaaacaagaatgaaaatacatttaaaattaagttaggtataaaaaaaactaagacaataatttaaaaaataaaacaaaaatttggaacaaagagtctgaaaaaggaaagaaaagaacaaaatacataatttataatgggatgttaaagaaaacaataaatgatggcgataaattccttttgttctttattttttacatttttttattgataagaatcaaaagactatataaaaaaaaatttacaatagatttatataactatttactcaattagattcctggatagtatacaataaatataagataaatatttattttatttttaaatgtgtaaaaatcaggacaatttaattattgaaagaacaaaaattgtcattaaactgagttataagaaaaatgtaactatagcaaatttttagacatttaagaattaaaatgaggatgagataaaaaaaatagtagttttttagattgaagagttgttgtgctgggataacatacttccctgtagatgaatggtagaatgagaggaattgacttatctccacacttgttgcaaggaacgaactgtcctgctacgccaaaatttagttaagagttggcagaatttgtgattggtttgtaagttgttgtaagttaggtgtagctaaggcaaatgcttgtctcaggtgtcactcacactttctgccccttcaactccaaatcccaccgcccatttttctcaacacacaccccttcgtgcttcctccaaaccatcaacgctaaccctacctccgattccgatgacgccctccgcctcaccgttccttccgccgccgcagtcgccgcctccattcgcaaagcctccacctcccccgtccaattcacccagcagctcgagaaccagcgccagagcggactggtgcttcccagcaccgacttccaccgactctgcctccaccagcttcatctccttcgcagaatcattcccgaaaccctcctctcggttccgattctcatttcctttctcctatttttttaattatctcatctgcatgcatccttgttagcttcaattcaagtcgcttaaatataccatcaatttcatctctcaagtattatcctctctaccaacaaataacaagtcttagaaatcgtgctaagtactctttcaaatattgaaaaactcttcaaattgatcccggactattattaaaatatatcaattttctatagatcaaactaatggatattcaatacttgagggattactgtggagagagaataatactttgggggggcggggggggatcgaactgatgattcattcgatataagtcaaacaaactctaatctgcttctttaaattagtatcatccatcaatcaaggttttaagttgccatccccgtttaggttttgttgtaatccatttatattgcagaaatttgagggaaaatgcagttgatataattgcaatttcagtcccaaagacaacaaaagcctcgatgtggtggctgaaatcgcggttgcagagtgttttataaaaccttgccatcaatttagtcttgaatttggccaattttgttgggtcttcgtgtatgtgcagattagtcagtcaattgggtccctcatggctttaaccaaattaactagcagatgttaggcactagattggctaatttggtaatgttagggaccaaattggatattgatccaatttcatggatcaaattgatcgacagattgttaatagagacagggactaaattttttttttttctttttgtaatatttatgaccaagttggctgttattgacaaatttagaaactaatttgatgttttactcaattttgggattaaatttacattcctaagtaagcactaaaatgtctgctttcttaaatttgaactgagtgatgtggttaaggagctattttgtttgctttgttcaggtgtatgttagaccagctggtagttatgtgatggatcggttggagctgcggcgggttgcactgtaccctggagatgcggaggcagaaggcattgtcattcttgtgggtcattttaatattcctgcaggcttgcgtgctgctgaggccacgctttccaattcgcaagtgtgttgaataccttgagcacacaatgtgcttctcttctgttccaccgtgcttgattattcttgttgggtaggatgaatgttaatataggtttgaatgttaattgtaggttaatgttgtccctgaatgtaaggctgtggttcttccgatggtgaaacacccatttgttgttggtttcttggttgctgagcttccgttggtggagcaggaacagtgtcagaaatctcaaattgatggaccagaaaacctcatgtctgttgaggaaccttattcatttcctccctttttggatttagataagtcaagggaaattcagaatcttcaggtcaagaatgaggcagttggtatgcataacttcacttctgagcaaagatcaaatgctgtcaacatttcacagtctctagctatggcatatgtcatggatcaggtttatatactgcatctttttcccctgaaaaaaaagagagaagaaaaaccattacattaacgcatcactattcaaatatgaaatgctagaaagtttgacgctactcaaactttgtgggagttgccttgaaatttgcatttcataacatttggtacttgaatgtgtgctttgcaagttgttgcattgaagttcacaattatttaatccatcactcgagtaagactgagtaactgttagtttttagattgcaatgcaagtcttttaatttatttctctttaacttttatgtatggtttcacggctgttataagaatagctttgacaccttgtatgggcctaaatttctagctcatggttatgctacttttacagaaagcaattttacttcagcaatcaacatggcaaaataatgtcaggatgggtaatctggttgagcaagtatgagttattgactgttgttgcattcctttaatctctcattttcatcctattctaattttttttttaatttatacagatccgcggtccactttcaagtattcaaaccttaagtaaaatcctgtctacacagacaaagagaactcaggtttgaaaattgtctaaattgtacctgataattcacatgcacttacatttctgtaattggggaacccaatagctgggttggacaaagtcccagctgaactgacacatgatcatgtctagtctctgactctacaatgcacctttttaaagcatcattaaattacttttttaggtggatttaatattctgaaaagtctttatttcagcatgcactttatgtgtactgaatgtgctaacttagtgagttggtgattagtagctatcttattcatgatgccttgaatcgagttctatcatagttttaaatgcaaggatatagatgtttggtaaaaatattactaaataaatatagatctatccagaaaattagagtgaacatgctgcaaaaggaaataaagagttcaatctcaaaggatgttgaatctaaactatagttatccataacttatagttattgaatgtcaaaaatgtcttataattggtaattgcacagatttcatatgacattgttgaagacctcttggtgcaaggtgatcgtctgagggatgtcctccaacaactacaggatgctgtttatttgacaaaggtacttctttctcttgtacttataatcatgcatacatgcaaatacattttgtatacctacaatcaattaatgacttattgaatttcaatgtacgttggttggaagatcttgaatcttcatcacttgttgtctcttgactcttcctctatataattttgcatgcaaaaatacacttataggcaatgtgccttgtcacaaaagtaataaagggatttgagtcctaagtatcatattcaagggattaattcaattcatgtttattgaattagtaaattcttttaaaccttttgctattcaaactatcaaaaagggactactgcaaaagaattaaaagaggaagatgaattaggaatttaattcccaaagaagatgaattaagaatttaattcccaaagaacatgaattaagaatttaattcccaaagaattaaaattggctagggctctggcctcacttgcattctaatttctctatacttatgtgttctcttatcagttgtgaatcacctcttctaacctattagcaatctgtggtcatgaactgttatattatttcccttgtcaaaataccaagtttggtcatgtaaggcacaaaacaagaaaagcataatgaaccaagtgacctgttaatttaataataataaccaattggaattcaagaattgaggtttggtcatgcaacaattctaagtgcatgtttgattcaacttattttggagaaataactgcttatttttgctagcttgagaacttatgaaaaacaatgatttcctcaaaattaatcccaatcaaacatacatttaacctaatttatcctataaatctgttaattaactgtgcattgtcatcaacctatcaattaactcaagtcattaataatggccaattcctaacatacaacaagtacaataatttaaacccaattgaaaaaggaaaaatacaaattatattaacgttaagtaactcccagttatggatttagttactcatgttcaaaagatatactaaataaagcaagaattcattaaacaatccataaagaacaaaaacaaggacccctttgaaattcataaaacacaggttcctaaagtgaaaacgtttaaaaattaaatgttattgaaataaacaaaaaaggaaagcaaacactgatagaaaccagtgcctctgatgttcaatttttgtccaatatgtagacaaatatagtgcgctacaatgaagaagcaatcaagaaaatgaatagttctactcacatacttgctgaatcatcaagatctcagttgttagatagcaatccaggtgatgtctctgcaaataaaatggaaaaatctagtgagtcactttctctaagtgctgctgtccaggatatagagatgccactaccacctttggcccttgctccattgcaacatggaatcaggtaggtttcattggttggttaatgcttatgcttcttttcatagtgtcatgacttatccccatatcttctatataatatattctcttgattctgttatatcccataataataaactcctaacttgcactttttgttgcatcaacaatcaataatatcttatatagtttgtttctttcattagcttttagatatttatttcttttacctttcaacagttaaattttttctgcatttattttgcttatgcttttcattaatgtcaggaagaccatgcaatgtttctgaagtattggcagacttggttgattcagtgagaccacttgcccggggtcaaaaacgtgtagtagaactaactgaactctcatcatcacctttgctagctgctgtagaagaacctgcattgcgccaggctttcagcaatcttattgaaggtgctttactacgcacacatgttggaggaaaggttgaaattgtatctacggcagcaccagctggtggtacccttgtacttattgatgatgatggacctgatatgcactatatggtaacttcagcccactcccactccttgctgtgcttactcatttttcttttggacaagctggaaattgttttatgcatgtaatttgcaaatttgaagcatctccatgggaaacttgggaacatttaatgctttggacttggcaaacagcgcattgatgccattttgtgagggaattagtgcagcttttcccaacgtataatttgcatgattcataatcatagtgacatgtctgtaagtctatagaaatgtggagccctccataaaattaccattatattgttgatattcgaagacttcctttgtggtacacatagcacttgattcataaaatatgacatctttcaagcacttccttgcttcttctattcaaacaattcttcgattgagtgctttatgcctagggaattgaattttgtgaaaatggaaactaattgttggttatgaacttgcctgcagactcagatgcactcactcaccccttatggacgagaactgttgtctgataatatgattgaagacaatatgacttggaactttgttgctgggttgactgttgctcgtgagatactagagagttatggctgcgtcgtccgcattgtttcacctcgtattaaagatgctcctcttggagctgggggaactcgtgtggaactctggcttccttcatcaattgtactgtctgatttgagtagccacgcccaagaggtatagcatgagtttgaagttccattgaagataaatagtttccttctcatacaattctacattgtagcacttggccagtatataaagattgtgaaattcaggagtggtagatattactagttctttcttcgttgttgctaaatataagtatccggttctgtatatagctcgtaaaaatttctttagtagagtttattttatgactttgctgtgtgtcaccatgtaaacaataacataataaacagtgtatgcatattatatgacaggaaaacttgttgggtttttacaagagaccacttatctgaagcttcagcatttgtaccatgcgaatccccttaatccaatataaataaacgaaaagagattgacctctttgagtaaactaaacttcagtcggacaatcttccctttgttaaaacaacaaaatttaggtagaagactaaaaagagtctttcaaccaccataaataaagaataatcgttattaaataaaattaatagatatatatatatatatatataattatttagttgtttaaatttcaactattcatttcaatcaaaatgacatggattccccggagcccggacttctttagactttagatgatagaatgcataataattgttaatcagaaaattaataatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaagtctaaaaaagttattcctttaactaatcaaaaatcaccattaaatatcttttcataaaaatcaacaaactgaatgataatatgtgattgaataataatataaaattatttacatttaaattaaattctgatgatattacattttttttcctttaaatcaattttacattttaaaaaacaaattaaatttatatccgactactgctgcatatgataggctctaaaagaccatcccattcacatattaatatcttatttatcgttaatgtgtgttctgctagattccagtgaatagtggtggctaataacagtttcttgacctttcgctaacaagcaagcctatctatacatcctccaatttatttatttatttattttttttttttttgaggattgcgtattgctccaatcattttcaaagattagttaacatatcactttctccgacaaaacatacatgcatctaaatggggcaatatgctaaagttttggtgaggctatagcaagtatgaaataaagaattgaagtttcagcccattataaaaaaattagttccttctgaaatgaaaagagcatcaaagaagatatattcagtaaaatctttttcataagaattgatctagatacatcaactttgatgcgttggaaatactgtgctcaaatttgaccctgaaaacttataaatccaaatttggcctacgtagcaagggcctgtggcacattaaatataaatttcattccacacaaaattgcttagttttggaatttcttttcaccacaacagaagctccagacgattatgatttatgaccttatatacttgtcacttatgtttttcgatattagtcatcaataaaagtaattgaatattccatataatataataatatggtaatccaaaaattatacttgtgagttacgccaaagtaagaaacgcctttaattgctaactattaccaacttttttttaaaaagctaatacaagtgacagaagcttaggcctctataatttgaagctgtggcggtggaactcatacttcatgttgctgaaagaaacttgatatttttttttaaggaaaataatatcaatgctcctaagtcctaaactatatgtcttggcagtaaacttaatcttcttgattaattaaaccaaactaaaatttttagggtatatatatttgtaaaaaggagtatggtttaggatatgattaaatactcttttaccaagtaaaattctgcaaatgatttgtgttatgaaaaaaaaatgttgagggtgattagagagttgagaaatgttggtaataaattattgattgatcaaacttacaactttattaaatcatctggaatcattttttatagaattaacatgactattaagataataaatattaacaggtttataggagcattaattaaaaaattaaaaatatagtttattatataaaaataaataaaacttgttctaatcatgtttccttaaataatacttatagttaaattttacacaaaatccataaaattgctacctagctaggtggggaagtatcccacttaaaaatcaataaatattttctctgcgaattaatagttatctttttatctattgtagattttgtttttatcaacaaaacaaatgttagtttatattttttgttaaaaatatcagtaaaaaaatttaagcccattatcttttctcttcttctttcttcatccttccttaagcctcttttttttaaccaccaagctcatctaatacagacttgtttgcaggtgcaactgtatgctcaatccctcccgcttatctccattgctttgcttcttgtctatttttacagatacaaggacaactagtgcaacctattttacaagatccattcatataggccattttgtttagctagattattagttcatcatcatcattctacattttactattcgattcacataaaaaatagaaaacacacacacacacactttaatattaaaacaacttctttgctgtcaataatcaagataaacattgggcaacatttaccttaatttccattgtctatatgatgcaaattcaactttgatatttgtgttaaaaagatattttagataacctgtttacagttacacagtcattatttgaatttctgcgtagaaaacttcaacgcgtgagttttgcacaataattaacatacatatacttttatcgtacgtcccatctcatttttctctaaaaccttttttttcatcaaatttatagttttctcactcttcttttatttttctcttttatctctcttattttcactcgtacacctaaaaatggagtaatatgtttatctctactctaacgcatgcatatttttttacatgacttgaggattttagtattacgtatatattatgataaaataactaaagattgataatctggatagaaaaacttcacacgtctctactctctcgagtaaatggctaaataactaaatccgtccacaaaaatgtaatgtgtagataaattgattgttgatagatgaaaaatataaatttaattttttaatatactttgtaataaattaatcttataaataaataaataaaaattattttctaaattttataatttaatgtcaaattatttttaaaaaatattatttattattaaattagtctttgaacattataacttaatgataaaattgtctcacaaaataatatgattaatttgtcacactttttaaatttttaaaaactaaatttatatttttcatgtgatcaattttttatttcatctcactttaaagacaaattttactctttattcccctataaataatttccaattgtttatcacttttcatcagcacaagctgaggcatgacttcagtacaaccctccctactcgtgttgctgctgcttggagtggtgaaaattaccactcctgtgctagccaatttgaagccacgcttcttctatgcaatacgaggtgatactatgttatcgttgattggttggtctgtttaaactttaaaataagctatatacaaatatttatatatcttcatttggtctttgtaattgtgtaaattttactttttaatccttacataaaaaataatttgttttagtctccatataaattcttttagtttcattttggttccaaccgttaaaaataactttgatatcttaacggttactgacatggtaacaatggaaaactatttatagagagagacatgccaaattttcttgcatgtcaagtttatcaatcttaattaattttgttgttttattttatgcataatattaaaatcccccaactcgataaaaatgtaattgttggtaagtttaatttgtgtgtctctctttggataaaagcgtttatataaccaaatgttgttaacacaagtgatttgatatttgagttttttcattaagatttggatatcgattcaatttctgacttggacatgaataaaaaccggagatatcactttacttaaaaaatttactgacttggtgggagaaagattaaacttcttagttatatatacagaatttttttttttaaaaaaaaactttttatataaatggatattgtaaaataggttgcatttgtatttataaccattacacatgaagcaatggagataagtgggtgggattgagcacttgtacttgctaactcgtttctggtttcaaatgcataaaaattatattcttagcagataaagtatttactactttttatgtgggattattttcctcttaagtagaaattttatggattttgtataaattttagtgatattattatttcaaaatataagtatataccaaacagttaataaaaattatataataaactttattttattaaacatttttttaaaaattatttacgtcactacagcataggcattcaaggtcggttatttggaccatacaaagtcgattttcaaatcgaccttgtctctgactacaacataggcgtacgtttctaaaaataagtaggtgtacatatttcaacgatattgtgtagcccccaagagagaaaaataagagagttattctggtgtttctcctggcctatttcttatatagatatgtgtattctcttatttataagaaagacactgtgtaattattctatttttgtatatttagagagattgtaatgtaatttttcttttttttagatacatgtaattttcttttacttagtaaaaatatttttttaattttatctgtaatttttttcttatacattttgagggttttttcatgttaaaatagagagcaaaaatgttactttattggcactttcatatatctattgtttcaaaaataaattatttaaaaatacattgagagaataatttaaagatattgtatctaatctttatgaagcagtctaaattttaagatattatgtctattcttaattaagtcattctaggagtgctaaaacacaatgggaattgccatcaacaagctaagatcaaacaattcaaatcatacaaataatatggactctacatttaacataaaacttcaagacgttatgtgaaagtacagtatacctctccaccaaccgtcaccaaaaaaattcaaatgaaaagcattgcgataaaatacaatatacttttggacaaattcttttcttttaaaaactcaataccctattatttttaaaatgttaaatgtgaaagtttgggttctttttcagagacatcttggacaaaaagatttccagtaggcaggactacttgaacttacatataaattagactactaatttttcaaattatatatctgaatcaaattggatcaaataacctttttgcacacaaattctcttacacatgcaggaagatgcttccgacagcatgtttgaaaattttgcctcggatcaaaattaagcaagatattcttgggtgggaacttatatatgcttttttttttatacatggagggcccttaaggccgaacttatatgtatgctaatcagtcttaatttgattttgtaaagttgcacccccaagatttgaaaaaacggtatgcgaccgtgcacgaatgaatgcaatttaaaaccttagttgaatgtgccatgcatgtgaagaatatgcacgtatgtcactgttagattaatttaaacaagtacagataaaattatatatgtttaatttttattattttaacgtataaagcgagaagatttaagcacaaagaaaaataaacatatcgtagtcatgcatagataaagccattattaatatataattgacattacaatatatagttgctgaaagggaaattaaagttattccagagaggcatatatagagcttttattttgaagaactattgcaggcaaaggacaaattgtactttccatcttaaaccggtagcttctcatatgaagggtggttggggcttatatattatgaaatggttgtggtagtattcgtaagtgctcatatgtgaatcattacggactgtggggtgcttttgatgatgaaatgaatccagtagtggatttggggggtactgctttgaatgaagacatgatttcagtggttgattttgggggtgctttggatgatgaaatgaattcagtagtggatttggggggtactgctttgaatgaagacatgatttcagtggttgattttgggggtgctttggatgatggcatgaattcagtggtgatttttgggggtgctctggatgaaggcatgaattcagtggtggattttgggggggctcttgatgaaggcatgaacttagtggtggtgagtggtttctcaagatcatggtctggggcaaactcaaaaaatgatggcttgaaattggctagcactggagtagtgagaaccaccactccaagcaacaggagcaacacgagtgggtgtagtacagaagtcatgtctcagcttggaaatcaaaagtgataataatgagaaactatttataggaagagacaaaggaagtttttttgtctaggtcatcaatcttcagttgttttattaaatatatacataatattaaaaaaaaacatttaatcatgtaagaaatgtggtaggtgcgtgtaatttgtgaatatgttgaggattaacttggaatgaattttttttaccaatttagtgcatttttgtttggattaaaattgggagaattgaaaaatatttttgttccatatgtaataatttttttctttcattaaaatatacagtttaatattaaaatttgtaaactactttttataactttaaaccaaatatagatttaagtaattattttattctcttcgtcacgttctttttcctaaaatgaaacattcttttttcacctttcatattctatgtcacattatttatcttttttatttatataacaaaatatcttggtgtccaagtatctatctttatcatataatttattttacctaatatttttaaagcttaattatcacatgctttaaaaaaaggtttaattatcatctaatgttattaattgacttcgttggttatgatcaattccggcaatgggattattattgtgcaaattaaattgacacacgtttaagctttgtacagaagctataaaataggttatcattaattaaataagataaattttaatgaatgtcttaacatcattggttaaagaattagaaggaaaaaaattattgggatacataaaattatgttatatatctataatttttttttacattttcctatattgttcataataaatactttctctttttaattttctaactaatgcacaaacattaattagtgaaactatcaaataacaagttggtgggctagggattaggagggcgagcaaaagttatcaatactcctatggccataattttaaaatccatattgattggtttgatcgtgaattgataatttggtcgagtcggattagatagaagaatagttatgtagtcaattaggtgcaacctagtgtaacctgctaactaagcaaggttgaaccagtgtcctgatcctgatggggctgaatcattgacccaggttggggtcatgtagcgtttttttgaagaaaaaaattacttcaaacgtcattttatcattaatgactaaaataataaagaaagaaaaggcatgcttgcatttaagtgtctcactccttcgaaaactttaaaagattaatctttggcgtcaacaacatttcctcccaccaccttaaagcttatgaattatgatgttttcttattaatttgtcgtcagtcatgatttcttcattttatgtttcctttttggttgtacatttgattttgttgttgtaatgtgattgttgatttggttttcatattatttgttaaatatgatgtgtttaagcaattatttatgttaactgttttagatacttgatattgtaattttatttatgagtagtaatttttttggattttatggtaagagatgtataaactttttattttttaaatattgacaaataatgtggatcaattagaaacttattagttcgatcgttagtttagtgacatagtattttaatttcatctgatcgatttttaaaatcatggctataggaatctcaatcatacacaaagcttcctgaaggaaaaaataatgaattgttgagatacatgcttaaaggctactagcttaattgaataagttgcaggttattttattttatgaggattactggttttattttccttttggttagttcaagaaacataggggtctcacaaatttagaaatgcaaaattagggagatttgttgcattgtgaagaaaacacgcacttagagagctcatgcaaatagtgcagccggttttgttgctgcttgttagttacccacatcttctctttctaactcaaaatggtatatacatcttgtgtatgtgagagttttttttataagtaggaattaaagattttataaaaaattataataattaatgaattctgtttaattaattgaattagaattctttctaagattattattaataaaattatatttattttataagaaaactaataaacaattttttatatgagaaaatcatcatcatagaatgataaactctctttaaatatttaacacaaattatatatgcagctacaggtaatattcctatttgaatcatatagaattaatatcaaagtttcaatagcatattatattttttctgtaagtatttaatgtaattatatatataaaattcaaactcaaaattgattaaattaaaataattcgcccgaacaaattcacaccaagtataaataaataatcagttgaatttgcaccatatagatgacgtaactataaataggtgaatgctacccaaggtttatcttaatttattgacagtaaaaaggttgttttaataaagtgtacatatgtgtgtttctctctaaacaaaacgtttaaatggatattgtaaaatagctaggttacacaagttgtccttgtatttttataaccacttaacatgaagcaattgagaaaagtgggagggattgaccacttgtacttcctaagtcctaacacgtctctagtttcaaatacatgaaaataatattaattattagttattaccagataaatactttacggattttgtgtaaatgttagcataatatgcatgtattatttcaaaaaataagtatcaaatataaataacgaattataattttttatatgacaaactttcatttttactaaacaccttatttttaattttttattaacattcctaaaaaaacccgttaatatttatttttcttattagtcgtattaatttataataaaaaatgatgcaaaagtatttaataaaattgttataaagttcatctaacaataatatattattaacatttttcagatatatctgtaatgttgatccttcgacaccatattctttgtcaatatacatcaatcatgaaactaatctacacacataatgagtaggctattcataaaagatttgtgaggatagtgaaactaacccaaacacgttatcatgagtaggaatgtaggatatagacgtcttacgtttaatcggtacgtaatcgcactgtggcacacaacatgtgtgtgagaaatttttgccaaatttctgcttcacttattatatcggataaattaaagaatgcatccaccttcatatctttcattaagggatataaccgcaggattaattttttgccagttttatgttaaacctattatatcgggtaaagtcaataatacttgaaccttcacatcttccatataccgtaagcacttttggatagattaaaaaagacaaaagaaaatgtgtaagtttatttgggggtaaatgacataatcaactttcattttagtctttatatttaacgaaattaaaaaaaaagttccttatattgatgttaattgctcaaattagttcctaactcattcaaataatatttaaatttgattcttaattgagataattattaattaaattttacttaccacttcagattaatcagactccctactaaaaaaataatctccaaagtggagtatgttagatacctccctcgtggatttcagggacggaaaaaataaagaagagaaaaatcttccttttcaacttttaattattttctctttgtgcattaacaaaagaaaaagaaaaaacacgtcgatggttaatgtggattcgcatccaactttaaattcttttgtctctatcctccctcctagtttcaagcctttcgcatttgggggtgaggaggatccatgagccatggcgcaatgtcgttggacggtgttaagtaacaacgtggaggtagtgaccaatttgagtgagttcatcaatttttggggacttctttttaactttttaaattttgggactagaatatagtgggttataaatttagggaacaatttcacctttactcttgatttggagcaaaaaatggtataaaatatgtaaggacaaatgcaacctcttacacaatttttaaagttctgatagcatttttatacaatttaggctaaattatatatttagtcttttatcttaatttgatttcttatcttttaaaaaaattaaattagtactttatagtttaaatttagattttttttttatcaatttagaattaacatttgttaattattttaacataatcatagttaaaaaacaccatacagttactagacgtgttttcacacatgcgaagaactttaaaaattctgtgctcattttctctcttacggtttcataaatcttaaaattaattgaggagttttgccgccgtgtgtttcaatcaatataattaaaaatcaaatgatttcattaaagtatgtgtaaaaattaaatattttcatgccgcaaattttaagtgtatcttatactttcatattatgaatggtatcgttcttctagatatctatttcgtaactaaaatattatacttttgaaatgtctatttcgtaatacattcaaaagtaattaaaagtatatattcctaaacaccttaggatagttattattcatccataacacctattccataaccaaagtatcgtacttttgggatatcaatataagtattctaaaataccatacagataggtgtaattctttaataacacttattctataactaaaatatcaaacttctagaaaagtctattttgtaatttattaaaaaataattacgcaacaagccatcaaaaataaacaatgaggggtattttagaagtgatacctaaatttttagtgagaagggagtgtaggataagtttttcgggtgccggaggataaggcctacctattatcataggttacaatttgtatttgatccactttaggctgatccgcattaggcccataaccccttttggacagaccagttttaatatttctttaatttacatgtactgatatatagttcttaaattagtttctattctttgtcacaggactataaagttttttttttattattattattgacattattatttaatcactgtgttatttaaataattataccattatacttttcgtttaatgaatagttaaaatagtcttattcatctggtcactgtttatgaaaatgaaataacttttatatttaatttctttcttttgtagtcatgcagttatctttcttaatttatttgaatttttgcatcaaatcaaattaataattttaattagttatccagtcaaagaaaaagttagttttcttaattatttattcaatactcacattccttaatttacatcaagtataatgagatgtttgactttgtaaattattattattatttgacgatcattattattatttgttacaaatatatcattaattaaattaacttttaagatatttttttaaaaaaagttagatgcattttttgcatttctaatttattatttttactactaatctacatatatattaaaactatccaacaccttggcatgtgttggtgctgacagtgctaacctatttttctttcttttacttttttttttcttattctgattgttaacccacacctagttactaataaagcaataagtcaacttttttttttcatgaatgaggagaaaactgtgtaatatgaattttcaagtagccgtaaaaccggtaaaagacacattaaagaaaatcagttggaaagagtcacctaacattattccgcttcaattcccgcactgacaattatcgatgggaattctctgcaatcacatttttgtgactgcttcaaattctggccataaaaattaaattatacattaaatataaaaacaaaatataacttgaaaaattttggtccgttagatgaagactgcataccctgcactgcagttgaaaagggtccgacaattatccgaacagatcttatcgtgcaacagaagcaggcgaaatccaataacaaattactgcaacagtagtattcacaaattcaaattttcgtgtccgtttatatattttttatcactattttttcccagaaggaagttgcatcaaaaccaaaagtaccaaaagcaaaacaaatccgtattttggctacaaacccaaacctaagagagaagattccataggacaattttgtgcctgctgctaaatctcttctttttcacctttgttcctctcctccaagaactcagatcactaccaccagcaacttccccgagtgttgtttttcactttttcttctcaaaatccactctcttcgccagatcttgcttccagtcgttccaggtgcgcgcttctctttctcccctcttctgttatcttttacggtttttagaattcagttttatatattaccctgccatttgcattaatttaattttcgtttggtgttctccgtatttcatgaaaatgtcacatgttttcttaatagtggagcattttggggatatcccctccctggttgcttatacgtcgcttgcggtgattattaggagaaaagcacgtgtgtgtttttcttgcttattgtttattttatttttccaacaatttggggtgtgtgaatgaaaatgcctctataataggagattcaagttgactaactgttgaaattctgggttatatgagaaaaggaaaaattgatgcgactgacgtgtttagattgtgacaaaatgcatccacatgatttataacaaattatgaagctgtttgaatctattttctcattaaggaacataactccttacttacggttctaaacttaacaaatccctgcacaattaatgtaggtcacgtagtactaatgtagtaagactaaaacagtaatagttttgatttctaacgcttcccttcaagttgatgctcactaagatcttcgtctgttacaaataagcacaccaaaagacaatcataaaaatttaatgttttctctatcatgaatagtgctgaagagaggcaggaaagacatcatagcaaacacttgacaggtctgaagagaaacaacaaaacatgatgactgggggttgttgacacttggcagtctgaagagctggtcagaatgttgcatggccaaggaggaagggaaactgatggaaagaggtgctgcagaaatttcttgacaaacaattatacacttcaaggcataagctctccaaattaattagaaacaacattgggaagctcttcatacttcaagaattctagagattcaaaattcaaaaaccttgaatactaaatatggcttgaaaacagctcgtggttggaagagaacacaccccagttgtagggaagcatagccaacaggggtaaaataagtttgcatttaaggcagccccaaagaggccacaactaaggtgggccagagatgactgcaattaaggcagtttttcaacactcctcctcatgttcagggataccggcctggagcatagcaaatgcaagtggcccaacaatagatctaggataggctctggcccaacaatatttttatttctctgatgtttgaataatacagctactgatatatacacaaagaggaatagaaatctgctgtgatgaggaaacaaatcaggaagcaatgaatagcctatctaataataattcagattttattcaaatctgattctaaacacatttattacaaaatattttttatctcatacaatggtgtattttcctcctctttttttttttttttttgaaccattttcttgttccattattaacatgtttagttgttctttgtactttgtacagggactgttttcttataacaagtatctttgcttcttataaggagggtacatgccactggctgactagcgaagaagaacaacccttgtgtatcgttttatgagcatacaattggaaaaccttggatataatggggatcagttctcgaaggtctaatcttcagagatggctaactttgtttatgctgtttttttattaagaaaaattttatctgctatttaacatcagaaagtctgatcgattgacatttgcatcttgttggctgcagttctaccaatagaaaaccaagtgatagtatgaggcttattgtgacaacttttgttggaatagtttttggcttctttataggagtatcatttccatcattgactacaaaggtgctgacttttagcatcttcttgttaggcataccttgtgccttggcaattggtgataaaatgttgttggacttaataatggaactctaatggtgctttaacaatttgcagttgaatctcccatccggcctgcttcccgccattgatatttcttaccttcaagagaaatatgcaggtgtcaatgcaccgtcttttgtgaagaataataacagcatctcatcaaagcatcaattaataaatgatacattgaaggtacacatctcatgtcagccttgtgaacgatattaaagttgctggattcaagttaatttctgtataacttctttcattgagaaggaaaaagatttaatggaataatatagttggaagaggtttcataatctcatcaaagattcatgcacattatttgttgaatgaaggatggtaaagaaagtgggatgagtaagtgggccagatgaatgaagtatattttatcaattgatgttagtttacaattttaaggttttaagaaccatgctttaatgggttgtagtggataggcccttaagattaagtagatggaaacttgagtttttgaggaaatgaggtgctggagttattcatttctgttgttagtcttctgcttcccttttatttatttattttttccaaaggaaatactgctgtagtaacaaactagagtaaaattggctggctttcttttacctagatcttcctttcagtttcagtcatgcaacagttctgagcctaaatttatcatcaagcattgagtaattttattaaattcataaattgtaaagctctctgtctctctctcttgtttttacacacacaaactatttcaccatcaacaatctagagaagttgaaatgtagaaaccaaaattccttatgaacagaaacagggtgcttttattaattgataaaatattgactcaaatgtaaggaagagagtaagaaattactgctagggtgatgttaaaaaattggaaaaataaaataagatcaagcacatagcaacaatcagaatcagaaagactcatgcttcttttgttaacagcttttgagtatgattttgtttacttaatattgggaaaatggtttgttaaaggctcaataacaattgctgcatattttcttgattctctgcattgcagatatgggttccatcaaatccaagaggtgcagaaagattacctcctgagattattgaagctgagacagacttatatttgcgtagattgtggggtcagcccagtgaggtgtgtatcctaaaacaattttgttatttctttttttttttcattctatttttgggagcatctgggggttgaaacatagaaaacatgttctttttgcatgcatagaaaaatacatctaaatacaaattatggtcctgctaatgttgttaataaacttgttaaagaagacttacatgctttcatcagattctttgtttcgatgaaataaactaaatataacaccccaaatccaagattgatataatttgggaaaggatagtgacatagaaaacttatgttgcttgccacgtgcattttttcttctagcttgatttttttttctgtttgtgttattaggccaatctgtaaatttttggactggagaggcctctgatgtttttattgtggtatatcatcgatatacagagtatttgattaagttgctgcttgcaggatttaacatcaaagccaaagtaccttgtgactttcactgttggttataatcagagatataacattgatgcaaatgtgaaaaaggtcatctcttagtttctttttctttctgatgcataagcttgtgtatgactgcatgggtctttaaactagctccattacttgtaacagttctcagagaactttacaatagttctatttcattatgatggccaaacaactgaatgggatgagtttgagtggtcaaagcgggcaattcatgtgagtgtccgcaaacagaccaaatggtaagaatccattgcgctcgatcttggatgacaaattttccttgcaacttttaccattattattgtttgcctaactaaaatcaaaagtgttctgctaattcatctatgttatgatattaagcatttaattgttttccctcctaggtggtatgccaagcggtttctgcatcctgacattctggcaccatatgactatatttttatatgggatgaagacctgggtgttgaacattttaatgcagaagagtgagtatttattatgatacaatacacagtttaattttgatatccatgtaaagttttacactatcatccaattatttgataattcctcattacaagattttgacttttaagttagtttgtcatcatctaacttgtccaatgtggtaatacaagatgtgattagatgatagtgttagaaacttccataattgatagtggatcaaaataaataaataaaatgtatatttatatacgtaaggatttttttttttaattttactcatgaagtttgatatgctctaatttcaatcacagatacttaaaactggtgaagaagcatgggttggagatttcacagcctggtttggaacctaataaaggattgacatggcaaatgacaaagagaagaggtgatcgtgaagttcacaagtaagacaataatccagtgttagttttcttctggtacttattttgttaaagaatgtgtactaactgtttatttttgtgatttctattagagaaacagaggagaaaccaggatggtgcagtgacccccatctgcctccttgtgcagcgtaagtatcagttgaagcattatttttgtcttatcaacccataccaaactgtatcgaattatgttatgcatgcagatttgttgagattatggctccagtgttttcacgagatgcttggcgttgtgtgtggcatatgattcaggttaaatgtttactctttattcttttttaaatatccattggttagttgtttaatgtctgtttatgcactcgttagagtctaacaattaattatgattgtaccattctgggcatttcagaatgatttggtccatggctggggccttgattttgctcttagaaaatgtgttgaggtgagtttgtggtctcattacttaaattcatctaatttcaattttttaattgcaattgctatgctatagaacattaaactaatatctctcactatcatgtagcctgcccatgagaaaattggagttgttgattctcagtggattattcatcaaagtgttccctcactagggaatcaggtaatttgttttccatgattattaatgttagatttaaatagttttactcatattgccgatgtaagatatgatgtttttctttactttgtagggagaatcacaatctgggaaagcgccatggcaaggggtatgttaatgttatgcatgtttcatacagtttgattcgtctctcaaaaattcatatatacaagttttctatgctgtaccgaaccatgaataggcctatatataacatttttcttgcatagttgtttaacattataactcttgatttaatttatcgagaagctgtattacaatggatggagctgttagtttatgcaaatactttgactactaaatatgcatgtctgttgatgaaccatgcatggtgttggtggcaggtgagggagaggtgtaaaagggagtggacaatgttccagagtcggttggcaaatgcagaagacgcatattacaaggccgtgggagttgatatgtttaactcgactactccttagtggggacaacgacggaagttgacttgtacacagccatcaccatagttcgattttgcatgatgtataattttattttatttttgttacttaagtttgtggcactagttacttgcacttataattgagagtcctagctaaggacaaaacaacagttcaatgtgggattccagtgctgatagagaattagataatatataggtaaataaaacttactgtgtaagtagtgtatttgattataatattctttgaggaccttgcaggaaatatgaatgcaatgccaggtataaacaatttggatgtgacaaggaagcgatatacctattggaacggcttcacatcttcgttaaacctctaacaaatcaagttgaaaaaatatattatcaaattagaagtaaaacagaatggaaaaaattaaaatgaaaagataaaaaaaattaatagaaaagatgtgttatttaaatggatagaaataaatgaaaaagtggaaatttttctttttcttatttagattagtgaaaataaataaattgtatacaaattatattaattaaaaaaattaaattttttattttataattcttttctaaacatagaattattattttgcaataaaaaattatttattaaaagccaaaataaaaaaggtaatgtaaataattgagtctaattattatgtataataaagcataaaagttttgatattgtcaattaataaaaaaaattatgataaatatgattcttaaggtaaatgtaaaagttaaaaagcttatcataaataataatttataattagataaaactgtaaaattctattgccaacttttgatgacaacctagaagttttctcatataccagagtgaacaagtaaatcttctttttcatttttttctcaaataaataattaaaaattgatatttctattccattttttttctctgttttattctcaaatgagtcgccaagtgcttttccactatttcgtgtggaatttgaacagaaaatagtattctaccttttcttgtgattgttgtggccatggattattcttttgggtgtggtgtgatttcctggtgtgtgcctttttgaatcattattagttaatatttatttctcaattcaactaacttgttacattatggtaggtgacaagtcaacgaggttccttgaatggtacttttctttgcttcaatggtcctccaagtttgccaatattaaggaggcagatttctcaatcacgtgttggcgcacattttagcgagacctcgacccacgtgccacgaattttaaaaatatttacctaaatgccacgtgggggaaagtatttgccagaatgccacgcggcgtagttcgctacgccccccagcgaactacgcaagctgatgtggcgcgatctgggtggctgcataattcgctacgcagtccagcgaactacgtggctgccccacgggcagtctacgtggcatcgaaacgtagttcgctagcctatccagcgaactaggtgcagcggaattcgaaaaagctgacggttacggccacgtggcgacgccttacatagttcgctcccacccccagcgaactacgccatctggaattcaaaaaaatggccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccaattaatatttgtgtaatgacttacgttagaccaaaatggcacattgccctctcctatacaatgatacatttaccacattgttatgcataaaccacaacatattaacactaaaattactaagtaacacacagttatgcgtttttacctgaaatcggagccacattttgcattccaacaactcccggagagggcatttcaaaagcacgatcaaaatcaccgtctacgtccgtatccgatgagtcactatctggaacaacaccttcatcaacctcttcctcagaactgtccatgggccaagctgggtcgtgggctggggccattcctgtatcttcaaaatcaatttcttgggatggttgggttgctggtggtggttgtggcgatggagacatatctctatcttccagattgaccatcggctctaagttaaggtcaatggatcccatgtttgtagttaattattcactgcttgactgtccaccagaatatacttccgcatacaattctataaatcttgggttttctccatcggatgtgcatgcatcagtaactaaggttacatcttcgtcatctacaacatcaacagcaacccactccacggggtttccagatgcacatctcgcactaagtcgagatatggattgtccccgttgtaagcgtaacttcttgtatatcattctcatcaaatgatcatagctgcatcgcggcggaatacgaaacattttgctttctccttcgaacacttgaccattcgctccaacatatctcctcccattataatatacaatggtgattaaaccattccctctcccactcatttttacaaattcgacactataccaacgaaaaatattctctagtggaaatcgatctcagaacaacatgcaaattgaacaagggctgctgcaattaaataggggggtgtggacaccaagttcgctgggccccatagcgaacatcaagttcgctgggcactatagcgaactctaagttcgctgccctgacaagcgaactctgaaagcgccacgtgtcagcaccctaacgtagttcgctggagggccaagcgaactacgtcacctacttcgctggccttcctagcgaactctgctccgtctgccacgtgtccctgcccgttctgccagggcactgcgccattggtcagagcacgccacatcagcaagcgtagttcgctagggggcgtagcgaactacgccgcgtggcactttggcaaatagttttgcctacgtggcatttcggtaaataatttaaaaattcgtggcactgtggtcgaggtctccattttagctgcctttgcaatgtaaccacaccctgctttccttgaaagatttctcaaacaagcacttggaaataacgtagatatcgtcacaacggaacttctataagaaaaactatacacgtcgattattaaaaaaaaaaaaaaactatacacgtcataagctagacatgaaaataagaaacagcatataccctcaaatgtggctttcgtgtttctgctgtctcatattttagtggattatcaaaaaatactgtatacaatagtatatgtaagagaagcccattgtgaaaaagaaaaaaaaaaaagtcctctccatcaacaattgtactcaaaattaatatataagggttgacgtaattaatatatgtatgtatatgaatatattttaaaaaatatgatggatgattagttaagttttattaacaatctggtaatgttgacataatttattcaagtcgttaagttttattcttatgatttaatggattggttgaatttatacatgaataaattagatgattagagataaacagtagcaatcgccatccgaagttgtacgaatacaatgttaccttttgtaaagttgaaaaagactagaaatcgggttgaaaaaaatgattaaccagttgaatttgttcgtggaattcctgatggtactttttttttaatgtagttcctgatgtcactaaacatttttacccgataaaaatgtaatacaatctctatctatatcttatatataactgtaatacaacctttttaatacatttttcatattggatgaaattcatatagaactcacaaatttagtagttatttaggaaggctattgtaaatttcacttaataataataaatatcgtcttgaaaaaattgtgagttgatacctcaagggagaggatccatcaacaccaacggatctatatggccatgaggatgggtagatgcacctctcatttcaatgaaatcattagtatttgtcctaaaatattatattttatatttagtaattttatattttgtaccccttaattttatgtatttgaatctctttaccaagttcacatataaaaataagtaaatgtaccctcttatttaaaccaccgaccccaattaatttgggttaaaggtgctgttgatgttgatgttgatgttgaccctcttatttaataaatattaatatttatcttaaaatattatattttgtacctcttatatttgtatctgaatctaactattctataatataatgataattataaatttttattttttaaataaattacacccactgactcagggtcttagttctgccactttacagcaaggtttaagtatatttcttattagaaagaaagtgcacttagttttttaattgctaagctctaagctgtagatatatatccttttgtcaaagaaaccgcttaagttacttgcggaggttatttgggcggaaagcacatgcgttacttagtaacggttcagcagtttcaaccttgtgttatttcttgggtcacacttataaggcgtgctttctaggtgttcagactttcccaattgtcactttatatgttggaaaaaactatctcgtgatgatattttacttttccacttggattgtggaagtggaacgaacaccttcattgtggaagcataactaatttcatttgttaatcccactatataaatatttggggtgttattttccaaagtatgatctctttctctcatagcatgtatgtgtgtgttttccttttgttcttctgaatggtaatctggttccatttattaaaccatttagctttcttctttcgactttaaacagggctctattcatttaattagcatctcagtttcttatatggaggaaacaatcagaaaagcttggatataatggtgaaagctactcgcaggtataatatttggcgatagatacttcgtgttgattattatgtttgttcttaagaaattttgtatatgctataatttaagtccacaaatcccttaaactaacataattttgcattttgttgcctgcaatcttactattaggaaaccgaatgaaagtatgaggcatattgtgttactttttgttggaggattttttggcttaattgtaggattatcacttccaccactctcaataacaaaggtgcagagattgaacatcttattcctggtgtaccttatgcttgagagcatatttcatatttattcatgtagttgatgttatttaactttataatggaactctaatggtgcttaacaatttgcagctgaatctaccatacggcctgcttcatctctcttgtgtacaggaaaaatatatagatagcagcaccgcatcccaagatcagtttccaagtgatgcaacaaaggtatgcatctcttcttgtcatccatgagaaggacttgaaaattgtagggtgtacagtgattcaagaaagttaggggaaaaacatattttattcaattatatagttggagtaaaacccataaagtcaagaaaggttcagcagcttataattgagcatcatgcttcaaaagtgattgactttaatttggaaggaattagagattagagatgtttactcccatttagagcttaagtatgatcattaaacactgttattgaaagcagaatgccttgtgaacagaaacagcgttggttaataactgatcaaatcaaatgattgtcagaatatatatggaagaaaacaagatattattagaattttatgtggttatctgacaagagtgaaaaggaaaattaaatatagcagcgtgagatccataaagcctcttgcctcttcttttcctctccatcctcttcttatttgttaatcaattataaaacataattgtcaaaggatttaaccatgatttcacattatgtaatatttgaaaatatgacatgttaaggtctgtatatatgatgataagacatttgctacttgttttcatgattgtctgcagatttgggttccaacaaatccaagaggtgcagaaagattacctcctgggatagtcaatgcagaatcagacttatttttgcgcagattatggggtcttcccagtgaggtgaagtctactacgagagtttatttatgtgctcaatgtagctacacccttcgaatgtaataagaaaaatgcagctaaacacagattaatgtgctgttaaacattatgctaaggttatttaaagagaaaaaggatcatgcactgaaaatgtaaaaagttctatacaatcatccaatcgcaatccaccatatattgtaagtatattgacttttaaattaattatttaagtaattcaaactataatttatgattaaatgacaatgtcagtgcatagacattaaactcttattaaaagtaacaaaaaatttagcttgccacatgtgatatttttctttctagcattattttctgttttttctttattctgttctttatttacttggactaggagtgcctccgatatttttgttgtgtgaggttctccatatacagagagtttgataaaatttccacttgcaggatttaacctttaagccaaagtatcttgtgactttcactgttgggtatgagcagaaaaagaatatcgatgcagctgtgaaaaaggttctctccctttctcttcctatctttctctgcataggtttttggacgcgtgtttaaactagatatgccacttgaacagttttcaaaggacttcacaatcctcctctttcattatgatggccgaacaacggaatgggatgaatttgagtggtcaaaacaggccattcatgtcagtgttcacaaacaaaccaaatggtaaaaattctatgcttaaattttcatgatggcatattttcagttaatattgtttaccaaactttaaatggtttgttatttctttttcctcttaggtggtatgccaagaggtttctacatccagacattgtggcaccatatgactatattttcatgtgggatgaagacctgggggttgagaatttcaatgctgaagagtgagtcttagatatatgatgtatgtgtattttctttaatttttgcttgttaaggaagtttcacttccccactaattccaatcgcagatacctaaaactggtgagaaagcatggcttggagatatcacaacctgccttggaacctagtaaaagtaccaaagcggtgtgttggaatatgacaaggagaagagagcatagtgaaattcacaagtaagagaactacttttcttgtgctgtgttttaatgtgagtgtgttgactgggtatttctttgatttcgactagagaagcaaaggaaccaggaaagtgtaagtaccctcttctgcctccttgtgcagcgtaagtaactgttaaagaattttttattttattttttttttgggaggggggttacaatattttcccatctttaattagctgattccaccattctgtaacatgcaggtttgttgagattatggctccagtgttttcacgaaatgcatggcgctgtgtgtggcatatgattcaggttcaatggttactctattgattttttttcaaatatctcattagttattgagaacaattcttgtatgagcacttcatacctcataaaaatatcagcatgacattgaaataattttagattgttattttaacgtgttttgagattttgatttggttgtgtctagtaaccaattgctcatacttaattgttgatggtttccaaaataagttatgattgtaacacactgctcattgcagaatgaatttgtccatggatggggtcttgattttgcctttagaaaatgtgttgaggtaagcctattacctgatattacttcctatggaactgatatgctatatggaatattaaactgatacttcctatgttatagcctgcccatgagaagattggagttgttgatgctcagtggattgtgcaccaaggtattccctcactagggaatcaggtaattatttttccattatcattattcctattatgtttaatttaattctaattatttcactcaaatgcaactgtatatataatatttatttgtttttgttatcctgtgtggttggtagggagaagcacaaacaactgaaaaaccggcatggcgagcggtaagttatgtatctttcatataatgaagatcattagcacatcctttttaacgtattttttattattgattaaaatttattaaaatctacaaaatcaaaagacccattaaatgaaggatgggacaacctacaaaattatacctaatttctaataaatttgagttgtaaagaatgtgttgctaatattattcttttagtagttgtttaggatcctctttcttgaccacatagctttttgcttctttttttttctcacattagaaactgttacctacattgatcaagaagcagtgtaataatgttttgtttttcttaatgggctttgattcttaaatatgtggtattggtggcaggtgaaggagaggtgtggcatggagtggaggatgttccagggtaggttgactaacgcggaaaagggatattacaagtccaaaggaattgatttttctaatttgctcgttcataattagggggacaccaccaaattcttatacatacatcgccaccgttgtttatgttttcgagatgattattttgacatatattgttttattaatcttgtaagataaagtttggataaattattcaataaacagaagaagacaaaaacaattaagataaacgaaggatttatttaaaaaaaacaaagattttttttacacaattaactaatcgtaaattgttaacttgtctattacaaaatctttcttctttttttttttccggaaatatccaatacaaaatcttgtgcttaggttatatggacttttctattcttttcgtgtggatacatttaagccatcaacaacacatcatgtttatgtccggggaaatttctagattcatttcccaactcccatggttgctgtgggctgtgacaaatgattcatttatttatttatcatttctaccattattatcaataagttcaaatactataactttatgttcgattacaagccagccatattccttgaataaaaattttcttttcttcaatgatactccatctttgaacatattaaaagatggattttttaaatagaatgatgacgcagaaagttcgcaataacactttgctttcctttccttgaacgattttaagcaataaaagaaagtacaatatagtccacaaagaaaagtactaaatatttaattcaactatttatccaagcaagtgttgtaattcagtgggtattccgtattccaaaggcaagagtcttacattatctagttatacattatttatttatttgtttatgtttcaatttgtttttaagaattttaaagtggccagtaaaagtacgggactcccatatattaatttgggccttgtggggcttgatgtaatgcgataatatgcctcacatagaacatctttatctaaaaacaattcacttttccaaaactcctcttctcccttcctttgttcttgggttgaaaaattactcttgccagcaagttcagattttaatatatattgtgcaattactataactgatgcagatggcatcataacatattgcatggttagggatctacgagaaaaataacatatcataaacaacacgtatgaatatgttagagaacactgtttccttaaaatatatttcgaaatctgaagactggtaaaaaaaaaaaactgaagattggcgtatttcggtctaatgataccaaacatgataaactaattaaaatctaaacactgaacatatatacattctgttgagctgaaattttcaaacaggtcctaattaattatttagaaccaattgtacttggaatttatttagaacacaattttatataacgtatcattgcttgttttgcattctttctacataacatgtactgaaatagggggaaatctatagcaacaacccattatcactataagaaaattgaaaggagaggactgaaacaaatacaacacgccatatgagtgtgaggccttggtgcatttatttaggtgaaataaaaagaaaaaaacagtaaaacccctgagtagtagtacttcagttgtagattatttatgatttatgatatgagatgtgggtaatatggctacgagtcaatttgatgccattttaaaaggggagctacaaaaattgagggatgaattattcgtaaaactttattataaaagtctcaccccaaaatcttttaaccattttaagggtaccccaaattaaccatacacaatatgtaacaatgcacataatgcccctatgatataataatagaaatagctatttatatacaacagaggctcatcaggcaccccttgttgacatgagcctggctaattccatcctcgtatgctcagactgaataaatgcctcagcttcttggtccacacttttgtaagcactatgattccataacctggtactttcgtaaccttgttcacgagcctcaacgttggattctacttcggctatagagtcctgctcatagttggttctgaatgccatatgacccttcttgtgatgatgatgcctaggactatgatatgtagcctccactggggggtcgtacacttggtactcgtcagaggggaatcgccaccctttgttgttgttcctattgtagttttggtatgccatttctaattataactttgagggtgttgagctaggttgtggtgttgcttcatcttaatttcagctaatatttatagtttttattattccatgatgataagaaagaatttaattcttctctctcttcggcatgcaaaaggatattcggaggaggagatttatttgatatttgtgcatggagctagcatccaattcggtatttttcttattgttcaaagattccaacgccaccatcatttaacgagacctcgacccccgtgccacagattttttaaatattttccaaaaggccacgggggttaaactaatttccagactgccacgcgacctatttcgctaggcaacccagcgaaataggttggctgaggtggcgccttcctgatggccacctatttcgctatactcaacagcgaaataggtagctgcccaacggtcagctgatgtggcgtgacctatttcgctggacccagtagcgaaataggcacgcagtaacccaagaagcggggccgttagtgccacgtgtcaacgctggacctatttcgctggggtgggtagcgaaatagaccacgtggtccagcataaataccccaccccggtgctggtccccccctcccttccctccttccaaattttaaattcttcttctctcttttggcttcttctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatatttttgtccaagtattttgaccaaaaaaatttaataattataatgatattaaatgtcatgagtattagaaaaatatgtaaaaaataaaggtaaaaaatttaataattataattatattattttcattgtggacatttatttatcgcctaagtttgtcatggacgtcgttggtaaatttatttagttctttttgtataatttgttagtaaatttaaatattaaaatttaaagaatttttaaaattatcaaaattttgacaatagcatcgccttgtaatatatgaaatggatattgcaatttgcatgaatagagtaaaagttgcaaaccataaaatattggcacgcaaaccaccatattaattgtaatttaaaaaaaatcaaaaatacagttttttgaaaactaattacagaagtatggtttgttcttgttgttgttattgcgtggagggctcaggttgagagtgacaattgttattattattgttgttgttgttgttgattttgaacatgtatctgatgaagcctgcgaaagatgatcggatttgggtgtcgacgattttcttgagaatgcgaagcgatcgttcctgtcccacggcggcgaacaggcggcaggtgtcagaatggagcggaggctggttctggtcgcggcagatgctctcgatcagagactcgaccgagggcggaagaataacgacatcacagtggttgtggttttctgccatgagaagaagagtgaatacttaccaagaaagtgacgagagtgagtgaatcatttcgtgcttatcttttttttttcattctgaaacttaaaagtactagataaagtcacatttacgcacccttttttggtgtgttatttaaaataatacaacaattttccaaagaccattctcactcgctgcaatgacagctgacaagacaatgacaaacagcagacctcacttcactcactactcgtttaaatgaataagaccttgaaggacagaacaataccgtttcaaggtgcattgagtgtggacgtgattaattaatctctgctgtttcaaggtgacagagacacccccgtctctttcaagacaacactttgtggtcttctatactgtagccaataagtgcgtctgatttgtaaaatgacattgacaacaccggggacgattgacaacacgttgtggtcctttttactgtagacattaaatttcactggtctgtcatgtgacattgacaacacaaccacgacagctgtttgctcacgccccatccaggcgcaagtggtgaccccccacacagtcagggcttaacacggttatatataccccacagtggtgtttaatcatccacacagcaaaccttcgcaaccgaaagtcaacctcaatacgatggccttcttaggtgaaacctgctctcaaaatattggtaattccaaattagcgtttatttttccgaatggatcaatcttacagaatgaaactggtgtttctttcgtatgtcatactccgataccaatgcgaattcccgatgagtgttcctttcagtcactcaagagtagaatgcacaacacccttctgctaacaaatgaccagtctgtggatgaaatttactatcgacaaccatccattaatacataacgatttttttttccattcactgcaattgaaaaatgatgatgatgtttgcactatgttggtgtgccatgaaaaactcccatctgttggtcctatcgaattgttatgtatgataaccagaacacccgatggtgtcctcaacctacttcgagccaccatgactcctactcatgatgcactgttgtattacaacggcaagtggaacataccacgaaaaggcaattttttgggttactcgtttactggaaaaaatccagtaagatttcaaattccttcaggatgcaatatggaaacactcaagcatataatcaagcaagttgcgccggtaggagttcccccttatggaattcacgaatcacaggttgtcaaacaagtgttcttcagacaaccaggtcacgcaaaatattcagaaaacatggtcgagtatgaaatagtaaaactgcaaaatgatgaagatgtactgaaggtgttggcagaatcaaattactggaagcgtttctctccaatagaaattttagcaagttttaacaaaccggtaatcgaagtactggaagatgacatgtccgctgcacaagaccatccaaattatgattagtttcgtcattttcatgtttgaattgttgttgttagtaggtttcgttgttttgctttttcaatgttcaagtttttgtgtttatctttgtagttccaattgtttgtacgggctgttattttattaggtttccatcactatgttaccgttaatgtcaattgcattttgatgtttgaaattcatcgtaccgtatatcaatttcacatgactgatcaacacttagctcataaaacttacgttataataagtaactatgtctaacctaagtcaataacaattttctacatcaatatcaaatctctaagacaacaacacagtatatttcatgtaatctaacaataatacgttcaatcaacactaacttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggacccagcgaaataggccgcgtggcattctggcaaatattttggccctcgtggcctttaagtaaatatttaaaaaaatggtggcgctttggtcgaggtctctcatttaaccaactttaatttgttcctagatagcgcaactcggatgaaattcgattcgtacaaaagtttatatatatatatatatatatatatatatatatatatatatatcccgctttcatgtgcaatttggaattttattttagtggcatgaccaacacttcagaaactgacgtctgtaatagttcattatttattaacaccttgcagatctaagttaattataaattgaaacaaaatagttattcaatgtccacagtcatgtatctctctggttatattccttataatttttttttgaaaagatagagtgggataaaaaagaagctaagaaaaagagttttaatctcaatattttactttaaaaaaaactgaaaagaaaataaaaagtgtatatataaaacatagtaaaaacgtgtagagataagatctcatgcaattgtataataattggagatgctcctaatctatagaggacgacttaacaacgtcaaaaaaaaaggatgacttaattaaaaaataataatgaaaggataaaataattttttactaactgtaaatatataaaagtaaatagtctttcacttttttgaaaatgtggaaagttgatcagtttgatgtatttcgttaattattgaatttttattaagcagtcaaggatcaaagcctataatcacaaggcaacaaagttatctatgaatcatgaatgtaattttcttttaaagtcatattagaacgtcactattaatctccatttctatattcaccacgaaaggagtggaagaaaaaaagttaaatttgattcctaatttgcggaggaaattaaatggcatattaatattccttttctcaactacaaagcatttgggttggacccgtaattggttaatcttcttgttagcttttgtgttgggccttaacccctccttagttctgaaaaatatattcaaaagtgttgcacctaaatggactagtaaaagccagattaaactagttggtttgaccagttggacaattggtccctcatctggccagaatgacccttggaattagtcctcataaaactagccaaataatcagtgaactagtcaatgaatgtgaaaattgaccagaactggggttcatcaattttattcttctatccaaattccaaagtaaaaccttttcctaaactctgatagaggcaagcttttaggttcctttagaggataatggaggataaatgctagtggacgttggctaagtgacatgagtcatatgttgaccaaagaaatcaatgaagaatgaaagaggttttatgggaatgggaggaagaagatttcagtagctgaatcatgttgtgtgtgaatgttgtagagcttatggttcccaagatctaagagtgattgaatgtcctatattcttagggatcgaagaatgcctatttgggcttcatattaaggagctcggaagaatagacaatggttggatcactattgaatccttcactaattgtctaattcaatagctagtctagttttataaacatggcttaaatcaatagttaacctattaattataacttctattcgtataacaaactcattacctttttggtacatttgtttcttttttttggtacaacaaactcattatttaattataaattatattaatgaaataaatataattaattttctcttataatatgagttaaagaactcatcttagaaagtgaaattgtcaccctccccactctcaatcaaacatacttaatattcgctttttcccttctttagaaaattgtaataggaaacttaccatcgaccctatataaaatgaaaagaaccctaagggaaactgaaccaatatcaagtccgacacgatttggttttcaacaaaagaacttcattgatgatacatgcacatgtcttattgttaactggttaaaattagtctaatagaaggactttagaattagaagataacatgaataagcgctaaatcacaagctatctaaaccatcgtctaacgaaagacctcagtaaatagcacatccccacgctttattgcatattgtctaaatcagtcaaataattttatagagcaaaatcaatgttggcagattccaacagattccaaataggaaattaccattctacagagggaaacggaaataagataaaataaagcaacatatgtcgcgcccgattaatatcacatattggaacggcatccaattgaaagtaaccaaactaaatttatgtaatgcaaagaactgagtcagcactgttatgaatatagaccaaccccaatcggattagatatttagcataaataaagaataataagaaaataaattggtctgcagaacaaaacttcccaaacaggaaaaagtggggaattttaaactactctcgtatatcggggatcaatcacactaataccaaataaacacatttcatgaaggcaaacccgttctcaaaacagcagtttcagtcctcataagtagagatgttgctccccttgaatgaaactccagctctaaattatatacagaactccccctagatcaaagaatttatctgaaattaaataattcccaaagaatatctcactggacaatgatacagctatacgagtgacacacaatcatcacaacctcagttaaaaacctccgagagaggagagtcacttgagctgtacaagctacaagctcagaaacaatgcagtatcataaatgactttcctagatcatctctctctcttgcaatttccaggtaaaagaaatttatacttctcagaattttccagaagaaaagcaggaagatgaactgcagaataggaatggggtattggtcccattttaccaatgatatccctgaaagtgtactcctccggcagcatatcaaataaatcggtccctttgcagattaccttctgaattctttcaggatttaaatagtgagagaacctgactctatcataatggctgtaggctttcatcttgaaaatgaaatcacggatttggcggaagcaaaagctacaatgccagccagcatctgccaatatgtcatcagactggcgataatgtgcatacctcgtcttaccagtctcatacctgtgaattgaagccctccagctcttatcatccacatgaaattcaaatgaatagagataatttttcagctgcagatgaaggattgagggtacttcatcacaccacctcaggaggttaatagtgtgagcacttgatatctcatccacatcagacataatcaacaagtcatcatcagtaataccagctatcttcaggagctggtccaatgctacacgctgatatgcctcttcaacaaatgggttttctcctttcttaaatctcccaccaatggtcccataagttaaccgcggctcaacaaatttgaactgctccctgttgctactgaaaaccagaggcttaggcaatccggtgaaggtggaatttgactcaaggacaacaaattcagttatgtaagggtacaattctttccagcgcaaggttagtatttccaactcattgctaaacaacacagcatcataaacacgtcgagggtactcccggactccccatccatgaagcctgcaaagattctccatggtgacattttcgttatagtaatgagggatgacattgaaaggcttgggtgctttttcccatagtggccgcagaaagtaggagatcttttgcccatgtatatagaatccaaagacacacattgggataatagcaaacatgaatatataggttttcacatccagaccacgcagaatgcagcgaattcgtgacatgcctgatacttgacttgattcctgcaaaattaaggaacaaacatataagtaaactgtaaaaatccagcttcaagaatgaaaaatcatgaaataaatatcatatgcagcttcattaaatcatacacaatcttatcaaaaacccaatgctcctctctctattgatgaaaattttcaagcatcatataacttaaatccccaattgtaatcataaagccaaaagctgtatcatgaagaaaaaagaaaccatgcccccaaaaaaccccaaattgcaagctcttcatgcgagaaaccttgcacccattcaaatccaattatggctacaacataaacgaaacccctttccctcccaaatgaatcccccaaaaaataggaacaagaaggaaagaaaaaaaaaaaaggtgtcttcgtttgcgttcacttacaagccaaaaaaaatagctcagcgggtttcctaaaattagagaaaataataataataataataataacaacataaaaaacgcaaccttatcccatacctaaattcagatctcgaaaatctcgttcacacaccaaaaaaaaaaattaaaaatagcacacaacaaacaacacctaaaaagagcaaatctaggacaaaagtttcatcacaatccagtgatagattacatgacaaaccacatcaacagttttctatggaaaaaccattcaaaatgactttttttttcctccaaaataacgaaatccaaaaattaaataggcgaagccacagctgaaagattaacttacatcgacaccacataaacggaaaagtaacatttaataaaaaaatattatggatgatatacctgaccacagacattggagcacaaatcatcgctcttcttagaacagtaattgcctccagtctcgctcatcatccaccacatttcgacgtgtctttcacagtccaacgtacgaatgaatcaaaacaaaaccagatcgtgaacacaaagtcgcaaaacgaatcggcgtttgaaattttagtgttaagcaaagaaacacgttgtcgttaaaacacagcagaggaaacaaaatccgaggtggtttatatgtttattcacacgaagagagtataggacggaacaaacaacgaggaaaagtaattagtaaatagcctctctgtatgttggaatgggtggcagttgtcgtctccacacagctagctatggaactgataaaaaaaaaaaaaagagagagaaaaagttccgttacaagattggtgattccactttctctatcccaatttctttctttataacttaactaataaataaagtcttgacctctacttttactgagtctctcttctccacgcgttgttgtgtgtattgagtattgactcgctcgggacaactggttcagttctctgctaatacgtgttattatttcatctaaaaaaaaaaaagctatgataagccgcataccccaacggcccccacaacatcagcggccggacaccaatgtgaggatgtaaattggactataatcacagtctagcaaacaagaaatggagttccgttgcctcttgtgaggtgttgaacccggatcttacccctggtatcactcatctaatctattacggaaacaagagggtatttattcgcttggcattttcatattttccataccacactacacgtggcagccagcgaatgtgtgcccggttttgcttttttatattcaacacaaaatattcgttacacaaacaaacactttctcagtatccaaaaaaataaaacactttctctgtttcacttcttttttatacattgtttttgttgctacaacttttccaatcatactatttattgttaattattaaaatttatataaaaaaaaatacataactcttaatataaagtaaaacttgccaacaaaatcttgttacggacttagttgttggtggtcgtttcttaatgagttgacaggctcaatttacttaaattttattatataaaaaaagaaacctgtaaattatgtaatttttaataattttaataccatcaaccatataggtcttttcttatagatttattgatctcaagactatttttaaaattatttcattacttttaataaaaataattttaattattttataattttcataatgagttgttttaatatatgtgaaataattaaaaaaaaaggcactaagatgtttatctagatgtggtactagaatcctaagttagaaaagacaatcatttaaaaaaaataagattattaattattatcatgaaaaaagtataaaaaaaattaaggacacgaaatttaaatatataaaattgagaaatcaaaatatagatatttaaatatttatatgtaatttttaaaaataagggatgcaaatacatctctttattcatatatgaattgtcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattattttataattttcataatgagttgttttaatatatgtgaaataattaaaaaaaaagtactaagatgtttatctagatgtggttctagaatcctaagttacaaaagacaatcatttaaaataataagattattaattattatcatgaaaaaaagtaaaaaaacttaaggacactaaatttaaatatataaaattaggaaaacaaaatatagatatttaaatatttatatgtaattttttaaaagtaagggttgcaaatacatctctttattcatatatgaattgtcatttcatgaatagatttttacatataaaaaataataacttaaatatttttttagttttttgtaatttaacgatttcttacatttagttcctgtaaaattatgtttttgtttttaatttttatagatatatttttctgtttttcattcctgtgatgtttcagatagtttttttattgatcaaattcctatttaaaatgttttaagtactaaaaacaaaaaataattttgcaataattctaaaagaaaaaaatacaaaattgtaagaaaaaataatgaaaaaggtgttatattcgaaactcgaaagaatgaagaaagtatacaagcgacatttgtcttggttacattacacttgatgatcaaaacaaagagtattgttagaggaggttgtaaaagaaagcggcaaaggtcgattttttgttatgttattgtttagtgtgtgctggaacagtccaatacaacactgccaccatgaaggttgtgatgatattaaagatgttttatttgggagcattaagttaagctaactataattaattaatgactaatgacaattatgtatggggaagaggaccacgttaggagtgggcccgtttagcaatgatatggccccccaccacgagcttgtcgccgttggctcgtctcgctagtttttaagcaagcctcccttttttctaataaaattattattattcattatgtctgtttagatataactgtttgatagttttttatgagaaatataaaaaaaaaaaaaaatcataacaaaaactctcaaaaattacttttaactttggatggtataacatggacatgttaactaatgtattcttcctttaacccaaacattcacactacaatgctcaacactgggctgagactaactgcctcaacttgtccaaagtcttcttctctagcctcctttccaagagcatgatcgccctccgatttgagttcggtgagcccaccttccacccccacatcactgttgttggagccatcaaaacacccccgacaaagccctcaccaagcttcgatcagcgtgtgaagccctcaggcccttccacattatcgtcaacggcgttgccgttgacaccttcttctactagtgcctctatctcctcctctgccccgaccctcaccttcacgaaactagcgcatactatagggaatctcgatggtgtcattgtctttaagaagcgaggtgaaggttattgcaacggcgaggcaccgatggaaaacaggattaaggacgccgtggatgagaaaggggagcccttggtcttgtaggttagggtttgggtctagagcatggccaaatgcagtcctattcaatacgaattgggacccaatatactgttgccgtcgccagcgacagtgacaatgacaacaacggctgcacctaatcggcgagaaagtcgtgttttctattttaggggttttgattttggatctcaatttgttgtttggattttgggtctgtttgcaagtctgattgaggttgcaagagggagtagaggcgacgaatattaagggattcacagtggtttggaggtaagggcgatttgttgaggtccatggtgtgtctggttgacgatggatttgagattttgcagaggttcagagtgggggtggtttgctacagacatagtatatctttctatagttatcaaacataattcagttgattttttatttattagtgaaaatgagtaatgatctattgattttcagttgatgtgggttcttggtatgattcagttctctctggttgaaagcagaagcaacagcaaaagagtgaagacgtttaaagaataacacgtttgtgggtagggatagaaataagccaggtcatctattaggggtctttggtctgacctgtttaaggcctaggtctaacttgtttattataaagatcagacttaggttttttgaaaagtctatttaaataaaaaggtcggattcaagctttacaaaaagcctattaggcctgtcatgctagtttatacatatttttttttacaaacctactacaaagatttcaaatcttttttattttaatatttatttatctatatatatatatatattaaaactaaaaaatatataaatcaatctttaactgagtttgttgtgattagtgaattttaatctcatattagagtgctttaattaattttaatttttttcacccacaaattaaaagggaagtatgtcaatgtgtgtatttctttatattaaattaaaaaaagtattatgcgaattctcgaagtttcactaatatataatatttattgtaaaatagactttttaataggcttgtaggtcaagtcagatttttaaatagactagaccaagcctaaaaaaaaaaagcctctaacaggtaaatagattaggcaggcttgatgtttttaaataaggccaaggttaggcctaatcgagcctgtcctatttccattcctatttgtaggggcatggacaagggtataatgggtaataagaattttaattagaagaaaggggggcttgcttagaaattagggaggcttatttagcaagatcttaccatttggtttgcttcgttcgaaagtaggcttgccctcgaaccgccagccaagtcacagtacgctttaaccaaccgacgtcttcttgcaaaaggcccaatactttattattattattatcgagaattaccaatgtgattcccaaaaaatacacaagaatcattgatgcagaatatcttaatcaactgcaaaaaaaaaaacaactaaattctatctaaactagaatatctttcctaaattgtatattttttttccttttcattgtcgttttgcaatttggtctccctttgttttaaaaaagagtggccttcacatataatgtttaacgaaaatatttacatatttgtacaataaagtatcacgtcaataaataaattaaaactgctctataaaaagttcatcaacaataaaatattgtcactaaaaataatttaaaaaaaatggagctctattacaagctactaattaccaactaagactcaaaatttaacagttttgtacttgtcacgtgttagaaatcatcttatattttatcgaaaataaatcaacttatttaataatttttaatctcgtgaccatttataattaaataaaaatcaaaaaatatttactaaatcaatatattttaattaaattatgttttaaactacaccctatgtttacttttatccttccaaattgggtaaggatgaaacaacttacaaattatatggatttgtttggcacttgtaaacaaaaatcttattcttgaacttaatacatataggcacgttattgttggtctcatccatgatgtcgatatagaaattaacatgttgagccacttgaatgcgaggctaaaggaaaaaaaatatattaatgagttagaaatataagttttatagacgaaaatattacatcatttgcggtacactcttctcttcttttttaccgattaattgtaacccaactatttattaatagcatatagcttacccagtggattaataactttacagcctttacagcacttgtataatagtattaacggactgcgtattatattccaatatcatccccttcagatatccgacaatgcaaatggcataacaattatacactatacatgtgggaaaccgtggaacgattccacctagcgaattgacaattaacgagtctaccacgatcaatatcggaacaacttactgatttgaatagctctatttacaatatttaaatgatcattgagttggttcaacattgatggtatactttatgagtgaggaaataagcttgatggtatactttatgagtgaggatataagcttccttgtctggggtcaaaggttgtttatccaaaatattctagggttaaaggtttttatccaaaaaaatttagtgtgtaatttgtgttttttaagctagtgttaggattttatttcactttgtgtttcaatacattttttggattttcaactataattttttcatgattttattattatttatgttctttagggatatgattaggagtgaatagattggactatgtcgaatcttatttaagtctgatctgatctactttatacttttataagttaatcttgggtttattatttgtcatggatttgtttttttggtctagtcctaatctctctataagtctaatttaatctattagcttatttaaatgcatgtttcatgttaaaaagtgtaaaaaaaattattgtataataataaaattattaaacgttaaactattaaagtgtgaaccaactatttatatgttatttccatttactttttgtttatttaacaaagttgtaaatttcattaaaaataataaaataattttaaactaaaagatgtgacaaaaacttatctaatgcctataaatattacacatgaatgtcatcaaaactttttaagccccaccaaaaaaaaataatctctatttctgctacccatatatgcatatagcaattaatctataccaaacattaaattcaatcatcaaatcactaaaataattttgtaatttttttgaaataattatgatattatatcatattaataataataatatctttattaaaataatattgttgctaattaggctcaatccatcaagcttaataagttnnnnnnnnnncgattccacctagcgaattgacaattaacgagtctaccacgatcaatatcggaacaacttactaatttgcatagctcaatttacaatatttaaatgatcgttgagttggttcaacattgatggtatactttatgagtgaggatataagcttccttgtctggcgttaacggttgtttatccaaaatattctagggttaaaggtttttatccaaaatattttagtttgtaatttgtcttttttaagttaatgttaggattttatttcactttgtgcttcagtacattttttggattttcaataatagttttttcataacatgattttattgttatttatgatttttacggatatgattaggagtgaatggattagactatgacagatcttagatcttatttaaatctgatctgatctactttatacttctataacttaatcttggatttatcatttgtcatgggtttgtttttttggtttggtcctaatctctctataagtctgatttaatctattagcttatttaaatacatgtttcatgttaagaagtgtaaaaaaaaaaatattgtataataataaaattattaagcattgaactattaaagtgtgaaccaactacttatatgttattttcatttactttttggtttatttaacaaagtaataaattttcattaaaaataataaaacaattttaaactaaaagatgtgacaaaaacttatctaatgtctataaacattacatatgacatgtcatcaaaactttttaagccccaccaaaagaaaatagcctctatttctgctacccatctatgcatatagcaattaatctataccaaacattaaattcaatcatcaaatcattaaaataattttgtaatttttttgaaataattataagattatatatcatattaataataatatcttaattaaaataatattgttgctaattaggctcaatccatcaagcttaataagttttctttttaagtttatggccttacctatttaattaaaaaaggtttttttaaaagctcgtgacaaaaaataatataaaagggatatattattagttacaagggtatatttatcgatacccattaaacaaaacctttcattttgatggaccattaatatttgtatttaacccatcacgacttacatatgacacttatattctatgcgttcttaattgcatcttgcatcttccatttttaaaaaatccccagcctaccctttctattttctcccccttattccttttctttctcacgcaaactcttctatttgttcttctcttcttcccgcggtgcactcgcttaacagttcttctcttcttctccaaccgaattcttcttccaactctcgacaccataggttctagcgcagaagtccatcccctccttcaactctccacgccaggtacatttcaacatcaccgttgtggacatttttccagagctggctttttggaacggtttttttgttttcaaaataaccattcggaaaaaggttttccaaaacacctattatggaagcaattcctttccaaaaagcttattttggattttttttttcatccaaaaatgccctgtcaggaacaccttaccaaaagccaaaaaaccattccagaaatcctgttccaaagtgcacttgtttcttctagagtgggcttttcataagcccagtaataccttccaaaacaccctttttgtatatctcattcctaaaatttttgctttcaaaatgaccgttttgtaaaaaggttttctaaaagcttatcctttccagaaagcctgttctagaatgtacttgttgcttccgggaaagactttcttaaataccttttcatgcttatgaaaatgctattctgaaatcattttttggatacggaatggtccttctagctgtttaatagataattaaatttgatttgttattttatagttttagtttgtatggaagatgattacttcaacaaaagatgttggttgaagttgacatggatatgaataataaataaaaaaagttatttttggataagaattaaaacaactacaatgaacattgtaatcattttgagagaagagagtgattgcactaaaatattattgacaacattacaaatcaaaaaaaattaaaggtactaataaaacaagctgtcacaacaaagaaaaatgacaattagagaatgatgtcataaataatatgtgtcttcttttatccagatgaatggaagttattcaaatttgaatccacaaaaaaaaaaaattgtgagaaataatcttaaataaaatttaaaagaacctgaaaagttttaaaaaatatataaataaatctatttcaagatttaaataatctgttaattagcgttcaagaacagatatttcaaaatggttattccattaaacaaatatagaattgaaacccagtttaagaagcatatcacagagatagttccagtcaaggcgatcatatgccttatttatgtcaatttttaaggcaacatctcctttctcacctccctttttacaatttgaacattaaatggatactaaaatcgtagtatattatattaatttattttatcttatctaatacagtgtgtgaactaggctcttaatgtgattattttaggataagaaccatgtgatgaaaaaaatatattaaaggacaacgtattattaattattatttttattgtaaacggatgtatctttattatgacaatcacgtacaagaggttccatggagctagatgggctccatcgatatgcttttgatggtttgcagatagctccatttcactgtatagaatgggcctacaaatgaacgggctaactagtaagtcacattcctaactccgtggatgctttcgaataaataacggggagccggatatgtatcctcacaaatgtggcttgcatattgatctttgcttaatagatggaaagtgaattcttattaatgccctaataaataacatatcacgcatgttttggctacagttttttgtatttgttatccgtacatttaacatgcttaaaactaatgatggtgtgagtgataacttaacatctttgcttattggaatcttgtgcagtctaattatgattacgaagaatatgtttggtttaaaatttgtaaagtatactttcatttccttctcctttaaactgagtttgaaggtaaaattgaagaaaaactcagtttacagtcagactcgaatctaaatcaaacaaaataatctttcagctgtactttttaacagatgttcaaaactcttaatataaacacaacgcacacacgtctcgtcgccctagcttcttttaggcctcaatagtgttcactgttcaatggccagattctggtatattccgtataacatatccaatcggaccaatcctatatcttgaacacttcgaccacgcccatgaagcatggtccatggaattatggttggtggcactttataatgcctatttatttcataaccatctgaatggtataacacactagctaacaccagtcatgttgtgctgtgctattgtctttatttttcagctggggtagcctatttatttatgacaatttaaaagatagatacaacctcaccttcaaggcatacggagtagaagggagaaagaaaaattaaaagatgaaaatataattaataatgtgatattacgatagagataaaaagaaaaataagatataaagaaactgataaatgcacgaatgtatagttatttttatttatttatactggttcgttgcatattgcggggttcctgaagttacaactcattttgttaggcttacgttaacaagttggtagtcacaactcacaactcaactcatgttatgccccttctaatcaattaaaaacaagaagatatctttggatctagagtgcacctgcggctcccaatgaaagattcctctcgaatactactacttatcattttcctctatatgtattattttgattgaacacaacacaaggcagcaattcagttccttatcacaaaccttacaataattaaaatcacatgcaatcctaattacaaaaaacctatccccaacccccccgtattcctaattacattgacataaaaatgttaaatcaacctcccggaggaaaagctgagaaagtcacgagaattgagaagccgagcagaaaagcgatccgattcactgacccttaattttatagtttcccttcgcaacttaccctcttctctatacacctgaatccctgctttgtccttaacctctctaaccaaatcccacaatctaagttctcttgccccatccatcatctcttggcacggctccaacctcttcaaacaacaaatcaattccaccgcttccccaaacttaaaccctcccaacctctccttaaactcactcaccctcacgcgcacctcaacttgcaccacgccccaatcctcacgcgccaggttcacaatctcctccactaacctgttcccgttgggctcgggcctcttgcaaatcccttccaccaaagtcaccaaggagtcaaaatcggtcaacaagtccacgttggccagacccgacaccctgtcttcgctgtcggtcgaggttccgaggaagaatcccaggatcctggaagtgcataagagctgctcgatgtgctgcgcgaaccatctgacccaggacgagagttcccatgatgtcgggtcggtgttgtgtcggaagttggagaggttgaggtagtttctgcccccagcggaggggtacacggagagctggtcctggaggatgaagctgccgtggtggatgatgtggtggacggcgatcaggcacttcagggccacggcagcgttgttggtcccctgaagccggtccatcaggacctccacggcggccgaggcggtggcgcgtgagccgtcgcccaaggagaggagcgtggccaggtgcttgcgcgtggggggcgtggaggaatcgtggctcgtggcgcgtaggagggagagcgtggtgcgtttggataacaacgccgccttgctctgcgatgctttgtccttgattatcccaattagatgcgtgagttttgtcatgtttatgtggcgtgcttaaagataaacacatttacacagacactactcgcgcatgaaaatttttatggtggaaaatggaattaaagcccaacccaatctagtcagctgtcttggcttggccctagtgggatatatgattatgaaatgatgttgccttctcagctataatgcccagccagatttttattttatttttatgcgttgttcaaatttgcgcatgttcaatcgagtggttgatgacttgatggctctagaacagtgcatatatacacacttaagttttccattttctttttcttaaccctcgatcgataaatgaatcatcattaatacaaaatttaattagaaaataaatatagtctaattcaaaattaattttaacaaaaattacttgtattcaatcacttaattacttacatacatattatattgaatattaatttttattttttataattaaatttattacttcttttaaacttatatataaacaaaaataactaatatcatatcaattaagaaatttaattgatattatttaattttttaatctcagtaaaaaaataaaattatttttaaaatattttttatcatgaatattttttttatattaaaaatagaattaaaatcatatgaatgatattttaagaatgataatattaaatatgataaaattagttaaaaatttatttatatttaaattaaacatatttattacttatatgtttcgaatatatatttttaatatttatagtcgtcttttttttctctttttgataaatggggatagtgattttcttttttaacgggatactttttttttgacatgttttgataggatacttaattattagcactattgttttttttaggaactagtaagtaaccgtgcataatgtatagataaaaatccaatgcaaaatacttaaaattaatgagttaactacatatacgtgtttggttacctatcatttacacacttagcttatgaattcaaccattctttttaaccgtgttagatcacactagttaaaaacaaataaattaaataataataaattaatgattaatatttatgattattataattgtaaatgcttttttaagaattataattgcgagtgataattttgaaagtatttgaccaattgttttaattttatgaattaaattaattagaacttagaattttagatgttatcttctcgttttataatttttaggaaacaattaaaacgaacaatattataatttctgaaactaaattgatgattactctacaataatagtactttctaaattaacatcccaaattaaataacttgcttcccaacttcctccagagtttacaggtccataacgggtatatttgccttttattttcttttctatctttccataacttgccatgagtttctggggaaaaaattgccacgagtctaatattatttttttaacaacatttaccatgcagcttcgagaggtcacacagtacgtaatatgttattgtattgctttggtattgaaatttatgacctgttgattttgatattgaaaattggatattggatagtagattaaaaaaaatgtaacgaggaaagagaaacagttgaccagtagtttcttgactttcttctaaaactaatctaataatcgtagacttttaaacggattggaagaataacgattgattgtccatatgctacgtaccaaatatacacaagcagtgccaattgaaagggtcatctgttcaattggattacgttgaaagagttactttaattcaattttattggtattattttatttttatcattgaattaatttgattttaaattttagtaattttattcaattgaagttanagactaattccataaaaaaaaaaaaaaattagactagtagcaagagagtttattaagttgggatttttggagtatttcaaaaggctcatatcccatattacttagtttaatacttttttctatagtgtttatatatcaatttgttttaaggacttttagacaacaaagtaagaaacaaagacttgcacacatgagattgagttaagtggatatgatgtggtgtaaattgtcatatatgtccctttacgggcacaagaattattttaatttacagattaaaaaattattttcagagtttagttttaattttggtttaagcttaattaccttcaaccaaaaagaaagcatatgcttatcatcacccttgaccctccccaaaacaagcatatacggttatggaattgtaattgatagcaagtaagggtgtacaagaacatacaatgactaatgtttttatcaacgtttttcttcttctttggatacatgttaaaatgtttcaatggacagcgcattcttatatcatttgtgtatgtaggcaattgcttcctgcccctctggctttgcttcctgcatcccataattgcttctatctttggatacatgttagtatgtttcaattagccattccgaattgcattctgggttacatttcgaaaaggctaatactgaatgtaaaattacaatttaaattatactttccagaagattaaaaaggtacagaaaacaaaatggaagtgcaggaagcaattgccgtgtatctactatatagtatatacacaagctgttgaagcccatgcactaatctggtaatgtgaagggccggggaatatataaatttctaagaatggtgcttcatacaccatttaaaaattctacaaggccattaatttttcaaaaacccgaaaatacccctgctgctttggacacttattttagttgagctgagcaccatttttgcttcttgtttgttgttgatttttggttcgcctcagttgcatttgagaagcattggtgatttttggtgccattttggttcatttggttggagttgtgggtggttgccggagcggcgaactcgtcgtcaaagtgtgcaaagatgggtggtgtctgctatcgtacggattcggtaatccgtatggatgctacgaattaggtaatccgtatgattcttacgaattggtcaatccgtatgattcatatggattaggtaatccatataactcatacggattggccaatccatataattcatacggattgaccaatccatatgactcatatggattacctaattcgtatgacttatatggattgaccaatccgtatgagtcgtatagattatctaatccacatgactcatggattggccaatccgtaagagtcatatggattaggtaattcatatgccttatatcagtattttttttttataaaaaaatcaaaaaatatatatttaaatgagattgatttgaagttgacaaataatttcgttgacaaaatacaatacaataaatggatttgccaatccgtatgaattatgcgaatctgtatgaagcaaaaggcataaaatagtgaaggatattttggaaattttactgttacgaaaatggtgtattagaaaaacgaacggtgtaggaagcaacattcttgatttaaaatatagaaaagccagaatgggaattgcttcctgcgccccctaaggaaagtgaaagtccagaaagtttttttattcttttatattgtccaaaacaggttgttgggggcaaattataaattgacaagccattacctgagttataatgattacgaagttcgacataatgaatcagaaacaaatgcaattagatacacattttgaagaaggaaaatgccccacatcggctcctagtaaatgttcccttcttaaacgttttttctctcaatatctacatccaatgatccaagattttggccttttaaaattaattgtcgcaaaagaaatactagtacttatataaattaataatctacttgtctcaaactcattgattctactctcgtttcaaaatcagtaactcatggattctactccatgcatgtctttcagatcctgttttaaatatgaagtgctaaagctgtaaacatggatagaattatttctgtaagattgcttttgcgcaatattagtaacaaggagaatatgatgagctgtcaattacgcgtaaaaatgcttttggatcctgattattctcactgacgattggactaaaacgatgctccagttttatatgtataactttacaacataaacttttaaattaaagttgattagttatcagaagacatttgtcgggcatataggtagacaaaatgtttacaaaatttaccaaatattctacattatacatatattaaatgaaatataaaatatgaattgaaaatgataaaatattaaattcaattgatgaaagattgtttcttaataaaaatgtaaatttaaatacagagatacaaaacgagtgaaactttaatttgttgtttcgtggcaaccgacttttaacccgtgttgctttatgtagtagtgtatttcaaatttaaatctctatataagaattaaattatattagtagtttagaagttaanatatatatatatatatatatatatatatattaatggtagtaaaaaaaattaagaaagtcgaagattctttgattaaatcatggaatcttgatcagatagatggattccacgaagaaccaagttctttatcagtttctttgtgcacacaaaataattaaaaataaataaaactttaattaaattatggttgacaaaacttgatgtgactattgatttgaccatgagctaacgatatgtttgctcatgcatacaaaatcagttatcttctaatttgactttgagcgttgaaaaaccaatcctgcagttattttaaattaaagtcaatggtaaaaaatttgctggcaacgtacttattttaatacattctacactatatattagttaaatttatcaaaaactgtataagtgcgacctattaaatatcaaactgataatttattttttcccaactcaacttaatttgtatttaaaactcattcttctaaaacttaataatactgttcagatttgagacaaaacgcaattcattttgattctgctaaacgggaatcaacaaaagtaaaaccaagtagttaatattttcagggaaagaaaacaaaaacaaaaaacggtatcagcgtgccgttctcctccgaaaccatcacaatctggccacgatgtcctacacaactacgagggcgaataaaatgaaacagttcgaaggacaattaaagccatgctagcagctctggtctggttgaccacaatgattaagcacagctcaaaaagctaaggaaagtggtggaaaaataaaaataaaacaaaatgtcacctggacctaaaaaagaaaacactgagttcctgatcaatgtctccctctggatcaatcaagtggaaagattcacagttgtctgagccacgaaccctctgaaagctagctctaaggtacataagttgatcatcttctttgttcactaactccttgcacttcataaccccagttccgacaaccaccgaacgcatcaacctcagcgcttcgaaatcagtgttggagggcctgcgcttaacggcataccccaccttcctcccattgcagtacatagtccacaaaggcgtggacaaaagtgtgtctatttcgccatcgccgtcgtcgtcgttgttgccgctctctagggcgattcggagggttcctcctctcatttccttggccaagatggttgttggaactgccaactctaggaggagaattggattggtggagttggcgtttgcctgaatgcaaaagctcacttttcctctgcgatatccgaagatcgtgcctgtgatattggtggtggagctcatcagtgacaatgatggtgaataaatatatttgcttgtgtttcggagggtctcgtttgttcttgttgttacatcttggtcttcttctataatggtggcgccgttacatgtggggattagtagttgcatgagagaacgtagcagcctccatgatctaacttgtttctcgcagtccactgtagtcacgccactggccatgtagatctaacttaatgtcgctattgtttcagtttatagctacctcttcagcatggtttagggtttgtttatataatacatggatgatgtaaaatacgctaaaaaatatactactagttaaccttaagttaatataatttttatttaataaaaaataaatttatgataaatataataatgtttgttggtataaaatattgttagtatatattgatataataaaacaaatttataattaaagatgttgatcaattaatatgagattattttagattaattagtatttttgaatttgaattcttatatgtaattggatgaaatatttgaaagaaatattatatgacttagtaacaaaattattttcagtaaaattacatgcaatctggtatatatactaaagagatattaatactcaagtttttcattagatcaaataaaaagagtaccttttcttcccaataatattagttagatatcattttatgttattgtgataaccaaaaatgaataaatattttacaagatatatataaaaaatggttgtccttttcgttttttgattttaatattcaacggttgacctcatgcacacttgttcaaaagaaacccacaaattcacggatcacagcgacatgtgtcgaatagtgtggaattggccaatcgggttcaacatttttgggctgccaactaaaagggttatctaatgcagccccgttgcttgattctgaaacaactcatgcacacgctcagtggatagctcctgttcccagtttttctaatttaaaatatttctcttatttattatttgaggtttcttttcgtttgtggacaaaagtacctgtagcacgctggagcagctatgtctgaaaataattaatatgtaaatattaggtgtcttctttcttttctctttatttttgtgagattaaactttgatttcagccattgaaaaatgcagaaaatttcggagagatttccgtacagtcataacccaccaattcactatcattcaatcattaggcaaatagatttcggaccataaaactccaaattcatacacactgttcaactcttatttaatttgctctacacacacacacacgagcatctttttatacttttcatcaatgataagacctgcctcaccaaaataaaagagaataaaacaatgtgtcggacttattatagcagacccacaaaactagcactaaatcttattctcatgtattattttgcatatagcatgtgagatgaactttggaggcaaagcgtgttgtgtggaggctaaaaaaaattggatgtgtttagctttctagcctggttgctccactcttgtcctcccatttcctttcgcttatttgtcgggtatcgaagactgtcacaggaaaaaacttgatcttccatattttttcagctttcctagatattcagtacgaattttgatgctatgagcagacaaattttgatgccagagataacgaatataatttacttgatgcataagttaatttgtagaattattttttttccaaaaaatgagttttaacttataaatatattaattttagtttatgaaaaaattatttatttatttatttattaatttcccccctataaatacttaaaagaaaatcttatccaaataaaccctaattgaataagagatcatgacttatatatttacttatgcaacataatggcggtaaatccatcttttcattgcaacaattaataagaaaatcaaattagtcgtgtatatttagataaggatataaacaacttctattcaatgatgttctaaactattacatgatagaaaagagtaaatatttgttttgaagaggagagtaaaagtttttcttcaagaacaaaggttctcttagtttatatgtatacaaaagttattgtccggtcgtcgtcatctgtgaacgactgaataattctacattttttttaacattctcctctctcacttaaaaaaatcatacatttacacatgacctactcctaatttaaacaaaaagagctaacttaagcccaatactaagacacaagtcttaaaccacataaaattaaatgaatatgtttaaagcccaattacacattagttattagagtgaaactttcggtagcttcaatttttacttcagataccccattagattctataatatagaattatattttggagtggacattctgaaatgtaatgggttgctagagaggtgcaggaagcaacactctagttatcaattgtaaccggtattttgttttcgggctaattaactaatacccgtgtttataactaaaacatatatatgtggtcatgttcgatattattttatctatatcttttatgttgaaaaagttaaactttggacttgtactgcattctaactatgtatgtagttttcaacttgatcatccctgtatttttttcttatcgaatccataatgtaaaatccgaaaaaaacaaacgtttatttttcgttcacttatataagatgtaattaataattatatgcgttttttaaaaactctttttaggatttttcacacacacttagaatacaataattatgattttcaacaatatcaagataaaatgtgcccggggttggatttcatgccactttacctacttgtattaatgataactaaaaaacttcaaattcaacaatcaatcctcaaccataaaagtcactagaaatctaatcccttagtggttaaagactaaatctcattattaattcctattccctaagtaaatcaataatgaaatttgcattaagcacatggtttgcaagatggctaagtattcatgcatacaccattcctagtgtcaaacccctagttatcttaccctaggtataggttttagtaacattttccaaattccaatgcaataaaagccaaaaatatgtggtttatcatgccacaactaaaatagagagaaagagaataagaaagaagattgagaaatgaaaaatatattaatataaaaaaaatgcaagatgttcagggtcattacattccaaccccaaatactaggagaatttagctagagagagacatgaaaatctcaaaacatgaagaagggaggcaaggtcttgaagagagagtcatggaaaaagcttcacaacaggtcccaacttcaagagaaatgttctctaatgtaaatttggtcaaatcctcttatcctgtccttaaataggatctgacatgtgcctttttaaaaaaacacatgtgacacacttgcactcaagcgctaatttcagctcgcttaaacgtgaggtagaccatagcgctaattaagcgtgagttaggctgtcttgcttaagcgctacatgatatgtgcttaagtttgaggtttaatctttctatttgtatatgaaaaaatatttattagaaaacaccaatctcctaaatagatattcatattctaaaaaaaactgacgcatgattagaagatatcctaagcatccaaaaaaaatgtcacttttttttattaaaacaataagaaataaagaatataaaatgaaactcttgtaggatctgaataatcaatgctcttacaacattggttaagaaatttaaaaaaaaatatttattgtaaaaatcataagaaaaggtaaacaaaagtcactaccaatgtaatttgtatatcccaataaaaatctttttctttttagtttattaattaatattctaaaaatactggttaacatttgtcattcttgtatgtaatgttgtagagaaattattaaataattttttatttttacattttcatgatctcaattaacttttgtaattaaaaaatggttctttaattaataataataaattaaacaatgattgtgtatataaacactcacttaaacaatgcagtgtcaagtcaatctgttataaacttgtcaattaacgttggttttactttggagaacctctaatgaaaattttcattttgtataaaaatattaatatatttaataccgtgtcaaatagagattaacgagacagaatgaagaaaaccatgtaataacttcttttaatgatgcgtgcatagtgattcatcactcaagcaaacacttaacggtactgaagcacctaactttcgtctctggttcgttagttagaagcatgagcgggaactaaccttagattggcaaaaaaaatgcgtgctatgttcaccttctattcaaatctccaaccatcgatcgaacaacatgtacgtacatgctcctcacttttttctcaactattgtgcttctcttcctctttcattttttcaatgctcctatgggaagaaccaaagtctccaccctctttgccaataaccacaacaacaattacatgcttccttattccaacaccatacgacaaactcttgtaaacaggccaaatacccacaaagaccggttccccttttcaccctttgaattattgcggcgccttattcgttcaagtattccttaccatatcttcttccattttcattcacacttctctctagctagttattagttactgttatcttatatactgaagtatttttatttttattttttttttggttttctacttatccgggttgagttcaattgcattgtaggaaaagtagatgtagactcaaaaactaaggaagaggagaaagtctactcttggttatacaccttggcccagtcagacaaaaacctggttttcgagtacgttaggtccactgagagaggcaagtatctgcactctgcagtaccttgtgaattctacattgatactgaaaaaaatgtctactttccgaccatataagacaatcttatccatgtgttatatgattatgtttaacttatttatattttattttatgtgttgtcgctctaaagttagaacttataactacgtagttcatacaaactatccaaaatccattaagttgatgctagtgggtcttggttgcatgtaaactagactgcagggtccagtgttttcagcttttcatttctgtgaattgtgatcactgaattaaataccaccctctagttttgtgccatatgaaaggtagtatttttcaattctgtgcaggcttaagtttcacagaagccgataggagactgagggaaaatgggccaaatgttccacttgagtattcctttccaagatggtggcatcttctatggaacgctcttttccatcctttcattatcattctgattgttttgtcagttctgtcattcattacctgcgacagtccaaatggatttatcatgctcatattggttttcatcagtgtcacccttcgtttctatcaggtttttctacattaattagttggttgcattgaaacagtggaattagtacttctcttcccttcacttcactctaattccgacctttgtttgtgtctattaggaatatagcagctcaaaagcagcgatgaagctttcggaatttgtaaaatgtccaataaaagttcaaagatgcgctggtagagttgttcagaaagaacttgtagttcaagttgatcagagggatgtagttccaggtgacattgtgatttttgaacctggtgacctctttcctggagatatcagattgttatcttctaaacaacttgttgtaaggtgtgttatgtcaaccggaaaatcttctggtttagtagattagagattagtgaacacttgtattcttcccattgccttttcagctaactaaattatcacatggtgatttcataccctgttaacagccaggcatcactaactggggaatcatggacaactgacaaaactgctgaaatcagagaagatcacagcactcctttattggatttaaagaacatctgctttatggtgagttagtaacacaattccctattttgtattttgtttccgttgacgttatagcttcattttaagatgtagccatcaaaaatattaaatttccgatcagagatagtctgattgaatggagaattttgctgagaaatgattagttattaacatcacagggcacaaacgtggtatctggtactggaactggcctagtgatttccactggatccaatacttacatgagcaccatgttttcaaaagttgggaagaagaaaccaccagatgaatttgaaaagggtctcagacggatattttacttgcttatttctgtcattctagcagttgttatcatcatgtttgtgataaattacactacatctcttaacttgagccaaagtgttctttttgccatctcagttgcatctgccctcaatcctcagatgcttcccctcatcattaacacatgtcttgcaaaaggagcacttgctatggctaaagacagatgtatagtaaaaagtttaacatctatacgcgacatgggatcaatgtaagtataaattcacattgaaaatcaactgattgatgacttggacactaaattcatatgcagttgcacacatttgaaccaacttataataaaatatgaattcaagtttccattcttacccagctttaactacgctttcccctgtctctaccatcaaaatcaaagaaagggaaaaagagaattggaacctacaattaatgattagatcagcatgcgttttaattttgcagattaaactagtggaaaccagaatgtaaaaatctatcattattgttgattaattttgaataaagaaagatcagcaaggcacgttcttaacaattatcaagacataaatataggaattatgtattagaaacattatgaataaatatgaacttgtagtaataaacagagaaattgataagtcggtctaaattgtgttctaacttctaatcaatttggctaattgtatacgtggtgctaaacttctagtatatcaattattgatgcaactgcatcattaacaatgaatgaaaacataaggtccaaaaatattgcaaggaatatatgtcttgttttaatccaaatatgcatctttctagcaaattctttttctgcgtacttatatttttaaatgttgcagggatattctttgtattgataagacaggctcccttacaatgaatcatgcaatcatggttaatcatcttgactgcaggggtttaccccaagaaaaagttttacgctatgcctttctcaactcttactttaagagtgatcagaagtatcctctggatgatgctattctagcatttgtatattcaaatggattcaggtttcagccatctaagtggaggaagatagatgagattccttttgacttcataagaagaagagtatctgtcatcttagaaacagaaggcggacactcacaattctttggcaggttcctggtaacaaaaggagcactgttagaagtattgaaagtttgttcttttattgagaatttcgataaagatgaaatctctcccttctcttcagatgattatcagcagattttaaatctctcagaagatttgagcaatgagggattaagggttatagcagtagctataaggaagctggaaatggtgtgtcttttcttcttgcatcatccaaattgggcgtacatttctcttcatatattttagatagaacactcactaaaaagatcacattgtcaaaattattctcttaggtgaaattattttatggttcatgaccaccacttatttgtagtcctggtcaatctttatataacacataactaaggttttttattttttcaattaacgaaaaagagttaataaattcagctacgtgtcaaggggaaattagctaaactatagatacttagcagttgtaaactatacaataacttcttattattgtagggaacggtcctctcatgttgattttttacatgacaacacgtgtctatctctctcatcataagcattaaataggcggaatcttattagtatttgtgaatattaatggagatagttagaaacaaagtttccacacaaggttatgtaaaaattcaatacgagagtgtgaagatgtgtcactatatctagctgtcaagattgaggataaaacatagctttgataagttagttggtggccaacaactaacagttttcagtttctgtttttagccttttattcttgatagttagtgcaccatttactgctatatatgtgagaggtgctgcagaaacagagggtggtatgtgcagaacgtgaaatcactttgtagtgagtgagggagtgctggtgagtcacaaacacagagagtgaagattggagtgtatgagagatagagtgaggcttggagttcttggtgctgttagctaaacagtggagaatcaagcaagattctattgtacacatatctttgtaactcttgatccataatagataagtttgcttctttctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacttgtgacgtaaatatatctccattttttagtctataacagcataaatcacatgtgaataaaacctttttaatttaacataaaaataaatacaaattcgactatatttatataccttttttatacaactatactcaacaatttctttacattagcatctatagtcaatcttgtgttaaagaaagaatttgaaatacccatcatacttgataattttttttaaaaaaattaattagttgtattcgatgtcttattttatgtcacaaaatagatattattaaaaaagatttatctactcactttgaaaacttttcactatacaccattgtagtataatcacaattggattgtttgaaaggttgtttaaaagatgggaatcaatgtcaatagcaaatttatcccacattgcacatatgatcctattacctctatttgatagaaaaatgtaatttaattagttaataatttaatatatgtcattttaaatattaaaaactatggaaaaagaagaatttattnnnnnnnnnngtttttagccttttattcttgatagttagtgcaccatttactgctatatatgtgagaggtgctgcagaaacagagggtggtatgtgcagaacgtgaaatcactttgtagtgagtgagggagtgctggtgagtcacaaacacagagagtgaagattggagtgtatgagagatagagtgaggcttggagttcttggtgctgttagctaaacagtggagaatcaagcaagattctattgtacacatatctttgtaactcttgatccataatagataagtttgcttctttctcccgtggatgtaggtccttgtgactgaaccacgtaattgctttgtgttcttcttctacctattgttctgtgtatgctttaattcggtttctggtatagctttgtacatgctgctgttgtgtgctctgttttgctgtgtttctggtttttctggtttcttggagatttaagttgcaggttccttaatccacaacagagaggataagagaataaggagcacctcattagctgtggctgactcactttcaatttcaatttacgtgtgacattgcagccgcaaatatgcgaaacaagtaatggaagcaagagagaagaagaggatattgaaagagacatggtgttcatcggcctcataacgtttttcgacccaccaaaggactcagcaaagcaagcactgtggcgtttgtccgagaagggagtgaaggctaaggttttaactggtgactccctctccttgacaacaagggtgtgcagggaagttggcataagcaccactcatgtaataacaggtcctgaactagaacaacttgaccaaaatactttccatgagacagtccaaagagccacagtacttgctcgtctcaccccaattcagaaacaacgagtggtgcaatccttgcaatcaattggaaaccatgttgttgggttcttaggagatggagtgaatgattcactagctttagatgctgccaatgtaagcatttctgtggagtcaggtgtagccattgccaaagacatggctgatattatcttacttgagaaagacctcaacgtgcttgttgcaggagtagagcatggtagactcagttttggcaacacaatgaagtatgttaagatgtcagtgatatctaacttgggaagtgtcatttcactcctcatagcaacactgttattcaagtatgagcccttaacttctagacagcttcttactcagaatttcatctacagtgtgggacagattgcccttgcttgggacaagatggatgaagagtatgtaaagacacctcacaagtcatcagagagaggcttgtccatgttcatgttgtggaatgcaccagtgtgcaccctttgtgatgtggcaacacttttgtttctttggttttattacaaggcttacactgatgtgactcagaagtttttccattcagcttggttcattgaaggtctcctattgcagaccctccccatccacttgataaggacagagaaaatccctttcatacaggatgttgcatcttggcctgtgattttctccactgttgtgacatctgcaattggaattgcacttccattcacacccattgggaaggtcatgggattctcacttatacctctctcatatttcggatttttggtgcttctttttctggggtattttacagttggccaggtggttaagagactttacatattggtttataagagatggctttgaatatcaaaacattcatctgtttagtcgcataaaatgctactgttataaagtcaatatcaagtagaaacttttcgtgtcatcaaacacatccaacattgctgtaatcgtaccctacaaatttcaaaacaataggaattacattcatgaatgaataatacgtgcattaaaattttgtatactatatttagctaatttcagatagttgtttatgttccgtccgaaattccagtgcttcctgtcatttttctatttgtgctatcagttcttgatccgcttatcaccttcagacaataagcatctatcaaaacatgtggaacatttgaaatcttttacttgtctgcatttgtatgagttgcatattgtcccaggccatgtattaattaacaaaaccggtttagtatgtactatttgataagaaaatttagtttgttagtcactaaaattatgtactagagattattcagatagaatttaaaaaattaggctaaattacttagaacgttgaacaagaaaaaacattcataaaatgtaggaaaaggtcctaccgggagtcgaacccaggtcgctggattcaaagtccagagtgctaaccactacaccatagaaccgtgtgctatatatttcctatgatgataacaaatacaagatgataatagtgtcttaaaaaaaagatgcagccaatagaaaaagaatttgagatccatgcaaaaagcatatgaacattgtcactctaactattcgtttatttattttttaatagatccactttcttccttatgatgtgctgatttcgctatttaaaagaataaaactttttgaaaggagtaaaaatgtaaaatttttagcaaaatgttgatccccattccccactaacattttgtcaatagaaaatctactttagattttgtgggaaaaaaaaaacaaagtaagaagaggaaacgttgagaataatattgcaatcaattaaaacaatgaagtaaatgataaaataggtttcaacaaaaataaatataaaaagtaaaagaggacattgtaaaaaacagcagtattaaatttgagtagcacgacaagaaaactaattaaaaaaaaaaaagagtagaagccatttagttgcgctttaatttttttgtgagaagtaaagttataatctttagagtaaattgttcaagccttccttttattttgtagtttttacataaacctctcattttataaaaatatgctataattaaatcccgaacctttgtttttatagcatgctacatttaaatatagaatcattgtttcataaatcccgaacctttattttattacatatattgagtcactatacaaaaataaaggtttttttacgttgaagtgtagaatataaatccctcaaaaattttgtcactgctttaatccttgaaaagattgttatcgtatgaatatatcctttgaagatttatttagtcgctcatcaaagattttattcaccactttagtcattattcacaggatccctttggtgaaatttaacatctcttctctcaaagactaacatgattatattttaaaactttgaggaactaatttaatgataaattaaatctttacaaaactaatttggtaataattttttaagaagactaaaatgatagtatttttatttcgcttagtaaaaacaaattaaaagattaatacagtgagccacgtaagtctaaggatgaaattttaagttttatatggttgaaatacttgttaataaaccttaaaaatgtatggagtttcatgaaaggacaaatatttgggatccactagctagtaattctaagaaagagacacataaaatatagatagaggaaatggatttagcgtttaatatggatgtcttgtaaaaaaaattagtcatcaattttagtataatttataagattgttacttacatggtgggtgtaattgaaaaatagtaaatgatgtttaatacaagttttttgttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgaaaacaagttcaatgcacaatctgagtattataaatccattggatggcatcatgtttcatacaagttaaccaaacatagccaaccaagtttgatgcatgattaggcaaaaaaagagggaggggttatagaataaaagagagagcatccatattcatatccgcaaactcatgttgaaacatacaaaacagtggtcaaatttcccaaacttttcatataattgtatgatttgtatcactatatacgtaaagcatatagataattgctgtaagggaagacagacagagacatatgtggagtagaggcatcactgctttgctttggataaacaaacgttcatcctccatcaacagcccttgatctttaaagtggacctttcatcctcctaaattagtgctttacaatggaagagttgaactctgactcctagagtgtctggagaacaaaaacttggtgttatgtgaaaaagatcttctcattctcattgagacggagaccggcctctttggcaacgcacgtccaattgaagccaacttgttattaatagtagttgttgaagttgaactcccactaccatgcttctcatcagcaacaacactcatatccttgttacttgaataattcactttttcaccacaatgatgggtatctaaatccaccaccacatcacgaaataacaccattgaataagcagaagaagaatccatggaaaccgatcttctcagaggatgtgtttcctcttccacttccactgccgaagacacatcatcttcaaccctctcatgatcagaactctgcacgcgggcctcttgatgatcagaaacgtttgaaaccgtgtgattattctgatcaacggctctgatcacatgcgcgccgccagtttcgtcgcgtagcacaggtgcacgacacaaggggcaatttttgtgagaccggagccacgtgtcaatgcaagggatgtggaaggcgtggctgcacttgggcaacaacctcagactctcgtcgtgttcgaactctccgaggcaaaccgaacactcggtgccgtctatgatgccttcgcctttcttgtatttgaataccgtgatagagtctatgagggactgttggagacccaccgtacggatgtaccatatcgggtggacaaccgccaactcctccacgtcatcatcgttatccgaactcggaggagaatctccgttcaaatcgagcaatatggggccgtcgactcttctgttttggttattgcggctatatcttcttgagtagaagtaccttatgagtacggacacggtgcagagaaatatgatgacgccaaccatgcatgccatgacaatcatcgagagttgaaaaacatttctgtgatgttctttaagggaaggtatcgtgaatttaggatgtggggtacgatcatggtgttgttgggttccattcttaggaagaggagccattaacggaacagaggtagaagcaggggtcaagtattctaatattctatggatgtggaaaatattgttgcatagagtgtggaatgattaaatggtaacatgagaaattcgggcttattttgatgggatgggaccatttcattttctattggagactcagactcactcgcgaatttacttagtgctttcttttttttccaagtccatggactttgtgatggtttccgcgttagctttaatggtggtggggcgttaccagattcttgtaatctacaatccttttcatcaaccaaactttctcttttttgttttttcataaataaaaaaaataggacatttttggttctcgctttattttatttttttaaaaaatagtttttgactaaacaagttatttgtgtaattttaaggtgattttatattaaatagtatagttgtataactataagtaaattacataattttttattataaataaataaatcattctcatataagaatatcttttttacacaataacataatttttgtcattaattaacgtttttctatgcaataaaaataaataagaaaaacaaaaccaatatatagaaaaagaccattcccatgcataatatataaaagtaatgtaaaaaacttattcttataaaaattcaaaatttgaattattattttgtacgttattcgttatctcattaaagttcattagctaaagacatgatataaatagtagattaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtattagaattttttttaagtgtgaagcttaaggaccaacaattattatttatagacattctattgatattctaccataaaaaatattcttagtagtcattaccattataatgatagttactaaaagtttaaccttgcaaattcatatcgttcactaaatagaattaagcatggttttaataaccatattttgagtttcaatcaattaaagcttattgtttttaacatcgttgcaaattatttttccaaaattacccccacttacttccttttatattccaaaactaccttcacctattttcttttatacatataaagataacattcttagttattaaaatacatatataaatatttactcttttaatgcaaaactattaaaatataaaataaatttttttattttcgtaattatcaccttacaactcatcccgacatcgtttttcacaaggctgaataaaggtcggggtataataggtttatttttattcctatctaacctgaaattttgactcaaatcatttatttatatatgaatccagtgagtaaaacctgagatatatggaacgaaactaggtcaatctaattttttaatataatatatcgattttaacattatatatatagttaaaacataaaaaaaagtataaaggtaaattaaggtaaattttataatatatagtttacaataaaaaattattataaatttaatattatattatacaaaacattatcaacacataattattaaaaagaattatacatttttaagagacattaatggtaaaccaaactaggacgacccgaaccacaacctaaattgattctaataaaacacacagtgtttattttcaaaactttaatccatccaaatcaacctcggtggttaggttttactcatccctagtttttaattgattaatagtgtgaaactttttatgttaatagcgaataaaaaattaattcataaaaattattaaaaaaatgagagataaaaaaatttcttaaattatcaaataattttattatttataccttaaaagaactacaaattaatataaaagagtgaaacgaaaaagaaagttgtataagaagaatactataaaaaaaattcatcttataagattatatcttacttaaggaataaatcaaccaaatacatttaattaaataagttagcttatcaattttcaactaccaaatttatcagttagatctttaaatactactttaaattcatcaaagaatgtaactccatatataatttacaataaattctttcactttgttttaaattcctacccataaaaaaaatactaccttaaatctctccttcaaaaccccgcagcccttcccgcttaatccccgttttcttctatcaggatcaaataatgcaggacgaaaccaaaaacatatagtcaacttaaaaacaaatctgcacgtcataacagtaatcaaataagagcatcgctttatgactgttgatagatcaagaatatgatatgttacacaagtaaaagtttacccaaaattgaccattatttcatttttttttcgtaataatgctgtgtttataaatcatatatgattgttgaaatccaatacctgtcaaatttaaatgtttaattttcaagtatctcatgatctgtcttggcggtgcccagttagtggtgtcaaaagaggaacttttcctgcaattgctaagccataagctttgagcccgtcgtactcagcaggatattttgtcattaaccttattgtttgaactccaagatctcgtagtatctgtcagagatttatcattcaattagttgaaaaataatgcttatgctgccaaaatgaaacaataatttacgatgaaacatgcatgagcgaaaataaattgttccgtacatatatgacggttaacagggataaagagacactaaattatatttattttgatttcttgttctggatgaaatggtaagaaaattgaagtcagatactaagacaagatatgtcaaaattttataaatactattgttatagtatccaaaagataaagatttcttgattaattaggaaatgacgactcaagataactatgtattaaagatgacaagaataatcaataatcatccaagaatttaaggttgtggaagttttgagaaagtgcaagatttggaattcaaatatcaagagtttgaaattcaaaatgttagttatcagaagttggatgcactttctacacctgtggactaacttataaacttaatatgaattgatttcaagatagaatcggaacatgtagtacatttcagttggttttaagatggaatctaatattttgtattacacacttccattattactagtaaatttatcatttgctgatctcaaatttgactttactgatatacattaccactttgtattcttttaattacttatttaaacagtagaataactcattttctcagaagttgattacttatttaattacttatttaatatggtgggtggtccgttatgatctaggatagattttaatatcatcttataagagtttggacctaactcaactcccagagcaaattcaaaggatgaggatcgttcccacttatatactttattttagcattatttctagtcaatgtgggacttgcgttttcccaaataatataatttatccttcacctcacatagaaacctcctacctctaacttgggaacttgtgcactggaatgcattctcgcactctgctgtactgggaaaatcaccatcttatctacctaccttccttccttctttctgcctaaggacacttggattcaacatatggagagaaaaaatgacaagccaacgttttattttacatgcatgcaaatattgacattacccatgtttcaataaaatgcaaggaatctccgttttatttacattattacaataaaaactgtataaaaattccaggcacacacaatcccaaaattcaatattaaccagatggatttcgaaatctgcaggtattactttgaacttgcgccagactcactcttactctctaattatagtgtacatattcaatgttatagattaatgtaggacttgtaatccatttgattcattttcatataaatcccaattaatgttttctatatatgaatatatgaacaacactatatatataaagtgatgtagggtacgtctttacatgtggcataagtggaatgtatgcctggacatggcatggaaagaaattaaaaaagagaatatacataaaaacaatggtaattaatgaaaggctgaaagctcacttggaaaatgtgtgcagggacatggaagagcaatgaaaattgacgaaagccattcagtgtctgatagatacggacaaaggtacgtaagataagaagagcgaacaccagagattcgttcatctgcaagatatggttccgcgattggtttatgtatatatattggtagctctgctgaggtaccacttgtctcttcataaccagttacacttacaaatccaattgccttgtttgtttatactttttacgttctttcctgaagaagaattttctacgtgacctttggtaagcaggaatgtgaaaatgtaaaaatttgctttggtttacaaagaaaatcattgtcatgataggaattagcgggtctagtatattctttttcgttcacaatagtcactgtttgttttatgttcaaccacaggtatctagaggtcatcctgtttaaactgaaacaacttaagttcatccacacatttagtggttcacaatactcatgtttgacatcttattcaaagaaaatcaagcattaattatttcaatcaaatatacaagtacccattaatatgtaattttcatattatcagattcatcaaagacaaattcaggtgtttatattagtcttcaataacatattttcttataatattcttttactgatcctttttaatatttaataaaaaaattatcagttttttttataaaaaaaaaaaggtattcaacaaaaatatacacacttgatatttccaatattataacttggatgttgagattttcactagagcttaatggggaggcaaaaaaaaagtttttcaattgatgtggtgatctcattgtcatatcctgagtcctacccctaactacctagaaaggcaaccgaggttagtataaatgccatttccgcctctgagaagggcaatgtcagtggttatggaatgaccaccctagttaaattccataccattgccaattgtaaatatatattgaatttttcttggtacgactttaggacatttaaattcccgaatgccgtgagactatggttaaatatttccaatttagcactctcttagaatcatacatagtttattcctagaatcatttacatttgtccaagccaatgctttagagttagagatttacaggaaatgcataacttggacattagaaaatgcaaattacagcatgccatgcctcaccggtcttcaggattgcgttaatttacctgcaccagagtaatgtttgtaactttctgttgatttcaaacaactttcatatgacgctcaacttatgtttatgtttcaggtcttggcagtagtagtactaacatttttttattgacaaatgttagttgttaattgttaatttttttttgttagtgaaagaatcaaactcactatcttttcctcccttttttctccttctatcaccaagttataactccgtggtactaacatgttaactgcaacagaattcaaactttgtgtaacattcttatcgttctcttttatagacatgcataattgtccattttgagatgcatattacttcattttcatatatgaggataattttgttttttttctcaactttaggtaaattttataagttgaaatttctggcactgataatttaatatttgattattttccccctcggtgagctcatgcccaatgagatgctgattcggattaggaactgcataagctcaaacttacatagataatcgttgtaaaagatcatgccttatttcggcatttgggcaattgtattaaagtaattcaactgtagtgttcaggtatgacaactgagaactatcaaaagttgtgatgaatatctagacatgtaaattatgaaccttgtcttggtgttattgtaaaatgtcacaatcactgtcactgaacatttcatatgacttggatacaaagtagaaatgtattatcagaaaatacactacctttttttttaatcttgaaatcaagtccatttcagctttgctgttactcttgtttgtttaagttcattttcttgaaatcaaatactttagacaatgagaaaagcagttgaatagaggaagaagaataaaggtatgtttgaatgtctgttcaagatgtggtgcatgaattccaaagtaaatataatggcccacaaatttcgttttgcaaaataaagggtcatggatgcttcttggaaatggaggttggctcaaacttaggtttacaccagaaatccaaacacgcactaattggttatacaacagatgctacctgaaatattctccaaaagtatttttctgtctttttggcttattgaccttggtgcatatgtggcgtgtgccatttttatgaaacaaagcatcctgtctagcatcgtagacctgaaataaggattaaagtatgtggttttatttccttacatgttttataatgtgaatgtctcctgaatcagcaatataaaaaacgacatttcaagtgtggaggatcaaatgcatgcggccttatctccaagagtagagaagaactcgtaatcatgagatcacaaggctgaaaccttattgttccacctaggctcatcatcttcctaaattagcaatataatcaaatatggaatgtcttgtttgtgttcccctacatatagactgttacccaacttgttcaaaatttcaaatggatgtattagtttgtttaaatttagaaaaagaattttttaaaaaatatttttttagtaagtcgcttcttaaaataagtataaaactattttaagtaaaagtaatttatatagacatattaaaaatgtaaaaggttgctttttttattaaaataaatatttattttaacaaataaatttaaacaaattttcctcacataatcagtaattttgttaagaggataaaacagataatgggattaaggatcattttcactagtctatataaacaccaagacaaaggaatgatcattggtggaatgagcttgaaatgtaaatataacatccaaataaagaaaggactatggttgatgggaaaaaaatggatgtcttggtactctgccttattgtgtacggatttcattaattatacattttgcatttcataaatggatcatagtggctataggtatcggattcatttcgtttatttatgttcattgttttgctttgcagaaacgaatgacaaatggttggtaggagatccatcatgttattctttaaaaaccttaattagtgcaatgcaaactttcttccttttagttcaatgtattagtaaagggataactgctctgattcttgaacacttgaatctcaatattgttttaatgttgttgctatggcttctgcattttattttaggttattgactttttcattccgttaataatgttatgtggtgatgttatttttaactgatactttttctcccatcatactagttccatttgtatgtttttgttctgcaatgatttttttgtcttatgatgacagagtcaaggcttaatgagttgactgctactgatgtgatcaagaattagttttataaatcttgattttacaaaattgattttgcataaaattaaaattgaaatgaattgatttatgttagaaaaaagctattccaaaaggaagtatagagtaaaactttgtaagaatctctcaactcaatccaaaagctacaaaggacaatatttctggtatccgaaagctgttaaatgttttgaggtgatcatttggttgtcatagtaaagcatatcgacccaaattgaaaggtttattaaccaaatgttgggaaacgaaagggtaaatacgggccagattttcatcaatgaaaaatcgaacaaatcacaatagtgaatttgagacgatactttaacttaacattaatgcttatgtttatgaatagttgttttcaattgtcttggaagaaagagagagaaaaaaaacaataataatatcactcttatgaaaaaggaagccctcctcgtcaagattctgttttctttcccgtaacttttgcttattctttctttgatttggatagcactcacaagttagaaaagagaacaaagttgcttaccactaggtgttatgcgctgtccgacaaagcctctcacctaatcaaaatcaagccttctttttctttgatggtggggggattcatctattaatttctcctttgtttttctcttcgttgtgtatctttgttgtattccatgcacagtaactggtaggcccttaccaaaccaaaaaggcctctctctttcttactttctaaagcattggaactaatcaaaatcactttaatgaaaaccatgtgattggctgattgatcatttgttggatcggtgtaattcactagttaactaaggtggtgttagctttgtttcccccccccccccccannnnnnnnnnnnnnnnnnnnnnnnnnnnnnnnnnnnnnntcaaagtttccctcttcctccatgcaacctcaaattttgtctctccacagcgtaaacttacactgtcttatgtgttcttgtttgtacgatcagacaagggacggggggcaacgtttttacgcattagcaaaggttgtgtgggtcctaagtttactgtcttatagaagaagttgagactaatatggcggccaaagattttgctaggagtctagattttggacatcaattatgtttgaattttgcaaggtgtgaatacagcccatgcagtgttgaaaaatgaaaatcatgcaccctagactagaactagcttttgcttcctaaacaaatcttaaatcacagattctgactttgtagaaagaactctctacttgcaagtgttccgctttttgcagttctacccacgatggcgttttatctacctaattgggcacaccacttttttccacttatgatcaaatgtctgatattgtttgatagcagaattttaattttgatgaaatttggctaggaaacgtgataaacgtttggctgcttcttctagtttatggaaaatattgttagtattactttatatatatatatatatcaagcgtcaaacgaatgcattggatagattttaaattgaattatactaatatataataggaggaagtttcttacctataataattttacaaagttcgagagtcattgtttctcttgaagaaaagttgtagtctagataaaagaaaaaatatattcataatctgtaaaaaatatttttttcttgtgaagaaaaaaaaaatagattaagagaaaacgcaccctcttgcgaagttagaaaagaccgtcaactttaaccagattttatataatgaaatttacatattgtctatcaacattaaaagtttgaaaattgaacccaagtctttgatagtgtgagttctagatgtgttaacccctacacactattatgtggaaaatgtattaaaaatgtagtctatgcatgactcatttaataaaaaaatgtttaaacattgaacccaagtcatggatagtgtgagttctatatgtgttaactcctatttatagactaatatgtgaaaaatgtattaaaaatttaatctatgcatgactcattgaataaacaattaaataaaaatccatcccgtttaaagtatattgtcttttatttataaaaaattagttaaacacattcatgtatctaaatgttgtaaagtctaggatttgtcccttaaagtcctatgctcgaccaatgaactttgaattacttaacctaatgtattataaaaatatgttaaatgattcatcattcatccaattttattttatttttatgcgtattcatccaattaaatatagtgatctagtcttgctaatctattttattttttttataattggacggattggttaaatttatatatggatgaatagaatagttagtaaaaaaatggactaaattgtcacccgacacaattattcgtttgctgaaagtgagagttcggagttccatacctataacctctactttatgggttttgttgacaagagcagagtatataataagaacattttcatataaaaaatgatagaatcgtggttttatttttttattttttttccagcttgtattaggagagtgagggcgagccctggcacagcggtaaagttgtgtcttggtgacctgttggtcatgggttcgaatccggaaacagcctctttgcatatgcaagggtaaggttgcgtacaatatccctcccccttacctgcgcatagcgtggagcctccgggcactggggggttacagtggtttttttgtattaggagagtgcttaacaaccaaatcgggaagttaaacccagctggagaagtgggattcgtcagatatccattaaaaattattagtgtttgaaaacaaacagtgccttacccagatgcttttgaacaagtcagcgacacgaataattatgtcccagtgaccatgcaggcttattcttacgcaatcttaggatagggttcacgttctatctgggcacatggattcatgacatatagacatgtcattgtattcacaaaaatgatgccccttgtcggaaatgctctgtttctctgttcttatattgtgtttgcctaaatcttaggttcacgaaacatattgcttcggaagcaaagttctcctatagttgtctacaaattggacatgtctgttccccccatccaaggttttgagctccctgcaatctattcttgtggctatgtttggttctgcattaggattgctacacccaaacccgcgtttgagcatgtgtaacatgatttagttagggaaaaaaaaaaaaaaaacaattgtaatttggatggtttaactaggagtagcttatgagttactgagttagccctttgccctgataaataatcgagaaatgctagtaacattaattttcttacactttctcagtgatttagaagtgagatccatcataattttaatttataataaattttagttaaatgtgttaaaaaaatgttgtcagcatttttcaaaataattaatattaaaagagcttaaatccaagatagatgataatgtgcctcccacaaaagcctgagccaatgtttgtgtgtctcaaaattggatctctaaggtagatgttgaaacttaagaatactatttatgaagatttggacgcttaaatccgtgaggggtagaggtagagttaagagacaattaaggttgaggtcatatattgcttgctattaggtcatctttgcatgtctttctaatgatgtgataagaaaaaaaatgaggaatatctgttatctgttatcagttcttcacccttaacttgcctgaattctagttttagacttttcaggtgttttgggtttattgaactgaatttgaccaagactaggttgtgtttgaaacaattataaacttattttttaaataaagtattttatttcaaatttaatatttagatttagcatttacagtttaattgtaaaattaaggtcatttaaaattaattttttgctatctcacccaaacaaatacttacatttatataaattcctaacgattcataatctcgcacatgatgaacccatggttcaacttcgaagtctgtatgtctatgaggccgaagtatttgcagtaattatctctcgaacatttttgttgaatattaccccgaatttaatgtgagataaaatgctggaaacttgaaaacattgtatgggccggatcagcttgtaaaacggttattttgtttgttatgtttctacctcgttatttaattcactgccatgctgggttgggtcactatcggcctgcctgctcaatatttattttaacatttcataaaagaagctcaaactgtgaatattttttaaaaacttaattaaaatatattgacggtgtaaatattttttacattatctctccattatttttttatttaaatttttaaattttcatttttagtcaaaaacttctcaaattgttattattaaattgttttaaactttctttcactaaaaggtattaatcaaaattccaaaggtgccctaaataaaaaatatatataatattttctcgctcttctgatcttaatttgacattctactaaatcattcaaaattcattaaatttatatcaaattttaggaacaagaacattaacatacaaatgagttgtggatcacatttcaactagaagttgttaacttgttatatacctacatcaaagcaaaatattaaaaaatttaaggatctaaactcacccacaatgtaaattgaaggtaaaaaaatgaagtcaaaattaaggcaggtaaaattgaactgaattgttcactctccagttttaatacaaatgaatatcaataaaatctaactcaattaattaaatgaaatttataaattattataaatttttaacactatttataatttctatgaatgaaaaaacaaataaaagagtgtcaaatgcgatcttgataaccccaaaaaacttattgtaaatcgcaaagctggttctcacgctttcaacccgatgaagtcctcacaagtcacaacagtttccgttcccgtggggttatctatgccatggcccaccacacacgtgttgctaccattttacaaaactgggtcccattttggacataaagtatgcatattttctttttgatttttgtttttttctatgggagtagggcccaaggagtgatgggcatacttttgtgccaaaactcgctttctcccattctattcatgcttgcctgtcactggtcggtaactgctttgaaagggcctgaaattgcgtagaaaggagcacattagtacaatgctggacacaccacacaatttaccacatgtgccatatgtttaggggaaagtgtggggatctcttgcactttgctttcgcaacatttatcaccatatatgcctagctagctttccatttgccatgtaaaaaattcttattcaggaggatttcccattgccatatgttcttcatgatactctctagattcttgaattgaagaaggtgctgtctggtgccaagttatgatcatttttgtaaggaattgccaatgtatataaatagactccaaattaaaatataacgatcgtttttataaattgaattaaatttatataaataccaatggagtactcttttttcaaagggaataaatgtgccatgtacggggaaaacgtcaaataccttatgatttgtgagttgtttatttatttagatcatatgaacatggacctttagtgaaatgaaggaaaatagcgagggtcggttcaactggtaaacttaagcttcgtgacaaaaagggttgcatggttgttgaaggttttcattggcgcctgtcaattgcgatgtgctaacttattcaccttttaattacttttcatgaaaaaaattagcaaagtaaattatgttatttaactgttttactatgtggaatagtgaattatggagtggtttactaagcttgagatctaagagagaagaagataaatgcattctcgtttgtttgattaatctatgtcgcacatctaagagagaagaagttttttttataaataaaaaaactaataagtatataaaagataataataattctataaaattaaccttagtattaatattatattaaataactaaatgacacttattagaagtattagtagaaaaaaacaattaaaattccattaaaaaccaaatataacacttattttagaatttttttttcaaatatgtctaactcaattcatttatcaatatccacaaattattataaatttatgatatttgaattggattcctaaatgtaaaaaatgtaaaatatataaatatatgttacataattattacatagcgatagtgatgattttaaaaaatgaaataacaattgttttttaagtctaaagtcaaaatttgttatatttgtaaaatctaaaaatatatttaatctaacaaaatattaaatgaatgaatgaaaatacatgctaacgtaaggaaaggagacttgtgtgattcactggctagagcagcgcgtgatagtagtataatagtattattactacgctgacgtaacgcaaaccttaagccggcttaaatagtggacgcaagctgccgaaagccacgccgtttccattttcatctgtccacactgtgcgctcctcgaggaaacggtcgaaaaaactgaagcctaaccggctaacccggtaccccaaaaagttgcatttgggttaaatttgggttcatttcataaccaaccgcagtagcagtcacctaaccccggtcagattctaacccgccttggtttatttaaagacacaaactctcatcaacccctggcctgtgaacttgttcacccttccccttctccttacttctcacgctccttccaaaacactccctttctcttttcccttacgacccttcttctgtgtgtgatgatgtagatagagaataaaaagagaccagtgtgcaggaagaaagagattggtcacttcttgtgtggctttgttttgttctgtgtgttggaatttgttgatgggtgaagagggagaagaggtgtcaagagataaggaacaacaacacatgggagtttatggaaatgagtggtcgtttagtagttgctgtgcaaattggcgccgtttaagacaccagaattcctgttccatgcctccttttaagtgaaaaaaagaaacatcaaaacaaaaacgtgttctctctcagcttttcttcttgagatcttaatatacattgactaaaagaaaaataaagggatcaaatttaagttccttgatctaataagatccgtgcttttgtttgtactactcatgaagagacttggcagttcggatactcggggtgctctcatgacgatttgtccaccaacaggttaattgaaaaaattgaaacttcggcttttaactctgtttccatgatgcgtgtttcatgtttgtgccttgtcttgtctcaacttttttcacgatcaaccatcccaattactcaaacctttcctatttttatactaaaattccttattctgttttttttttgtgtgtgtattgcatcacaactcatcatcatgttgaattatgctctgtgttcgtttgtttcaagagacaacaacagttacagttacactaaccatgattatgtcttgatttgaacagacgaacacagtccgaggaacaaccacgtgtatgggaaggagttccagtccatgctggaaggactcgacgaagaaggatgcgtggaagaaccagggcaccactctgagaagaaacgacgactaagcgtggatcaggtgaaggccttggagaagaacttcgaagtagagaacaaactcgaacctgaccgaaaggtgaagctcgcgcaagaactcggcttgcaaccaagacaagttgcggtttggttccagaaccgccgcgccagatggaaaacaaagcaattggaaagagattacggtgtcctcaaagccaattacggatcacttaaacttaactttgacaccctccaacaagacaacgaagccttactcaaagaggtaatttttacactggtagcttaagatgtgtatatatatatatatatttatatatatatatatatactattttgatctcatcactggtcgatatgggatcttcaacaagtattgaaagtttgtttgattgttttgttggcagataaaggaattgaaatcgaggctggtgcaagaagagaacgacaacaacactgaaagcgatgtttcggtgaaggaagagatgataaccactctgcaggatagtaacccgctcggtgaagccgccattcctggatcggactcgaaggagttgagttacgagtgtttcaacaagagtgatgaggtgggagggggttctgtattccctgtggatttcaaagatgggtcttctgatagcgactcaagcgcgatcttgaacgaggagaacaacaaccacagccccaacagcaacgcggcgatttcgtcgtgtggggttctgcaaagtcactggcttttgtcgtcgccttcttcttcgtcgatgaacaactgtttccagttccagaaacagtaccagacgtcgacgcagtacgtgaagatggaggagcacaattttctcagcgccgacgaggcctgcaatttcttctctgatgaccaagcaccaactctgcagtggtactgttcagaggaatggagttaagaggaagaagaagacgcttaattaattgagagcattttgcagggtgtatagtaattggatggagagagaaactttgtaaaaatgaaatggtcaaggattgaagaagagagggaaattgaagagcttgagagaaaggagaggggggctgaagcacgcatggcgtggggtcggatatgagaggttgatgacgataaataaaggggggtagtaatcatcatcatcaatctctcggccgtgcgggaaaaggggggtaatttatgaataataataatgattaggtcgtaattaagttctatctagtgagtaatgctgtaaaaaatccacaattcacctctgcttccacctttctttctatctctcaccagttttatcggcttttgtatttttatatctagattaatttcttttatcaaaaatctaagtttttcatattggaattaaatatttatggcattttaaatattatttacatgcggttaactgtttatatattattttttaacacaacttgaattttattttgataacttatattaatatttattgcaaaaacttattttgtaaactatagagagattttttttttattggcatattaaaagtatttaaagaattgtatttgtgatttgactttatttaacttgactttaagttttatgtacactaaatactttaagggcataaatgaattataggactgagaaacaggaaaaatagaaaagtaaaaatgtgttgttgaaatcattttaaatatatagtaaattatacgtaaatattcttaagattttgtgaaattacacatctaatctattttttctactcctgtatatcgtaaaaacatcacattgtgtcattatgttcttctacgagaaaggttgatgtaggctgttttgttatttggggggcaatttttttaagaaattactaatttgagttactttttaaaaaattatccgattaatagtaagttgtgagagtctctcacgactttgtgattaaagtcaagcacattcttactacttctgaaatgtttttgttttcctttttttgtgtagaagtaataaatataggtnnnnnnnnnnnnnnnnnnnnnnnnnnnnnnnnnnnnnnnnntgtgttcattattcatttatttctactttatagttgtttgtttcatttcatttaagaaaaatattttgttttaaaattttctttataatactatttttaatttatattaaaagtagtgaattattttttatttcaaatattattaattattatttgtgtaaaacagaaggtcataatcatggtaactaaaatatttgaaaacaataaaaaaaataaagaactaaaaaaatacaaataataaatgattatattagaaattaaaaaataattcatcacttttttaataaattaaaaatagtattataaagaaaactttaaaacaaaatattaaaaaaacgaaatgaaacaaacaactcttcgataaaaataaatgaataataattactttaaaagtcttacctctatttatgacataaaaataaaaataactaagaaaataaccttttaaacaacttcaaaacataaataagagttgtacttatatatatgacttcaacatggaaaaatataaaaaataaaagcattttagaagtcataagaatgtgttcaattttaatgagaaagtcgtgcatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaacatttcagaattcgcaagaacatgttcgactttaaccagagagttgtgtatggcaatcatgacttatccctgattggataatttttcaaaaagtacccccaatgggtaatttctcaaaaaaattgtccctcaatagtaaaaaatccgttgtaaatgttcaaaaaatagaaaaaattcagataaagaaagaatgaatatttaaatattacttttttggtatctatatttataacattttttttagttttatagttaaaaacatctcatattgaactcaatagtcatcatgttttttactattttgatccttgtaatctaaagttgtttaattttatttgcgatgaatgtgaattaaatgggtcatgttatattcgtttaaaatgactttaatcgatacttgataacgataatcaaatgagtaaagaaatgcaacttttggaaccaaaataggatgctctaaactataaagactggaaggaaagtgaaagttaccacaactataaggacaaaaaaataattaaaccaatnnnnnnnnnnnnnnnnnnnnnnnnnnnnnnnnnnnnnnnnnnnnnnnnnnnnnnngtttatgagtggaaaaaatagtgaaaaaaataaggatgaaaatatttttgtactaattaaaacatgatattttacccaagtactttccaacataaaattgctagtttaaaaaaatatgggctaaattataattttgatttgtgatttttatcctcctatatttttcatgatttaagttcctatattttacaaattttacaatttcgatctaatcatcaattttgcattcattttttcttttattttgtacattttaatcaattaaattatttctttatgatatattaaataaatt

SEQ ID NO: 3 - DNA, 365842 bp, Glycine tomentella
  source 1..365842: mol_type = genomic DNA
tgccactgtgttgggtgctttgctacattgccacatgattttctgcttcaggaactgtttggaggggatcaaattcaataaagaatgtccgaatctccatcggagcaagttcaaccacgaacttcgtaggatcaacgggtcctcctctcaccacctttggttcttcagtggagccttctaccttccaatctagcttcctcttttccatttgagctctttcttgattagcagacaaactcgtctctgtcactttattgatctgaaaggttgagttgtcaaaaggaaactatgcatgagtacataatgtgtgaaaaaaactaacttggagtagttcgccatcactcttaccatcttgttaggaaacaactttttcaattccacacttgccgttactgagtaatttttgtcctctccgatctatatatgtaaataggcaccaaacatcaattcaagaatatagggtatttggtgtcttaatgcaaagcaaaatatttgagagagaataaagataatggaaaaagttgtaaatcttgatgcatgaaaaatatcataaatcattcatagctagattacaaagttctttgcatgggtaaactgttattgatctctaacagttatatacataaatattatttccattattttgatagaaattgttgaaatatgaacaatgaacactctttttcatacatacagattgaaacccaaagggttcattatatacaactaattctaatattctagaatattccacaacttattctaatactctagaatatttcacaattaattctaatactctagaatatttcacaactgattctaatactctagaatattccacaactaattctaatattctagaatattccacactccccctcaagttgggagatatatattaatcattcacaacttgctaattaaatcctcaaaggttggcttgtgtaatcctttagtaagaatatccgcagtttgctctttggtaggtatatatgacaaacatacactaccatcctccaatttttctttgataaaatgacgatcaacctccacatgtttagttctgtcatggtgaactggattttgagcaatactgacagcagccttattatcacaatacaatctgataggtagggaataagagatcttcaattcctcaagaagtctttttaaccagattccttcacaaatgccatgagctagagctcgaaattctgcttctacactgtttctggcaacaactgtttgtttcttacttctccaggtcacaagatttccccagacataggtacaataccctgaagtggatcttcggtccattaccgagccagcctaatctgcatctgtatagatttcaaccatcctcttgtgtcccctttgaaagagcattcctcgaccaggggtgtttttgaggtatttgagtattctataaactgcactaaggtgtttttccttaggagaatgcatgaattgactaaccatgctaaccgcaaatgcaatatcaggccaagtgtgagataagtagatcaacttccccaccaacctctggtactgctctttgtcaacttctttcccatcttcaattcccaatttaatattaggatcaattggagtctctgctggtttgcacccaaacattcatgtttcttgcaacaggtctagaatatatttcttctgagttaaagaaatttctgccttactacgagcaacctccatgccaaggaaatatttgagaactccaagatctttcagttcaaactgatcagctaaacactgcttcaaagagtttatctcctcacaatcatttcctgtgacaattatgtcatcaacataaacaatgagaatagcaatttttccaccatcagaatgtttatagaatagagtatgatcagtctgagcttggaggaatcctcttcctttcatagcttgggtaaacttttcaaatcactctctaggggattgtttaagctcataaagagacttcttcaacttgcatattgatccgtctcctttttcaaaaccaggtggtggatccatataaacttcttcatgtaaatctccattcaagaaggcattctttacatctaactgttgcaagggccaatcaaggttggcagcaaatgataatagaactcggatagtgttaagtttgacaactggggcaaatgtttcttgatagtttatcccatgagtctgagtgaatcctttagcaaccaacctcgccttatacttgttgatgctattatctgcattaaattttattgtgaacacccacttgcaacctactgttttctttcctctgggcaatgctacagattcccaggttccattttttttaagtgcatccatttcttcaaagacaacattcctccattttgggtcatcaagtgcttcttggatgtttttgggtatttttgtactgtctaaaatagtgttgaaagcaggaaaacctggggataacatttcatatgagatatgatgagaaataggatgagcagtacaagatctggtaccttttcaaagaccaataggtaaatttaggtaagttgcatcagtgtatttaggtattgggttgttgcaactaggactcgagtctgaatcttggcagtctagaggctcctgaagtgtttttcccctgctgtaaatttttccccatttaccaggggatctctagtctgtggcatagtagctcgtcctatctcctgctcaataactacccctgtctccaaaggcaaaggtagaacaacagactcatttggtttccaagatttatcttcatctaccccaatagactccccttaaagagaagtcgaaggaaaaaaggattgtgtctcataaaatgtgacatccatagaaacaaagaccttacggagaaaggtgagtaacatttgtaacccttttggttaggaggataccctatgaagacacttcaaatagacttaggatcgagcttgaacctttgatggggaggaacatgtacaaaagccacacagccaaacaacttgagaggaagggaagaatgagctcgaaaaaaaaggaaaggcgtcggtaagacaaaataaaggggattgaaaatttaggacacgagaaggcatccgattgatgagatatgatgcatgcaagacagcttccccccatagatagttagggacatgcatggtaaacaaaagagttcgagcaacttcaagaagatgtctattttttctttcagccaccccattttgttgaggggtgttaggacaagaactttgatggagaataccatgttgggtgagatagtctccaagaacagaattaaaatatgcagtaccattgtcagttcgaagaattttgatagaggtctggaactgagtttgaatcatagcatgaaagtttttaaaggtggatgcagcatctgacttatcctttaaaagatatacccaaccctagaatgatcatcaataaaagtaataaatcaacgagcacaggagatattttctcacgggttgggccccatatatcactatgaatcaaggtaaatggagaaaaatcatgatgaactctaggaggataagaaacacgagaatgctttgcaaactgacaaatatcacaagaaaaagaactaggttttttattgataaataagttgggaacaacttctgaagataaaagaaatttgggtgtcctaaccgacgatgccacaacaaaacatcattacaatcatcagtcaaagataatgagtggtgtgcaaaaacttttgtttcattaggatccttttcaaaatagtaaagcccttcttcctctctagcactgtcaatcttcagccccgagttctgttcatgaaaatcacaagcatggacagagaatttaacaacgcaatttaactcagaggtaagtttcttatagaaatgaggttacaagtaagagagggaacatgaaggactgagttcaaagtaatgtgttcagaaattttaatggatccctttccagcaatagtagagaagttgtcattggctgttcttattcgtgacagttgatagtaaggggtataagaacaaaacaaggttgcattaccagtcatatgatcagaaacccctgaatcaagaatccaacgattactacgatcagcatggaatgtcgtaccttgttaagcaacatgactagttgcttcagcagattgaggcatcaccttctgaaatttttcatactccgccttagagataaaaacaccatcagaatcaggagaggcacgaagctcctcactcgtattattagaagagacttgataagcacgactcttgttctgccccttttgtttccagtttggtggtttgccatgaatttcccagcatttttcatgagtgtgaccacccttattgcaatgagtgcaccaacggtcagtacattttgaatcaacagagtgacgagccagtattttttgtaacaagggcagatacatcagaggacttagagtccttgtcacccaacataactttccgacgaagctcctcacgtcgtacctcggaaaaagcagcagcaagagatggtaatgggttctgccgcaatattcttccacgaacatcatcaagatcatgattaagaccagcaagaaaatcatagagacgccttttctcaacataatttttaaactttgaattagcttctaaacattgaagatctgctgcatcataaaggtccaactcctgccacagggttattaaagcaagaaagtattcagtaacggtcatcccaccttgacgtaagtctctcaccttggtattgagttcaaaagcctgagaagcatttcctaagtcagaataatattctttaacagcgtcccaaatttccttagccgtatcaagaaacaaatatgtttgactgatgtcagattccatagaattagtcaaccatgtcatgaccaaggcattttcagtcacccaatcatcataaccgggtttaccttcaacgggtttttcctttcttccatcaagataccccatctttcccttcgcttggataaacaacttgacagattgacaccattgcacaaaatttttaccgtttaaatggtgtttggtaatttgcatagcaggattgtctccagaaggtgacgaatattgaaggggagaggcaccagaagaaatgccggatgaagaagaagaatccataagttactatgaaggacaggaacaaacgcaattggaggtgactagatagtgtttatggaaaatgacagagagagatgacttaaggtttttcaaaaaaatgggtttcagagttgcagaacgataataggaaaacctgctcttgataccatgttgaaatatgaacaatgaacactctttttcatacatacagattgaaacccaaagggttcattatatacaactaattctaatattctagaatatttcacaactaattctaatactctagaatattccacatctaattctgatactctagaatattccacaactaattataatattctagaatattccacagaaatgcatgcatgtttgcatttttatagcataggttaaatgcaagtaaaacaggtcgcagaaaaaatctttccaatcatggttaagaatataaaattgcagtcaagcaatccttagaagatcattttgaaagggcaggagaaccaaagattatgaaaattacaacctcataaaggtgagccaatcttaggaggacttttccatttttaaattcctgcattcataaaaacaatagatacacatcagaaataaaaatgaggtaaaatattggaaggcatcttaaccttcatcttctattttctctataaatgtccctattgttctccctttcatacctggagggttaaaagagcaatgttgtcaggtaaactgtaggaagaatctatgccagaaaatgtggatggactgaaatgcaaccaattatccccatcctgcatcacaagtggaaaccagtaatgacaaacgatttaaccaccttaattttttctttggggcgggggggatctaacttcattttacctgttctgtgaaggccaacagcaatggtgaatataattcctggccaactgtgcgacgccacttagcaccttcacctttatggtcaattctaaggtacagttttccatgaatctggaaatatcatataaacttgtaccattaataaacagtaagttggtgagaagatgggagccaaaatccaagtgggttaggagggatctattgatggattggaggcaattattattaggaattatggatacaaagtaacttaacttgaattagtaattcagcaacagttctgtatttggaagttcacaatggaagttattcatggaaaataacatatggcagttacatatcaggattatatctaattgtaggatgtgtaattaggaaactgtgttgtcatttgcagtttgtgggaagagaatactctctgtaggagacttttatctctgacagcatgtatattgttgtattatgtaagatttatgtgcccagtattgtatgctttaatttttattagtctatcaattagtgttcgatcagtttggtccgacttgccagatcagtgggaagggatatttgtcaggccagcacattgatcatttgaaaatggatagtttctgatcatgtaaatttattagagaaacaagtggcaggatttgcgaaataatgtgttgcaaatggatgagaagattggaagcatggaagaaaggcttctctttgagatgcaaaggctgttcaggaagagaatagtggaggaaaatgatgattacaatcaaaaggaagggaactcttccagctagggctcagatttgaatttccaaggtttggatgagcattgtatggcagttaagaaagtggagctctcgcctgtcatcctttaatggagaagatcccgtggaatggttcaatctttttgagagaaacagaaaattatctcagttgagtgaaattaaaaacgcttctgattccaaggtttggaggaatttgagaattcatgaggaagtagcaacctcaaagcagttaggttctgtagaggattatatttagaaatttgaactcttctcttcataagtaaataggctgatgcctgaggagcaaattttggcgggaggacttcaaccagatatcaagtgcatggtccatacttttaaccctaagtcccactttcaagccatgcaattggctagaaatatttataaaattcaacctgagattagcaattacacttggcagtctaagaattggttacgaaacagtattgatgtggacaagacagttattgaagtccttgggcacaaggctaatttttaatcaggtggtattgatgggaaccaagattttaggaaggattgattgatggatttaaggcagttactattaggagtctatgtgatataaaataactactgttgtatagttattataagacaatattacaaaaaaaaaccttaatactgagagagttatgagagagacttttagagagagaaacagtgggaggagtagagtgaataataggtttaggtatcgtgagagatattgggagagagctcaggggagatcacgtcctattcctgatggggtcaggtatactcagaacaactcggaggctgtggaggaagaacgacggggtctttattcgaaaaactggagggatgcggcagacgtgtcttctttctatttcacacgttttcctgaagatatggtcgaaagagatttgtggtttgtattcaagaggtggggagatgttagggaggtttttattgcaaaaaataggaatagaaatgggtgtaggtatggcttcgtgcgcttcaaaggagttgacgatgtcggcaaacttgagaggcagctagataacttggtggtgggaggtcttaaaattcatgtgaaccttcctaacatgaccgggagcggaagatgcgatcaaaactccacatgaatgaaacgaagcatagggagttatggaggatcacgtggttcaaaaggtgaaaggaaaagctaaagtaaatatggaccaagaggttttggcggatcagaagcccatacctttcgtccagcatcgtaatcactcgtacgcacaagccatttcgatgggtaaccatactagaatgaagagatggcccatgtatcatggccaagcagtggtgaaaccttcccactcgtctgttcagtttgccatttccatggataaccgtaaatggtgttgtgaagcctgggtaggtagacttttgaaactgtcggtgttcgataaggttgaagaagaatttatgtgggacggaggagaggaagttaaacccaaatatttgggagacgacatggtacttctgtctagtcatagcgattccaaagcggcagagatgtgtaaggaagcagacgcaaatggttcgtctctgttctattcgctggaaaaatgaaatccagctatgaagccagggtacaggctggtcagggtattatgttggggtattccattgcatgcgtgggatagtgagtatatcaaatgtatcgttgctgggataggcgatatggtggtattggatgatgacacggacgaccttaatcgtcttgatagggcaagggtactaatcaaaacaccgtggcaaccgtctatcaaccatttggtagtcgcatccattaacaacgtggaataccgtattaacatcgttgaggagacatgttctcaactctgcaaatgtccgagggcgagatatacatcatcatcggaggtaatttcgtccgacgatagcatgagcggcatggatgaaggtttggaggttagtcacgtggccgagactccggcgatggtcatgacgtcgtccagcgtcagggatgaaggccttagatgtgggaaagatagggtaatacccgcggggcaaggcgcggtgaaagtaccgctgggtagtcaaaattctgacaataggagtaaagcaacggtggatggtaggtgtacctcagctgacaaacggtctccttttttcatcgaaaagggtttggcttgtaacgacccggctgcgcgtcagacggtaggagccaacttggcagatgcggaaacggttatgggagagagggacggaaacgagctagaaggtgtcgcgcatgccgggtacgggattgatgtcaataacactgctacaggtatggatgagagggaccctgataggcactggaccagccagaggaggaagaaagaatgaaaagaatctgaatctttattgaatgctactcacagttacacaatcttgagtgaattcgaggttcactcagcctcccaatactctcagcttacccgctaccttcgctcagccccttacctcctatttataattcctcaccctcccacaattagtgtaactaactatttaaacaaaatatcactaacagctactgaatattactaacaacagtccttaacaacaatcctagatcctatcaataccctccccttcaagatggaccttgtccccaaggtccaggtgaggaaaacagcatgtatcttcaatcaggatctccttcatcttcctcttccatgatcatcaacctcagttgcttgttcttgcacacatgtgttggatgatacctctcctcgcatgtaaaacattctcctttcctcattttctcctccacttcttgccggagacaaattatggaagatccttctaccttgtcttccattattgacctgttgaacaacagcttctacctactgcccctctttcccagatttctgttctgaacaatttggtttctgaccttgatagctatggctataacttctgcccaagcttcccattactctattttttcttcaatctgtctagccttcatcatggtctctatcaaagttttaggttcatgtaacctaacctcagttccaatctcctctctcaaacccttcaagaaaacttccattaaaaacttttcactcaatcccttaccagccccaacatgtctctcaaaaagcccaatataattctgcactgaatcttcttgcttcaaagaaagcaaagcttgaattgggttacctaaattggaactctgaaatctctgcaccactgcattcttgaattctgccgaagattggttcaaactccatgactcccaccattggaaccaagaaagagcctcgcccccatggctacaagaattgcatccaatttctcttcctcctgcaccccttggagccaaaaatatttatcaattcgagagacccactccactgggtcatctctgacaaaaaccgacaactccatcgtcctccattgtcgcgccattccttcctccttctcgccgttcctccctttcttttcatttcggcgaaccggttcctttctatcgaccctctccaggacgccgtttcctccattttcgatttctccagcgttgctgccagtttctgcagcaattcttccattgaactcaactgggtctcgatcgcaacttggtacaactggttggtttcatgcgattcctccattgctaattctagtgcttcgattctggcctccattttgttgttgttcttcgctgccattaatgacccacagccccaagaaggagctctgataccagtgataggcactggaccaagcagaggaggaagaatgaaaagaatctgaatctttattgaatgctactcacagttacacaatcttgagtgaattcgaggttcacttagcctcccaatactctcagcttacccgctaccttcgctcagccccttacctcctatttataattcctcaccctcccacaattagtgtaactaactatttaacagaatattactaacagcagtcctagatcctatcaaacccacgcctgcaaagatctcctgctcccactgagcagctagtgggtagcgaacatctcaaggctggagctggttcgggtgttgcagagatggaggcgcgagaagatgttcctggagtgctggagaatgacaggctggaaaaaggaaatattggggggacccacacctgttgtctgctcataagccggggtcacgtgaggaactatcgactttgggagttggggtgtcagggggaagacatatgggacaagtcaacaatttccaggctgtgatcaacagtaccgagttgggccacaattcttttggcccaatttctacttggaaagtttattccagaggcaaggggtgcagaaaggatttgaagcccactttatctaagtaccctcattgtggactcacccctcagcagtccgtggataaaggtaaagaggctgttcctggagcttctccgtctttatcttctggtagtgggctaaaagatttagctgagtggggtgaaaggcagctcgaaaacaaccataccccagtaacaagtcctacaaagcgagaatggagtaaagatgctcatagtgaatgggaactagctaagttgctgggcctaaattgcaatgaccagattgcagtgattaatgaaatatcatctatggaggctagagacatgcgcgaggttcagtgattgggaagtagctctgggggaatatgaagatcatttcatacaacactagaggtctgggagggggggttaagtgggcagctattagaaatctggtgacaaaagaaagggtggacatgctatgcctacaagaaactaagaaagaaagcattgataggaggttatgtcatgcattgtggggtgaccctaattttcaatgggaatgttcaccagcttgtaatagggctggtggtttattatgtatttggaatgaaaaggtgtttaaattagagaataaggtgataggtggaggttacatatactcggaagggaaatgggtagctgaggacactaaagtcagtattatgaatgtgtattcaccatgtgaggtttctctaaaaaggattttctgggaagatatcaagcagttgaggtgtgcacatatggcaggattatggtgtataattggtgatttcaacaatattagaaggcctcaggaaaggatgggaatctgccagagagccattgataatggtattgtgaaggaattcaatgactggatagatgccctggagattgatgacgtgccctgcctcggttgtagatttacatggtatagaccgaatgggaaagctaagagtaggctggatagagcccttgtgtctgctgattggctcacaaaatggccatctaccactcaactgatttcggacagaaatttctctgaccactgtcctgttctgttgagatcttcgtttgttgattggggtccaaagcctttcagggttctggactattggcttcaggataagtcttttaggaagactgtttgtgagtgctggaatgaatctgctgttaatggttggggggtatgttttaaaagaaaaattcaagcatctgaaattgaagttgaaagcctggaacaaatcacaatttgggaattctcaaaagaagctgatgtttgttgagaaggagcttaacagaattgaaaaagatggggatgatagacagctgaatgacaatgagattttgagaagaaaacaactacaagaggaactttggtttgctgctcaatcacatgcagcaattctaagacaaaaagcaaggaccaaatggatcaaaaaaggagattgtaattccaggtatttccatgtgaccgtaaattggaagtgtaaaaataacttattgcctggtgtgatggttgacgggtgctggtgtgaggaccctcctagagtcaaagcggaaactcaatccttttttatgaggaggtttgaagattctgtcagggagagaccaaacttagatggtgttagaatactatagtatgtataatagaataagtcccacatcatgtatattgcataatggtttctgtactgtttaatataaatcactccctgcgtgatcatataagacacacaattctccaatctcaagttggtaccagagcccactgattaggtgttatctccttccttgtcatgcgtccttccggcaagcccttgtccgccgtgcgtccttctagcgagcactcatctgtcgtgcgtccttccggcgagtccttcactgccgtgtgtcctttccggcttgttctcgatcgtctcccaccgttcggatcaccgtctcagctgccagaaccaccatctcagccaccggaattctttttccgacgagtcttcatctgaaaccacccaggaaggatcgtctccgtctgatttattttctatttatcaaaagttttgtgctgaaatccttaatcagtttcatactcctattcgtattttgcgtagtgataatgctaaagaatgtctctcacactttttctgagtttttggctaaacagggaactatccaccaaactacctatccacatactccacaacaaaatggagttgtcgagcgtaaaatcgtcatttaattgaaacagctcgtactcttcttttgcatatgaatgtccctcttcgattttgggctgatgcggttattatctcttgcttctacatcaattgtatgccctcttccattcttaataatgcagttccttacagtcttttgttccctgatagtcctttgtatcatctgcctttgcatgtttttgggagtacttgttttgttcatgaccttactcctggtagagataaattaacatctaaggctttcaagtgtgtcttccttggctacccccgtttttagaagggttattgttgttactctcctaatcttcgttgtttcattgtgtctgctgatgttacttttcaggatcagcaacctttctattgtacttctccttccgtgtcacaggtttctcacattcttcctttaccttttcttgatgtttctattccagttacagatggcaatccagttgaggaaccttctcctgtccatgcttctctagctcctgctcgtcccctacaagtttatcagtgtcgtccccagccagctttggatgttgcacccccttctgactcacggcctttgccacttgcctcgcctcctttggatcctgcctcggacactactccttttgcctcacgcataggtactcgttctacccgtaatcctcatcctttatatgcctttttgggttatgaccgaatttcttttccacattatacctttgtttcgagtctttcttctgtttctattcccaagactacaggtgaggctcttgcccatccaggttggcgccaggctatgctagatgcaatgggtgcacttcattctactggtacgtgggagcttgttcctgctcctcctggaaaatctttggttggttgtcgctgggtatttactgtcaaggttggtcctgatggccatgttgaccgtctcaaggctcgcttggttgccaagggttttactcagatcttcggccttgattatagtgacaccttctctcctgtcgctaaaatggcatctgttcgcctgtttcttgcccttgctggtattcgccactggtcactccttcaacttgatattaagaatgcctttctccatggttacttacaggaagaaatctacatggagcaaccgcctggctttgttgctcaggggagtctgggttggtgtgtaagcttcgtaagtccttgtatggcctcaagcagtctcctcgagcatggtttagtcgtttcagttttgctgttcaggcttttgggttggttcgtagtgaagtggatcattcagtctttcataggcagacatcttctgataagtgtatctatcttttggtatatgttgatgacatcattattactggtagtgatcaacctggtattgaccagttgaagcaatacttgtttagtcaatttcagacaaaagatcttggtaagcttcgttacttcttgggtattgaagtggcacagtctagacagggcatttccatctgtcaaaggaaatatgccttagacatcttagaggagactggtatgttggggtgtaaaccagttgatacacccatggatcctaatatcaagttattgcctgaacagggggagccattatctgatcctagtccttatataaggttagttgggaagctaaattacctcactgtgactaggccagatatctcgtttgctgttggtgttgctagtcagttccttgattccccatgtgattctcattgggatgcagctattcgtatcctctggtatatcaaaagagcaccaggaaaaggtttactatattcggatcagggacacacagagatttgtggttactctgatgctgattgggcagggtcaccctcagacagacgatctacttcaggttattgcatcttctttggtgggaacctaatctcttggaagagtaagaaacaaactgttgtagctcgatctagtgcagaggctgagtatcgtgcaatgggtgtcactgcttgtgagctcatctggttaaagtagttgattaaggaacttcatctttgtgcacaacgacagcccatgactcttatttgtgacaatcaagccgctctacatatatcctctaatcctgtttttcatgagagaactaaacatatagaaatcgattgtcacttcattcgagaaaagattcagtcaggggaaattcaaacagcatttgtcaactccaacgatcaacttgcagatatcttcaccaaagctcttaggggtcctcgggttgaatatatatgtgataagctgtgtgctcacaatatatacacaccagcttgagggggagtgttagaatactatagtatatataataggataagtcccacatcatgtatattgcataatggtttctgtgctgtttaatataattcactccctgtgtgatcatataagacacaattctccaatctcaagtgatggtgttaattttaggtccttggatcagcagcataacgatatcctaatggcacctttcgatgcaagtgaggtgaagaaggcagtctgggcttgtggaagtgagaagagtcccggccccgatggtgtcaactttaaattcatcaaagaattttgggatgtatttaaagctgatttccttcgattttttgacaaatttttcgtaaatggagtattcccaaagggtggaatgcctcttttattgccttgattcctaaaggtcatgatcaacaggggttaaatgattacaggcctatctccttattagcttgtgtatacaaaattgtggctacagtactgtctactaggctgaaaaaggtattgcctctcttatcgatcaccgtcaaccagcttttattgaagggagacatttgttacacaatgtgctcatagccaatgaagtggtggatgaggcaaaaaggaagaaggatagatgtcttgtgttcaaagtagattatgaaaaggcttatgactcagtgagttgggagtttctgttttatatgatgagaaggatgggttttggttcgaagtggattacatggatcaaaggctgcttaaaatctgccactgtttctgtgtaagtcaatgggagtcctattgaggagttcactccacaacgtggtcttagacaaggagatcccttagcccctctgctgttcaatatcgttgctgaaggcctcacgggattgatgagagaagcacaaaagaaggatcagtatgaggggtataaggtgaaaaaaaattggttgatattagcatcttatgtggaatattctagagtattagaattagatgtggaatattctagagtattagaattacttgtgaaatattctagagtattagaattagttgtggaatattctagaatattagaatatgttgtggaatattctagaatattagaattagttgtatataacaaaccctttgggtttcaatctggatgtatgaaaaagtgttcattgttcatatttcaacatggtatcagcaggtttccctattatcgttgtgcaactctgaaacccatttttttgaaaaaccttaagtcatctctctctgtcatttcctataaacactatctagtcacctccaattgcgtttgttcctgtccttcacagtaacttatggattcttcttcttcatgcatttcttctggtgcctctccccttcaatattcgtcaccttttggagacaatcctgctatgcaaattaccaatcaccgtttaaacgctaaaattttgtgcaatggtgtcaatttgtcaagttgtttatccaagcgaagggaaagatggagtatcttgatggaagaaaggaaaaacccatagagggtaaacccggttatgatgattgggtgactgaaaatgccttggtcatgacatggttgactaattctatggaatctgacatcagtcaaacatatttgtttcttgatacggctaaggaaatttgggatgctgttaaagaatattattctgacttgggaaatgcttctcaggcttttgaactcaataccaaggtgagagacttacgccaaggtgggatgaccgttactgaatactttcttgctttaaaaaccctatggcaggagttggacctttatgatgcagcagacctacaaggtttagaagctaattcaaagtttaaaaattatgttgagaacaatagttgtgcttatcaagtctcttctaataatacgagtgaggagcttcgtgcctctcctaattctgatggtgttttcatctctaaggctgagtatgagcaatttcagaaggtgatgcctcaatctgctgaagcaactagtcatgttgctcaacaaggtacggcattccatgctgatcgtagtaatcgttggattcttgattcaggggattctgatcatatgacaggtaatgcaaccttgttttgttcttataccccttactatcaactgtcacgaataagaacagccgatggcaacttctctgctattgttggaaagggatccattaaaatttctgaacacattactttgaactcagtccttcatgttccctctcttacttgtaatctcatttctataagcaaacttacatctgagttaaattgcgttgttaaattctctgtccatgcttgtgattttcatgaacaggactcgggactgaatattggcagtgcaagagagaaagaagggctttactattttgaaaatgatcctaatgaagcaaaagtttttgcacaccactcattatctttgactgatgattgtaatgatgttttgttgtggcatcgccggttaggacacccaaatttcttttatcttcagaagttgttcccaaacttatttatcaataaaaaatccagttctttttcttgtgatattagtcagtttgcaaagcattctcgtgtttcttatcctcctagagttcatcatgatttttctccatttaccttgattcatagtgatatatggggcccaacccgtgagaaaaatatctctagtgcttgttggtttattacttttattgatgatcattctagggtatgttaggtatatcttttaaaggataagtcagatgctgcatccacctttaaaaactttcatgctatgattcaaactcagatccagacctctatcaaaattcttcgaactgacaatggtactaaatattttaattctgttcttggagactatctcacccaacatggtattctccatcaaagttcttgtcctaacacccctcaacaaaatggggtggctgaaagaaaaaatagacatcttcttgaagttgctcgaactcttttgtttaccatgcatgtccctaactatctatggggggaagctgtcttgcatgcatcatatctcaacaatcggatgccttctcgtgtcccaaattttcattcccctttatcttcccttcctctcaagttatttggctgtgtggcttttgtacatattcctccccatcaaacgtccaagctcgatcctaagtctattcgatgtgtcttcataggatatcctcctaaccaaaagggttacaaatgttactcacctgctctccgtaaggtctttgtttctatggatgtcacattttatgagacacaatccttttttccttagacttctcttcaaggggagtctattggagagatgaagataaatgttgcaaaccaaatgagtctgttgttctacctttgcctttggagacaggggtagttattgagcaggagataggacgagctactatgccacagactagagatccccctggtaaatggggaaaaatttacagcaggggaaaaacacttcaggagcctctagactgccaagattcagactcgagtcctagttgcaacaacccaatacctaaatacactgatgcaacttacctaaatttacctattgctcttcgaaaaggtatcagatcttgtactgcttaccctatttctcatcatatctcgtatgaaaagttatccccaggttttcatgctttcaacactattttagacagtacaaaaatacccaaaaacatccaagaagcacttgatgacccaaaatggaggaatgctgtctttgaagaaatggatgcacttaaaaaaaatggaacctgggaatctgtagcattgcccagaggaaagaaaacagtaggttgcaagtgggtgttcacaataaaatttaatgcagataatagcatcaactagtataaggcgaggttggttgctaaaggattaactcagattcatgggatagactatcaagaaacatttgccccagttgccaaacttaacactatccgagttctattatcatttgctgccaaccttgattggtccttgcaacaattagatgtaaataatgccttcttgaatggagatttacatgaagaagtttatatggacccaccacctggttttgaaaaaggagacggatcagtatgcaagttgaagaagtctctttatgggcttaaacaatcccctggagagtggtttgaaaagtttacccaagctgtgaaaggaagaggattcctccaagctcagactgatcatattctattttataaacactctgatggtggcaaaattgttattctcattgtttatgttgatgacataattgtcataggaaatgattgttttttttttttttttgatcagcaaaaataatatatatatatataaaaaaaaaaaaaaaacagtacaaggagtactgctgaagatacaaaacagcgggatctactcaaaactttgatggctttgaaccaaagccgacgaagttctgacagatcgcacaaaaagaaaacaagacaaaatacagctgaattagcccctccccaaaggtgcgaaacactgactcaagttgctagaccaatagttaaaagggatatcaaaaccatcctctaggttcctcagccacgaccagcaaaagaagatggcatcttccaaaagtttgtggccattataagattcattgtgaaaaaggatttgatttctatgcttccaaatacaccatgttaaagctgcccaccaagttagccacctagatagagctttcccccttaaatgacaaaaggaggactgtctgtaatgctcctttggattacaagagtatacccctatgatgcctacccaagcccatgattcccagcacataggtaaaatacaagggcagcgaaagaatagatgtgatgcatcttcctcagaattattgcaaaggggacaaagagtgactggtatatctatatttcttctcctaagattgttccttgtaggtaatctatccttcaagagcctccaaataaagcacgctactttggatgggattttcaatttccataaactcttaaaaacttcatcctgaaagtgactgtcttcctccctgctgagcatatgataggcgttttcaccgagtattctccgctggattctcccgtccaaatccatgaatctgcttgctgctgattaattaccaacccattgatatcttcgaagaatcttatggccaactgaatctcacactctctaaaaggtcttctccattgtagctgccattcccacccatcttgattttgattgcccatctgctgaatgacatgtttttgttgttgtgaaatctgaaaaagtctaggatatgtgaccttcaaggaagtccggtgttcattccacgaatcttcccaaaatagtaccttactgccacacccaatcttccatctaaggccactaaaaaaccaaccatcaagctgaacatttccggagaccaaagataaatctctccaccatatggaagctgatgataacctcgaagaggcctgtagatgcctccaatctccgtatttggattccagtattttagcccataaggcttccgactggtgaaataagttccaacaccattttcccagcagcgcctgattgaaaacctttaaattcttgatacccagcccccctttctcctttggaaggcacacagaaacccatttcacccatggaattttcttctgatcatgattagagccccacaagaacctcctctgcatcctttccaatttaattatgacctgcgccggtaccctgaaaaaagagaagaagaaaatagggatagaattaaggacaactttaataagtgttacccttcccccaaaggataggtgtttgtgtttccacatggctaattttctctcgcactttttaatgattggtccccatgttgaccccctccgcggatttgcccctataggaatgcctaagtaggaaaaaggtacagacattacaccacaattaaggaaactagcagttgcagctacccactgatcgtccatcccgaaagcagcaaggttgcttttattacaatttagcttcagccccgacaccatctcaaagcttttcaacaacacctttaaggttttaacatttgctgaagttgctttcccaaagaaaatggtatcgtctgcatattgcagaatgctgatctcaatgtctttggatcccaccttaaagccttcgtacagacactttgtttgtgcctctcttagcatccccgtaagtccttctgcagcaatgttaaacaaaaaaggagccagtggatccccttgtctgagtcctctccgaggttgaaattctgatgttggactgccatttaccagtatagatatagtggctgatgttaaacaccctttaatccaggatatccatttagcacaaaaacccatcctcttcatcatgtacagaaggaaatcccagcttactgagtcataggctttttcgaaatctgccttaaaaatcatgcatgatttattgctcctcttagcctcctcaacagccttatttgcagtaatgacattgtgcagcagttgtctcccctcaatgaatccagattgtctttcatcaatgatgataggcatcacccttttcagtctgttagcaagcaacttagccacaattttatagatacagcctataagggagataggcctatattcatgtaggctttgtgggtccaaggtcttaggaatcaaagctaagaacgatgcattcaatccttttaaaaatgtgccattggcatggaattcatccataaagcgaagtatatctggcttcaagatctcccaaaaagcctttatgaaattgaaattgaacccatccggcccagggcttttatcacttccacagctccacactgcttcttttatttctgctggctcaaagggggctgacagaacaatgttatgctgtgggtccagagttgtgaagtgaaccccatctaatttaggtctttcagcattcaattcttgatagctctctttgaagaattgcctaatcacctctttaacccttgctggctcttgtatccagcagccatcaattaatattccttgcaacatatttttccggcgtttccaattgactgacaaatggaagaatcgtgaattacagtcaccctcctttatccatctggacctagctttttgccttagcaaagatgcattagcatttgcagccacccagagttcctcctgaagttgttttctccttctaatttcatcttcagtcatttgtctgttttctgtttgtaattcaagattgttcatctccaattctaaggatctgatcttctgttgaatattttcatattgttctttattccatatcttcaacttctgtttcagcaatttgagcttctcctttaagataaaacctccccagccaaaattcctataagaattccacacctcagctatgacctttgatagagatttatcctgtaaccagcaatcaaggaacctgaaaggctttggcccccagtcaacctgtgaagattttaacaaaataggacagtgatctgagtaattgcgtttcagggctatttgatagcacccctgacagagagtcatccagtcagctgatatgaaagccctatccagcctacttttggctaacctattcggtctataccaagtgaattttctcccaattctaggggcctcctccacttctagttcagcaatccagtcattgaaatccattagggatcctgcatattggtaattctgtcccaagcccatcctttctgatgatcttctgatgtggttaaagtctccaataatgcaccataagtctgcaggaaatgctctcctcagctgtttgatttcttcccacaaagcttttttcaaagttgcatcacaaggtgaatacacattaattactgtaatttttcttttttcagacaataggaccccttccaaatatatataaccattgccttgcaaccttttttctaccagaaaagtttcctcactccaaatacatagcaatcctccagctttattaactgcacgctggaattcccacgccacatttgaatcaccccacaaagcttgacaaatagtctttgtaattgtttctttcttggtttcttgtagacatagcaagtcagcttgttctttacccaccattttccttattgaattccatttgacccccctccccaaaccctagtgttgtaagatatgatcttcatgagtccacctcctctcctcccctcctagaaatctcccctttttctgttgactccaaagccagaattctactgatgatatcctccttggtgtgactagttaccccaaactgttgagccatagcccagaaatcatcttgtttgggtgttgtaaaggatgaaatagagtctgtgtctgaattcacaatttgctttaatcccacctctctgctagccccttttagtccactgtcacccccaggctttgtgggtgatttgtgcctagataataaggtaatttcttccttccttatcttgacaggaggtgtttgctcctttttcccattgaggcccactttttgatcactggttgtatttacggctgaatggattctattatcgtgcataggaaatgattgtgaggagataaactctttgaagtagtgtttagctgatcagtttgaactgaaagatcttggagttctcaaatatttccttggcatggaggttgctcgtagtaaggcaggaatttctttaactcagaagaaatatattctagacctgttgcaagaaacaggaatgcttgggtgcaaactagcagagactccaattgatcctaatattaaattgggaattgaagatgggaaagaagttgacaaagagcagtaccagaggttggtggggaagttgatctacttatctcacactcggcctgatattgcatttgcggttagcatggttagtcaattcatgcattctcctaaggaaaaacaccttagtgcagtttatagaatcctcaaatacctcaaaaacacccctggtcgaggaatgctctttcaaaggggacacaagaggatgattgaaatctatacagatgcagattgggctggctcggtaatgtaccgaagatccacttcagggtattgtacctatgtctggggaaatcttgtgacctggggaagtaagaaacaaacagttgttgccagaagcagtgcagaagcagaatttcgagctctagcccatggcatttgtgaaggaatctggttaaaaagacttcttgaggaattgaagatctctcattccctacctattagattgtattgtgataataaggctgctatcagtattgctcaaaatccagttcaccatgacagaactaaacatgtggaggttgattgtcattttatcaaagaaaaattggaggatggtagtgtatgtttgtcatatatacctaccaaagagcagactgcggatattcttaccaaaggattacacaagccaacctttgaggatttaattagcaagttgggaatgattattatatatctcccaacttaagggggagtgtggaatattctaaagtattagaattagatgtggaatattctagagtattagaattagttgtggaatattctagagtattagaataagttgtggaatattctagaatattagaattagttgtatataatgaaccgtttgggtttcaatctggatgtatgaaaaagagtgttcattgttcatatttcaacatcttacaatatgctgatgacactatcttttttgggatagcttctgagaaaaatgttagatctattaaggtcatgttgagaggctttgaattggcatcggggttaaaaataaactttgctaagagcagttttggggtgtttggcatgaatgaacactgggataacaatgttgccttgcatctgaattgtagacagctggttgtccccttcttgtacttgggtatacctatcggggcaaacccaaggcgatctgtcatgtgggatcctttgattaagaagtgtgaccgaaaattagctacctggaaaaagtagtacttctcctttgggggagggttacattgattaagtttgtcctcaatgcaatccctattttttcattgtctttcttcaaggtcccgaagaaggtggtaaagagcttgatcagaattcaaagaaggtttttgtggggtgatagtcaaggtcaaaggaaaattgcttgggttagttgggatgtgatttgtcaacttaaggagtgtgggggtttgggtattaaggacattactacgttcaattatgctttacttgggaaatgggtttggaatatgttccatcaacaggatgagttataggtgaatgtgttggagtcaaaatatggaggatggaggaacttgggagtcaatagaagggttggaggagaatccatatggtggagggatcttggttctgtttgtaattcaaatgaggaaggatgcgggatcataagaggaattgattggaaggtgggctgtgggtgaaagactttattctgggagggtacatggaagaatgtggggctgtcacttaaggacaaatacccaagactgtacctgatttccaatcagcaacaacaactcatccagcagatgggctcacaaatttctcaggagtgggaatggcagtttcagtggagacgacctttcatggaaggggaggtagattcggttatcaagttcttagaagagttacaagggtcgatggtacaacctcaactacaagatgcgtgacagtggggggctcatccgagtggagtgtacaccgtggggagtgcttataatttcatcaacaaggattggacttctctgaatctttgtgaagtgtacaagatgctatggaagataaaagtccctactaaagcattatgttttgcttggagacttattagggacaggttgcctacaaagctgaacctgagaagaagaaatgttgaactaaatgatctaatctgtcctttctgcaggaggtttgaggaggatgcagcacatttattttttagctgtgataaaattcggccaatctggtgggattcattgtcttggatttctatctacaatgtgtgctcagtgaatcctaaggaacatttctgtcaacattccttctattatttcagcgggctttgtgggcagagatggctaacgtggtggatagcactgacatggactatttggtgccatagaaacagaattattttccaaaatgagcctttcaacagtcacaagcttatggatgacgctatatttatatgctggatgtggtctaagaatctggagaaagggtttaatattccgcttcatgtttggtcctgtaagctgggggagtttttttgttatcagtggagggtataacatatagatttagttacccctctctgttttgggggtttctcttctgtttcagctagatttttggcaccttaatccatgccttttccatgtattaggttgccaaaggtcttgttttggtttgcttcttctgtttttgttttagtactacttgtactgtctctccttttttctattatttatatatatatatatatgcatatttttgccgatcaaaaaaaaattataagacaatattacacagtaaaacatagagattggttgtctttgtgcgagagaaggtacttttaggaaaaatcatcactaattttgtcagctccaaagaccagctggtagacatgctcacaaaatctctcaagggcactcgagttgacaatatttgtaacaagcttggatcatgacatttatgctccagcttgaggggaagtatcgaatatacattttggtatgatttgattgtgtagataaaattagggatttctctcattattattcattattgggtttccttaattatgtatcattacagattataaataaagcttttatgtgtgaggtacaacacacagaaacagtaaaatactttacatttatagaatttgtatagaaagtgtgtcttaccacataaagcctttatttataatgaacaaatatgatcaatccaataatgagagtaataaggaataaatccctaattgctatctaaaaatataaataagagaatattatgtaatctaacacttcccctcaagctggagcatatatgtgatatgagccaagcttgttacaaatatagtaaacctactaaaaagagaaaaggcagttctagccatgtggttgtaccgaataaatgatggctcggcagcagtcaacggaggcccacagttacgacggatactgtttacccgtgaaaagagcacgcattgaaagtgtgagatgcacacacatgggggcatgtgtggcggcagacggttgcacggttgcgtcgtgggtcatcaaacacaggcgacgatggtcgcaggtaggcaccgacaaaagggtgtcgggaaggctgctaaacaagggtaaaggcgcagtgcggtactgttcaccacaatgagggcctgggcgagaaaaaggacgtgcgtgagaatgcatcagtggttcttcaagacaatgtcaatggagcagcatagatcggaggaaggaagatccgtgggttactggctggaaaggtcacagagcttcggccgcggccactgctagtggccagaaaagcttaaactggttattgaaaagaaacggcaagtggagcgcccaccggagacagagtccctggtgagacacgatttttgtgatacctcaccaaagaataagaataatctgctctggtaccatatcaactttgtatagaaactgtcttggatgaccccacaaagcctttatttataatgagcaaataggatcagtattgattacataggatcaatctaatagtaagagtaataaggaataaatcccttttctttatcagcaaaataatacgtattatattaataaagatgagtacaagtggtacttttctatgtacattgttaccctactatgtataatcctaaggagccattatacttcctaatagtgcagtattgcaagaattaggaatccataagactatataggtctttgtacccctccacaaaaagtatcctataaaacacaaaaagtatcctataaggaataaatccctatttgctatctaacaataaataagagaatattatgtaatctaacagttattctgcattagaaactgcacgatgccaaatattcacagaaaaaaactgatggcagctaggattacatctaatagtagggtgtataattaggaaactgtgttgtcattcgcagtttgtaggcagagaacactctctgtactctgtaggagacttttctctgggacatcaagtgtattgctatctgtgttcagaagtattgtattttatttgtattttattagtttatcagttggtgttctatcatgataattgcaaattttaaaatatctttaatgtgtgttgctagcaggctatgaagcaccgatactccaatttgcctcatgtatctatatcggatatgtatccgatatgatactcttggatacttcaccaatacatgtccgtggagtatccaaacctatgaagtagcaataattcaatttgcttcacgtatccaatgtcgatactctttaaatactttgtcgatatgtattggtgaagtatccaagattttaaagtattttaggaaaatccaatacaactacatgaaacacttgtatgtataatatatgaacatagaatcattatccctcatgaacaaaaaatataaattgttctctttatgaatatttcaagaagaaaagaaattgaaagtatttttcctataggtaaataatagaaagtaatttatgatgacaatgagctataattttttttgttcttactaatcttcaggaaatacatttttaatttggactagcagaattgcaattatatatttaatatgttacttttatgattttttatacatttctaaatacgcatattacatgtatagtatcctatatatttttgaaataatcatggtaccatatctgatgcgtattgtatccgatacatgtatcatatttgtgcatcatagttagcaggtcaggatccataggcaagaaaatggtatgtatggagagatcattaaaagaaaagtgtgtacttgcactatgcaagacagcctccatatctctagcagtaaaagttaataaaatgagacctctgagcatcagaaaaaagtcctcacaaatggaagacataaccagaatcatcatgaaagcaattgtaaatggatttgttggaaagatatacttaactgttaggccctcacacttatcagcaacacaaactgtttcattgagtacctcacctacacctcttgcatcatcatgaagcaacctcctaacaaaatataaaaccaaatcacagaacaaggaaatgtcaatcattaattattattccattacctatatcctatgtagtaaagcgcaaaagcaacttgaactttaagtcactagatatgaatgacaactataaccaacctgtggagcatcagctctacttggccatcttctaagctggaaccaccaactgagcggtccaccaacacagagaattccatactactatcttgtacatatattcctaaattgacctgaaagaatggtgaaaaaccataatattaactaatatccatttgaagatagagcagctggactaaaatgcagaaatatctatgacaaacaaatcaacggccataagaaataaaaatcatgagttacaagtgaaacagagagctcaaatcaatgattgacaattaaataaaaatgtgaaaagaacaaaattcatgagaagaaaattcatttgctcagaaaaagaaaattgtagcagataataaaataatccatacataagaatgtaccacagtgccagaatttaatataaacagaaaatagaaagatggatagtgagtcttcgattaaacgaaacatactgggtaatagtttccagcaatgggttggttcacttgtagatcccagtctgtcctgaaatctcgaatctgcaaaacaaattttaaaaaaaaaaataaaagtcattaagaaaaaaggaacaaagctagaggtaagccttctcaagaataatacaaaataaaaacctaaaactagagatcgaattgtctaacagggcatcccaaagcatatctatacatggaaaaaaaaatgattaggaaaaacaccacaaaaaagtcaaaaaataaccctatcccagatgttgtctagaatgttttcttgcaaattctagcattcctttcaagccaaagtcatcagagaacagagaagagcatggccactgaaattagcttcttaataaaagccaaaacctgtaaaattgataaagagaaactgatgcaactacgacagaccgaactctcaaaaaaatcccaaataatctaattttaaagaaaaaatttgctgcagaacaatgcaaaaaaagatgattccctgtttccgaacaagaacaggacaatgtacacatgtcaggagacaaagcagtgagaggcctgcactttgtcggatgttgtaacgtaagtgttaagcctaaataaagtctcttcacatttcatccacccatcattaagatgggtctaggtcaaggttttcctattaattaaattgtatgttgctcttccaaaatatcaaagtctccaatccacaattagaatattttaccatgatataaggccaacagagataatataatcaacaatctacataatttataatagaaagacagcaaacaaatttaacacaccctcttaatgaagtcacgtccattagaatctgtgtagaatgtcttgttggtcttcattgtagttttaaattgcgtaataatttctttcccaatgccatcatccacaggaataggcccaacctacatatgtatatataaatctaagatgcaacttctcaactgttcctgagcaatataatagaaatgaaacaatcatttgctcttccaatcagataacatggaaggtaacctactgtgaactcaatttcagcatgctcttttgccttgaatatcctcgtaatctgtatatacagaaaacaaaataagacttccgtgcttaagctgcaagaaaatagatgatcacaagatatacaacttctaattttactaaaatttgtgggggcaggggttgctgcaggatatggaagtgatgcgtgcgtgaatgcctgtaagaaaatagttcatttaatggttattttaaccataagttacctgggatacccatgaattgagctgttgatgtacttcatccaatattggaccacgcaggacagtaaaagatgcctgaacacaaaccatacaaaataaatataaattattctctggattggccataaactaaaattatcatcaaccattgaatgttcaaaaggcaaagtttgtaacctgatgatctgatttaatggaaaatgagccatttggacgaaatacatatgccccagaagccttaagaaaaacatagtttgcaatcaaaaatattttgattagtttcagttcataatattatagattaaagtaagaaggtggtcttatcataggggcatagtgctaagaagaatacacagtaaaggaaaaactgaaaaggaacaaaagaaaatgaaaaaacacatacaatatagagcattaagttaatcgtctgactgacaaatgcaccatctatcctgcatcaagaatgggaagcaagcattctttttttattgttgaaagagttatttgttaggttattgtgagtatataggcttgactctagtgtactttgtaccgcatgtactaaactctcaacttagtattttatatgcatggggagaccatgctatacagatcatcccattacagcataattctcttctctcctctctctacatagtatcgcaagtatactagggaagccaccaatcatgtagggcatctgctttccaaaaagaaccctaccagtcagccagggctactggcaggtcagaaacttgtatgatagctagttcttaatcaagaaaccaaccagatctgaaaaccacaggtgtggcaacaatcaggtgtaggtgctgatctagagcaaaaccgctcccgttttcgtaacatagaggagcatcttgctggtctgaagaaagcctggtcatgtttggggcttttcttaggtgttggtgctatttttggagcaattcagtcagttttctggtgctgtttagtgaaacaatgttgtgtttgggctctattttttgtgatctctactacatttacaaaaaaattaagaaaatatgtgtaacaaagaaattaaatcatctggctaggactaccaaatagaaaagacaactatattcattaaaaaaaaaaaaagaaacatcttcctactaacaatgtaattgaagattaaggcagttgatatatatagaaatttcagtatatatgtaactaactacctgaggatctttgtcggtcccatcgtttccagaataataactgtatgattgttcaactgatgttgtaaccttcaaccaaagccaaaataaaataagaaacttcagcattactcactttatgccttaagcaaattgaactttaaaaatgttgacatcaattatcagataacatctgatcttggagcataatgagaagacctcaactagaaactgttagatttcaacttaaaaccaattggcactaagtgaagttgtccaacagatatataagctgcaccccaagaactgaggcaggcaatgtgggactttctaacaaacccctccacagatacctgccaaaacagacgagcctactagaataggcaagaactaagatgggctataggttctgataccacgttagatttcaacttaaaaccaattggcactaagcgaagttgcccaacagatatatataagctgcaccccaagaactaaagcaggcgatgtgggacttcctaacagaaacactaataaattcatattgaaaacttaccagagttctactgtttacatagtgagtcagtcttccttcattttctgaataaagtagctttaaattcccttttccaacttctatgcttttattagtacttccttctgatctgtatatcttggagatagttgaattatgacctttgtcattcaaagagttataaaagtttgagttagtgagtgttactttcagctcaactttaccagtacatactacagactagagataagtaaacaaagttaagaaaaaagtaatatgatatatcacttacttgattgtttagagcttgacactatataggtgctgaaaccaaggggaggaacagacactggaaatgcaagccaaaacttgagtttgttgcccccaggagcttttcctatatatgctctgacatagtgttttctcatagtcaaagtagcattagacagaggcagaatctgagactcaattttattcccagaaaaatcctgaacaaaaacctgtccagtggaaacctgtggcaaatatgttctggagtcagtcatgcaaatcataaattagggtctaaagtgtttgaatagttataaatatggaaatcattaacaatttaatcaaagaaatttgttgaaataccatatctgatgtgtatgcacatgctgtttcttttagcatgctcattggatcatgggtgcattagtacataaattaatgaagatcagaggggatggaaaaacatataaatgaaacagaggcatatgaatgcctatggatccctcaattagctcattccagtcaaactagaagaaaataccaaaataaaaatatgtttttctcatcatctttaagccttctaatgcacacagaaaataaatggctgtactaccgggggccctagggaagtcagaattgtggtccttcaagaggcaaacaaatagctcaaaagaatccaaatttcaacaatcagttaattaatatctttcaagactaaaagatgtcacaatcactaagaagaaaatgacccaaccaagtacttggagcatggcagcaaccactgattttgaagtgatggaaaaattcattttttactgcccatacccaagtccaatattgggaaaaacccaagttccacatcagctaaagatagtgccaagatagagtatataagtgggggcaaccctcaccctatgaactagcttttggggttgagttaggctcaaacccacattctaagatccaataagaaataaagtaaaataaataaattaccatttaaagaacttacaggaattcgaattacatcttccctcttccaagcaagaggattataaacaacaatcacctaaaaaaggaatacaaattgagagaaacattttaataagaaagattctatatagtcatgatcatgcaacaaatcaatactatccttaccaagctctttccattaatcaatgtagcttctgctggaggacagtaacttatattaagaagaggacactgccaacagattcacaaaatttagtgtcaaatgttaatagaatatgagagagagagagagagattgagagtgaggaagatcttattattcaacccaagtattgaaaggttacatgctcagattatatagagctcaactaacataactgaactaactgtgtaataactaactgtatttagttagttagttacaacagctgtctacagctgtactgacagctatcagtcataacactgagaaaagaaaataacccatcagagtaggtatactctaataccccccgcaagctcatgaggagttggctgaaagtttctcaagcactctgagcttggctctgtagacagaaaaggtggaaggtgtgagagctttcgtgacgatgcctgcacactgatcaatagcaggaatgtgtaccactggaaccagatcagtgagcaccttttccttgaacaaaaaacaggtccaactccatgtgtttgattcgagaatgaagaactggattataagccaaggccactgtgctagtgttgtcacaaagaatgacgggagaggcatgagagaccttgagttcagaaagaagagacaaaatccaagtaacttctgctgcaactaaagccatgctcctatattctgcctcagtgttggaccttgcaacaacagtctgcttctgggaccaccagaagatcaagtttggaccaagaaagatggctgcaccagatgtgaacctcctgtcatcaggatcagaggcccaatctgtatcacagtatgcatgaatgggaaagggatgcttggtagacataggctgaaattgcaatccccgtgatatggttcctttgagatatctgagacagcttcccaatgctgttcagtgggtttagacatgtactggcacaccttgtttactgaaaaacagatttctggtctagtgattgtgacatatttaagtgccccaaccacagatctatagagtgtaggatcagaaacatccttagaaccagtcttagtgagtttgcagcctccaaccataggagaagaaatgggatttgcgtcttccatgttggttttggaaactagatcccttatgtatttggattgagtgaggataagagacccattaggcagagatgagacctctattcccaaaaaataatccagcagacccaaatcctttagagaaaacacaggattctactttgaaacaagtgactttataaggctggaattatttccaatgatgataatatcatcaacatagactaggatagaaacaacagaattctgctcagaataaacaaagagagagggatcacttgctggaggaaaatttgaaaagaagagtagctttaagcttgtcaaaccaagctctgggggcttgttttaagccataaatggctttgtgcggtctgcacacaagctctttgttggaggactcaaagcctagaggttgagtcatgaagaattccattgaggaaagcattgttgacatccagtggatgtagaggccagttatatttgagagcaagagagagaattaacctgactgtgacaggtttaatgacgggaaaatgtttcattgtagtcataacctagctgctggtgaaatcccttggcaacaagccagagctttgtatttatttactgtcccatcaggattttccttgaccctgaacactcacttgcagccaatggcttttctggaaggaggcaagtcaactaaggtccaagtgccatttctgagcagtgcatcatactcagccttcattgcagcaagccaagttgggtttgaaagggcagattagatggttttgggttcaaggtgagtgagaagtaatgtgggattgacgcttgacttaacaatgacagacttggcacgtgtacacatctataggagtatagtatactcctataacatcaagtgaacattgccaggtctaacaagggaaggctgtaaagggggttcagcattaaaaggtggtgctgaaggtgaatcgggtggtgtgggtgacccaggttcagaggctggtattggtgaatcaggttcagtagagtgaactgtagttgcatgttcatttactggtaaggatggagaggtattttagctgggtgggtggttgctggaatcttgagtaataactgttgtgggagtgggttgtgatggtgtgagtacagtaacagtagaggtaattttaggaggttctggagtaatcaaggaagggctaggaaaagagttttacagggaaaattagacttcattaaaggtaacatccttggaaatggataccctaccatcagctgcaagacactgatagcctttgtgagaagtagagtagcccaaaaagatgcactcctgtgacctatactgcagcttgtgcttgtcgtaaggttggaggagagggaaacaagagcagccaaacgccttatggaaggtgtaatcaggtaatttctgaaacagcctttgatatggcacctcattgttgatgtaagaagagagaagctggttgataagatagacacttgaagtgaatgcatgatcctaataatgaagaggcatgttagcttgagagagtaaagtgagaccaagttccaccatatgtcgatgcttcctttccacaaccccatttgggtgatgggtgtgaggacatattaatctgtgcactgttcccagatcactaagaaacttggtgaacggtccaaactctccaccccaatctgattgggcagctttaataggaagattaaactgagtttgaaccataactttgaattgtttaaaaacttccaatgtttctgatttggttttaagtaagtatatccaagtaaacctactaccagcatcaacaaatgtaatgtaatacttaaaaccagaaggagatgaaatatgggcagggccccacaaatcagtaaatatcagttcaaaaggagttgaattgaatgatttagaggaagaagatggaagtctatgtgttggaatataagcaatgaacactctttttcattcatcagattgaaacccaaagggttcattatatacaactaattctaatattctagaatattccacaacttattctaatactgtagaatattccacaactaattctaatactctagaatatttcacaactaattataatactctagaatattccacatctaattccaatactctagaatattccacaactaattctaatattctagaatattctacactccccctcaagttgggagataaatattaatcattcccaacttgctaattaaatcctcaaaggttggcttgtgtaatcctttggtaagaatatccgcagtctgctctttggtaggtatatatgacaaacatacactaccatcctccaatttttctttgataaaatgacgatcaacctccacatgtttagttctgtcatggtgaactggattttgagcaatactgacagcagccttattatcacaatacaatctgataggtagggaatgagagatcttcaattcctcaagaagtctttttaatcagattccttcacaaatgccatgggctagagctcgaaattctgcttctgcactacttctggcaacaactgtttgtttcttacttctccaggtcacaagatttccccagacataggtacaataccttgaagtagatcttcggtccattaccgagccagcccaatctgcatctgtatagatttcaatcatcctcttgtgtcccctttgaaagagtattcctcgaccaggggtgttttttaggtatttgaggattctataaactgcactaaggtgtctttccttaggagaatgcatgaattgactaaccatgctaaccgcaaatgcaatatcaggccgagtgtgagataagtaaatcaacttccctaccaacctctggtactgctctttgtcaacttctttcccatcttcaattcccaatttaatattaggatcaattggagtctctgctggtttgcacccaagcattcctgtttctagcaacaggtctagaatatatttcttctgagttaaagaaattcttgccttactacgagcaacctccatgccaaggaaatatttgagaactccaagatctttcagttcaaactgatcagctaaacactgcttcaaagagtttatctcctcacaatcatttcctgtgacaattatgtcatcaacataaacaatgagaataacaattttgccaccatcagagtgtttataaatagagtatgatcagtttgagcttggaggaatcctcttcctttcacagtctgggtaaacttttcaaaccactctctaggggattgtttaagcccatagagagacttcttcaacttgcatactgatctgtctcctttctcaaaaccaggtggtggatccatataaatttcttcatgtaaatctccattcaagaagacattctttacatctaactgttgcaagggccaatcaaggttggcagcaaatgataatagaactcggatagtgttaagtttggcaactggggcaaatgtttcttgataatctatcccatgagtttgagtgaatcatttagcaaccaacctcgccttatacttgttgatgctattatctgcattaaattttattgtgaacacccacttgcaacctattgttttctttcctctgggcaatgctacagattcccaggttccattttttttaagtgcatccatttcttcaaagacagcattcctccattttgggtcatcaagtgcttcttggatgtttttgggtatttttgtactgtctaaaatagtgttgaaagcacgaaaacctggggataacttttcatacgagatatgatgagaaatagggtgagcagtacaagatctggtacctttttgaagagcaataggtaaatttaggttggctgcatcagtgtatttaggtattaggttgttggaactaggactcgagtcagaatcttggtagtctagaggctcctgaagtgtttttcgcctgctgtaaatttttccccatttaccaggaggatctccagtctctagcacagtagctcgccctatctcctgctcaataactccccctgtctccaaaggcaaagatagaacaacagactcatttggtttccaagatttatcttcatctaccccaatagacaccccttgaagagaagtcgaaggaaaaaaggattgtgtctcataaaatgtgacatccatagaaacaaagaccttacggagagaaggtgagtaacatttgtaacccttttggttaggaggatatcctatgaagacacatcgaatagacttagaatcgagcttggacctttgatggggaggaacgtgtacaaaagccacacagccaaacaacttgagaggaagggaagaatgaactcgaaaaaaaggaaaggcgtcggtaagacaagataaaggggaatgaaaatttaggacacgagaaggcatctgattgataagatatgatgcatgcaagacagcttcccccccatagatatttagggacatgcatggtaaacaaaagagctcgagcaacttcaagaagatgtctattttttctttcagccaccccattttgttgaggggtgttaggacaagaactttgatggagaataccatgttgggtgaaatagtctccaagaacagaattaaaatattcagtaccatgtcagttcgaagaattttgatagaggtctggaactaagtttgaatcatagcatgaaagtttttaaaggtggatgcagcatctgacttatcctttaaaagatatacccaacataccctagaatggtcatcaataaaagtaataaaccaacgagcaccggagatatttttctcacgggctggaccccatatatcactatgaatcaaggtaaatggagaagattcatgatgaactctaggaggataagaaacacgaggatgctttgcaaactgacaaatatcacaagaaaaagaactaggttttttattgataaataagtttgggaacaacttctgaagataaaagaaatttgggtgtcctaaccgacgatgccacaacaaaacatcattacaatcatcagtcaaagataatgagtggtgtgcaaaaacttttgtttcattaggatccttttcaaaatagtaaagcccttcttcctctctagcactgtcaatcttcagccccgagtcctgttcatgaaaatcacaagcatggacagagaatttaacaacgcaatttaactcagaggtaagtttgcttatagaaatgaggttacaagtaagagagggaacatgaaggactgagttcaaagtaatgtgttcagaaattttaatggatccctttccagcaatagtagagaagttgtcattggctgttcttattcgtgacagttgatagtaaggggtataagaacaaaacaaggttgcattaccagtcatatgatcagaaacccctgaatcaagaatccaacgattactacgatcagcatggaatgtcgtaccttgttgagcaacaagactagttgcttcagcaaattgaggaatcaccttttgaaattgctcatactcaaccttggagatgaaatcaccatcagaattaggagaggcacgaaactcctcacttgtattattagaagaatccataagtcacctcaaactaaaaaagagaagaccttttttttttataaaaaaaataggcttcagagttgcagaatgataacaggaaaacctgctcttgataccatattgtaatataaatcttcttattcattcattcagattgaaacccaaagggttcattatatacaactaattctaatattctagaatattccacaacttattgtaagactctagaatattccacaacttattctaatactctagaatatttcacaactaattctaatactctagaatattccacaactaattctaatattctagaatattccacaaatagtcaatagcatatatcagaaagcaaaacagttaaaagcaacataaaagaacactcaaccaaaagcattttcagtaggataaaataattcctttgtcgtttatttatatcatttttattaaaggacaaaaaaaaagaaataggaaaccttatcagctaagaaaggttaaatgtagtgaaatatgtaacattttcccgcatggaaaggggggagtttaaggaagaaattatgttgctgataaaaatttggcatgtggcataaaatgaaatcatatacttttgatttttaattggctgccaagtcaaaatataacagagtagtagttaatttatgattgattcttccattaaaaaattaaagaaacttatgctatgactatagtgcattgcctgctggaagtctgtcactggattcatcctatacgaacttaatctttggtttaccaaggaagcaagtgcagatgcaaccaacctttctgcctgaaaattaagttgtaaaccatataagttgatgtttatgatatcaatactgaaacagaaaattattaatatttacctcttcatatcccattgagagtcgcagtgcataatcagaagcaacatgctgcctttctgtgccactaactgcatcatggtgctgagcaattgctaaagcatcagctaatgcatcagtatttggtcctgtttcattcctccctttaaaatattccaattgccgtgctgcctaaatgtcaatagaagaaaagcaatgaatgtagcccaaacaaggaaaaatgagctatgagagcccacaagcacttaacaaattacttcataaagtaaaagaggtcaagattctacctgatagtaagcactcatgaatctcacatagcccttcaaagctggcctacttgtaaaatatccagtccaatatgcatttgggtgatctgcatacctaaaatattgtgccttgaattcaaaattgacatctctaaactatgtggaagctttgaagggaaggaagggatgggaagggaagtaaatgaaggggattctcaaaagcttatgttagtgttagaattaagcacatataaaatagatcttatcacatatataatacagattagctgttattaaagactgattcttagttgattaggtaattaattcctgtacattagcccttagaattagcatcagattctgttgtgtagaatgcaatacgaattataaatatacacatgtggactgattatcacacaatttacgaaattctatatgaccacatctgaagtagaagggaagaagggacaggtcacaaagatgctgacctcagcatagataagtattgcagaagattagaagaatagcaatggtagcctctctactaccgagagtagaaaggaaaagacactaatattttcttgaagtaaggtcatggacaaaacattgcaaccacagacttggagcgaaacagagtagagggcatgtgttggaaacaatagagtgaggtacctggttttggaggataaacgttacgagggtattcaattgattaagatatcatgaggtaagtatggaattgcccaaaaattaagtggggcattgtagcccttagagttaccattagactccactgtattgaatgttgtactgattatcaccatacatgtttaaactgattggtcacacaatttaaaaaattctatagcttaaactattagatgaaagctcatggatagctttattatatttagcactcttgtttggatgtttgagggaaaaaggttattctcttcctcttgttagggagttaaagttaaaagtaggagaaatgacagttatgtcccttatttatttaaaataagttatttccctttccttcaaatttcttcctcttgtttgggagttaaatctaaaagtaggagaaatgacagttaaatcccttatttaatttaaaataagtgatttccctttccttcccctcattaaaaaacttccaaacagaagtttgtcaattccctccccttcccttctccctccttacctctaattccaaacataaattgagaacggaagtatccaagataaactcacgggaagaaatcatcaactttaagaggccaatactcattagctgcatattttgcatcagtgtagatagatggtgttgaatataatgcattgacacgtccatcctaagagagtatggcacaaatggcaagtacaagttttaactcaaaggagctaaaccaggaagtgtcatcaaagatgcaaaacaagaactcagggaaacatttcagacacaattgcaagcttgagtacctgattgacgtagtgaataaacttatccatctgcctgaaccatgaattagcatattgataacggaagtctgtccccattgcccacataatgtgatttgttttggtcacattagcctagaaacaagtagaaaatctagtctgtaacaaccgtgatatacaaatactccaattcaaacaacataaaaccaattaaaatatatgtatcaacatcaacatcacctttaacccaatcaaaatatatgtataaaaataaatatttactctcgtaaatttactgcattatcaggcttttcaaaggctgtggtgttatgttatagattatgaaaaatataccttgcaaaaatgtataaaactttaactaaaagcaagaaaatttgcttttgagagcatctaaaaaaagtacaaaagatggataatataaaattaaaagggtaaatggttaaatagggaaaggaaaactgttacaattaatagaagctgaaggtttttaggtaattcatattctttatcagccatagctcctttaagatgcatcttctaggtgtcaaaaagatcctatgacaattttaaagcacaagaagttcctaaaaaatctttgccaccaaaaagtatattttttttgtctcttctgtaaaaagcaacaaatcaaaaaacactgcatttctagtttactaattagaatataaattgcattcttaagcctccattaactagcattcttaattagaatttatataacaaaaggaagaggttcaattgtcagccagacctcacctgagctaaggcagcagatacaaaatcgttgaccctttcttgaacattatagtcaaatagttgaatgtcatccttttttaatcaaaaaaaaaatgtcatccttcaaattaattttacatgaatcttagaagagtattaaacattttcttccagtaaattttaaataaataaaagaagactacctgaataggaggggaaacatcatttatctcaaatgtgaaaccatcaggaggatcataatgcctgggaaatatcccagtaaatatctgcaatgaagttagccataggaataattattgtaagaactgaaaagaaggggaaaaaattacttgtaagtagcaacagaatcattaggcaactaacttgtgaagaagagccaagagacctggaaccctgccaaataacctcaagagtcttctccttcaatcgcttagctctatcttggtaatcaattctagcaaaaaaatgtgaatcgaatcctagctgcagccaagacacaatcacatagggtttgcaaattcataatgacatgccacaacttcaatatgattgtgtgaattacacataagagtacaagctttgattgactagaagtgaaatcaagcatgttatgttggtaattaatacagataagtttccacatggttcaattataataaacatacctcagcaccaagcaagtaagcctgaactgcagaatggccaaatgggtcaatctgccaaccaactcttggaaccttaccaaattcttctttgataaattgatgcccaagagtggtctggtcaattagatcaatgtaatgcggggtggcctcatcatgcatacacatacccccatttcttcaaaaacaaaatcaggaaccaaaacaaaacaaaaaacaaaaaaacaagaataagaaattactaatcagattcaaaagtcatcgacttaagcatcatatatgcaaattacaaattaggcaaaaggaccctcctaaaaaatccttcacctgcaagctaaccattatctactgcaaccttatatcatagacatgaatttgaaaagcaataactattaactagcttcagaaagaataacataagatagttacattacatgaattccaactgacccgagttgacaagctccttgactttaattttcattgctttactttgctgtctccaccatctctggaaaaatgcctacccataaaaaaataaaaagaaaaatcagcactcaactaaacccactatcacttacttcttgccctttaaaaaaagaagttaatgaaattaaaacatacacgctcaaaaaatgcaagcatggaaagttagcaatatctactcatgtatcataaattagaatacacaactctgaaactcactctctcaattagacattcttaatattttctctcttctttcctttgatggtgtatttcacacattacgctggcaactaaccaaacaatttctatcaatcatttccctggttatcaattgtggaaggcggaatatggtggaagaccaaaattctatcatataagcatgccatcgcagcttatggcaccgccattgcagcttatgacaccgccacagcaggcctcctttcacaaatttcctatgaaggtggggtcaaaaaacgccacgttatagcattatggcagtcctataatggttatttaataacattgatcatctcaaaccaccttatctttacaagtataattgtctttttaatcatttatgtcttttaatctaacctctttcattcctatctttaaattaaattttaataattattaaaagaaatagttcattataaatccaaaatacaatttagatatccaagacatgaactttaatataatttatatattcaatattatttatttactatgaattttaattatacattaaaaaaagttatgttgtgcaaggcaactaaaatacttagatatgactaattaccatctcaacgtagatgaacttccgattcttgtcctccaagagagaagatatcacagaatccagtacgttctgcacacatgcaccctgcaaccagaaatcaccttcaaaattgtgttcatacaatttctaactttgcagccaaaaaaattacagaataaaaaaaaaaagacagacagacccgaatggagttgttggctccaacgtagtactgatccacggtcttgagccacccaacatcgtcgtgggagtgaggtaccaagtgcacgtttaatttgtctgggactatcctctgcgttgtgttgtactctatgtactctgattccgcaacccaaatcgccgccaccaaaacggcgaataccactgccaccgcgttgaccatcattgctgcctctgggttactgaactcgccgattttgctttatattattactattattactgaatgaattgccaactgtggagtgcaaggaaagacataacaaatggtccactccatgataattaaataattaaataatatataatatatatactatatacaaagtaaatcctataattatatctatgttttatatttatatcctatataatatttatttcctataattatatctatttatgtcaccaaacaattcttgcttaatcattacatactgatgtgttttcgtctctttcccctaatgaatgcacgaatcgcattcttgtgtgacagaaaattgtgttaaaggttgacctacatggtgataggatcaacctataaggatcttcgttatggcgcaactggcgctggtagccacagcagaaaaccctgtgaagggtgtggcgctgatggcgccagacccactggaaagtggcgcctggagcgccatgcccacaccaggggcgccaggttggcgctggaagcgccagtttttctggaggttcacgccaggggcgccatgattcccagccagctctggtagcgccagatgtggcgttgggggcgccatacgttctggatgttggcgccaagagcgcaagagtggcgccaggagcgccgcatgtcggtcaggggcagtatttaagggccaaaatacgaaattcttggcattttcttcttccttcttcttccccacgacctgaacctccattggagagcacccaagctttagaaaccttagtttcttgacccaaataccttctttgaaacaccaaacttgtgagaattatatagagagcctttatccttcatcatctttgcttgaaaacccctctaagtgagaatctctttccaagggaagttctaagaactcgagctaggcgaggaattgcggcattttaaggacacccaggctagaaggcgaggtcctgaggcattcctcatcaattttgaggtaagaaattcgagtttctccgattaatttgtagtttggggttttctgtgaatagtgacccatatgagctggggctggaattagcccagggtcctatagagaaacttgtttagaatggtttagtgatgaaggattagctttcagaattcaagttagtggactttaaatcttggctctgtggtttgcttatgtggcttttgtgataagtcactaattggatatatgccatgatagagcctggattatgtttgttctgagcatgagaggctagcggaatggtgccttgattgaggcttagaccgttccagtgatatattgaattacgggctattgtgagccagagctcaggcatgtgttgtactttgagtctgtgatgactcagatgttttgtatgcatccctgatggaccttgaagggtctgtgagtagcctagtaagggcttgacttgattgaaccctaggataggggaattctgatatgatatgtttctgtacttggatgcctgtgaattggttttgacatggatacatgccttgattagggcctgacactgagagtgtcggtggcgggagccacaaaatagggaaagaactgcagagcgaggctttgccaggtaagttcagtgtccctgggatgatttctcatcttgtgtgccacaccacactccgggggagtggtggtcatattcatgatgcatgcatttggttgttgcatcctcataatgatatgtgtgtgcatctgtgcttgttatgcgatataattgtgatagatctattggccaatagatagatatggacctccctaggagttgatggtttcctcctagtatggttggctcatggttgaggtagctccaagggaatttgtttcccacaaaccatggggatagaagttgaggtagctccttctattctcggaggtaccatatatgtgcatccatgcgaagggttagcacccaatgggatggcacaggtgtgaattttcggtcttacactgatttaggtgttgaggtagctccaccatgtttggatgtgtaatatatattgttatgagggccagagggccaagccagtgggccatttgcttgtgattgcctgatgtatgtatgctggagagtgggccagggtgaaggaggttcctccaaggaccctgagcttactgagatgtgtatcgcaccccgtttggggatttatctttacaggtgactcttctggaagaggagagcagtcttagggcaggaggccctagtggagacatgtctgcttggccggtggcagcagagggagcttgaaggctcagttttgttttgtttctgttttgtacccttgataagggctggtgtgtgtacacctgagttatgtatagtttgtataccctcggtgagggcagttattcttttgtatcaccacggtgtggtgaagacaatgatgtatatatttatgtacaaaactattgatgttatgatatgagactttcctcctgagtatattcctgatgtatatgtttatctgcctatgtttaagtatgagaaactggatcagtaggggtgtgtatatctgtcttgtgtgtgttttatgggttgtacttttattccatacataatgaatcaagaaaagagattatttgcttccgctgagttttatattatgtttttattcgcttaactgatattattaatgataacgcaccggaggcctacggggtgttacacaaccgaaaagctttgacatgttaaagtgcatccatgcacactcattaacaaaaggtaaaaccaaaaccaatatattcaatataactaacaaagaaaagctagcaatatgaccaatcgtcgtatgaaggtgatttcaaaagaaaaatagggccatataacaataccaatcaggaaaggatacattccaatcataaaacaataactaccacaaaacaactaggatgtgtgtttcaataaaaaaatccagtgcttatgtgaataagcttcccctgaacaagttgagagttcagcaaagttcccttgaacctatcaaacttgatcaaccactaacaactaatccaaatgtgggtggatttggtcaggggttgtggaagttaaaatcacataataataagccagtataagtaatgcaaaaatccaaatatagtaaaacttgcctacaaataaggtacaatataagtcaataagaatgacacaagtttaatctacttctacctaccatcatgtgaatgagtaagggcatattaagtgttcaaccactgcaattcaaaagctttctatatattcaattcctactctaataaatattttcaacaactcatcttcacaagcatagtccatttctaatcatattaacacatcaaatcatctcttttctctaacaatcacatatattcacaggtttttcccaattttttttcatttctttttaaaaaaaacccaatttttaactgtgcaaagcttgttacggattacaggatccgtatgaactttacggattggataatccgtatgactcatacggattatccaatccgtaatgttcatacggatcctgtaatccgtaacaagggcacggattgaccaatccgtaggtgttccacggtaacaagggcacggattgaccaatccgttacctaatccgtggaacacctacggattggtcaatccgtgcccttgttacggattattggatccgtgacctccatgcccgaccaccagaccatggacgacgattgaccagccttaacatatagagaactcaccagggtgacggcatggactcaagggttcaccaccaatgcaatgtgattgccgacaaagctccaacaacgtccaatggtgtgtcggagaagaaggaaccgaaaacgaagaaggaaccgaatgcgctcagggaagaaggcaaactcaataatgctgcaacagagggattagcacagcaaagtgaatggggtcggggaaaaagaagttggtgccgccggagaagaggagaagaaaatcgaaaacggccaggagagggaagggaagaagaaaagcttttcaaaatattatatttttttttaaattaaaggctatattgggaatttcactatttaaaatgttgtatgagaaattttttatggtgtaggaagctcatcacataaggcacatatgaggcaacaaggaaaagatgaagtagctggagagagaagaggggctgcatggatcccaaggagaccaaagggaccaatcaagggactccatcagagaaaggaagagactccttaggtagtctcactcttccttcatagtctccttctttcttttgttatttcctctcatctcttcctatttttcttctttttattttcgttttcactcttcttttttatttttgtgggttgttatttacttcattaagagaaatgtttgtgatttgttatagttagattcgttggttttgattgtgcttgatttttttctttctctccttctatttctttcttttttttcttttctgttttgagttttccggtcacctctacggtcgccaccgtggccaaccaccgcgtgccgtcaccaccgaccgccctcccaccaccggcctccatggtggtggcctaggaagttgggaaatcatcaaagaggtgaaaaaccctatttcccgcagctttgctgcagctgctgtgcctagacgaaaatatgcatcgggcacaaaaaaatgaaaattgctttttgcaccccttttttgatgagttcacacccctcttattttttaattattattgggcctagcccaaatggaaaaaaaactaatttacttttacacctcatttctgttgggcctgacccactttcaaattaagggacatgcttcatacaccattccattttctcctacaccatttgagcttttcataatacccaaaatgcccttaatgaatcaaaaaatatatataaacgtccagcaaaataaatgagagagaggtgtgagttgttgtccatttcgatccattttttgagcttcgcattgcttggaatcaccattggtgaggtttttggaggtgtacgagctgcagttggacgtttggtgtcgccagaaaggaagcgcggaggttgctgttgaggtaagtggttttttcagtcgtacggattcgataatccgtaaaattctggtgtatgaagtatacggattatacaatccgtacaagccttatggattactcaatccgaatgaactatacggattatataatccgtatagttcattcggattgagtaatccgtaaggcttgtacagattgtataatcagtataggtcgtacggattgaacaatccgtatggcctatacggattatacaatccgtaattgcaatatgtttaaaaattacataaaaatgaaatgtaatttgaaaattaaaagtttaaatataaataatgacatatgtatataaagattgtgattaatatgttttaaatgtaagtaaattttgtgtgtttgtgattaatatttgttgaatgtttttattgttttgtcatataatcacttgaggtgatgatactgattgtgtgttattacgaataattaatgtattgtgtatgacatggattcaattagcattacatcaaatctagtgaataatgaaagaggaatataagctgcttgcattagattgtataatatataagttcaaaattagtttgaaattgaggaattgttacttaagacaaatggcttgtcccaattcagtcaggcttttgtattaaatgtttaatgaatatgatttgtgtgtgggattataatgttagtaaaggttacttaagacaaggtatgttaaattgtttttttttgtcagaatggacagcgatgagtggatgtacgagagtataatggatgaagatatttacatgaatgaagaagacattggagcagactctgctgacgttgaggacaatgactgtttgattgattgttctgcagcgttccaaacaaatgaggtgattatgttgatgacttaaacataaagtatatgaatgtagttaaagttgttaaatgagtatgttggaaacattaaatatgaataattcttttgtgtaggtgtttgaatcgcgtgatgccgtattgaagtgggctcgttttgtggcgtctgagaatggttttgtggctgttatcatgaggagtgacaccaagacagggaaaataggaagaacgtcttttgtcttaattggttgtgaaagaagtggaaagtatagagcatggaaaaaaggtttcacaccagcaacaacaagtagtagaaaatgcgagtgtccttttaagctgcgggctaaaccaatcgcacgaagtgaagggtggatggtgaaggtaatatgtggtaatcataatcatgcactggccaactcattttgtggacacctatatgctggtcaaatgactgatgaggagaaaaacattgttgctgatatgactagggtgatggtgaagcccaaaaatattctgctaacattgaaggagcataatgcagataatgtaacaagtttgaaacaaatttacaatgcaagatatgcatatcggacgcgtacaaaaggtgctaatactaaaatgcaacagctaatgaagcttcttgagcgtgacatgtatatacattggcattgattgaaggatgaaaatgttgtgcgtgacttgttttgggcacatccggatgcagtgcaattgagcaatgcatatcatatggtgttcttgatagacagcacttacaaaacaaacaggtataggctacctttgcttgacatagttggtgtcacaccaaccgggttgacattctctgctgcatttgcatatttagaggcagaacgtacgaacaatgttgtgtgggcccttgaacggtttagagggatttttttgaagagggaatttttccctaaggtcattgttacagacaaagatttagcattgatgagtgcagtcgagaccgtttttccagatgcaaccaatttattgtgcaggtttcacattgacaagaatgtgaaggcgaaatgcaaaacttatattcgacagcagaatgcatgggattacgtcatggaagcatggggaagtgttgtcgactgtaataaggaaaatgaatttgatgattatgttatgaagtttgaggttgcatgtgctccgtggccgacgttcgttgattatgttaaggacacctggttgactcctcacaaagaaaaatttgtgacagcttggacaaacaaagtaatgcattttgggaacacaacaacaaacaggtaacatttcgtgtctttatttttcattccaacatgtttaaagtcttcacaattaattgataatattgtaaattgcagggttgagtctgcccattggaccttgaagaggttactgcagaatagtcttggtgatttatgcacggtctgggatgcaatgaacaatatgatatccctgcaacatactgaaatcaaggcatctttggaaagaagtacacatatggttggacatgtttttaaagtgacgttatacaatagactcattggcatggtgtccaggtatgcgttaaatcaaattgctgctgagtatgagagggtgtattatgcgagagaaaacccatctcgttgtggatgtgtgcttagaacagtgtatggtttgccttgtgcatatgagttatataagtatgttcttgcaagcattccaattaacaacgttcatgtgttttggcggagattaaatttttcggataatggtgaagatgaaaaccaagttacaaaaataacactaaagtcaaagcttaaagaaatagcgtttcctgataagaattccatgtgccctccacctgctaaggtcaaaactaaaggtgctcaaaagaaaaacatctccaagcacgaacgttcgacaagaagggacccgtcttacttcgagtatgtcgatgagttacattctgtgcagaacagttgctctacacccatacagtgcagctcctcatcggatgttctaaataggaaccggatggttcctatgctcgatcaatttcatccatttatgcacaagtttattgttgacattactgatgtcaaagctgatggaaattgcggatatcgagttattgcttccttattgggttacggtgaagaggcttggtcattagtgcgtaatcatctccttaaggaacttgcacaatggactgatcaatacattgcgttgtttggtgggacacataggtttgaaatgttaaagcggtccctattagttgatggattgtcgaaggtgtacatttgttttttattttatttaacattatttgccaaactgttatatttggaatgcatgttatattaactcatgatttacaggtaacgatggagaagtggatgaatatcacagacatgggtcatgtcattgcatcaagatataacatcatcctagtatccctgtcacgacagcaaagtatgaccttttttcctcttaggggccaacctcctacatatccacgtgttcatcgagttttgtgcattggccatgtgtttggcaaccattttgttaaggtaacacacacaatactttaattccaaagtatggttaaagtttaatttatgggcttcatgatttttgtaacaatttatttgaatcaggttactctgaccgacagttgtccattaccgttgacggcatgtttgtgggctagtcactgtaccaccgaagctcagcagtggccttaccattacgtagatagaatgcaattgtatagcaaatcgattacgttacgcaagaatatgttgatttgggaaatgtttaaacactcagttgacaattgaaatgtatgcgtttacttctttaatgcatgtcaatcagtaaaaacatgttgtgtgtcttaagtaagtaaagaacgaagtaagtgtctgatcatgaactatactttaatatcgatcaaaatatatatgcatcaatgtccaataaatgactgctaataactcatctgtcaatccaggtaaaatgtatacaactcaaagcctatgctactcaaatatatgtcatatggaataatcaatgtacaacaaataaatagatcaaagcatatgctaatcaagatgcctcctctgtggtcggaaacttcgtcgacctcgggtgtagacaaggccatcctcagtcacgcctcgaacatgctgaagcagctgctgtatcatgctccatgcatctgtgccttctgtcaccatcatcatgtcaagcatatgctggaggccctctgcaacacgttggcacgcatgctgcaaataaacaatacaatgtggttaagaaattgaacatctgaaatggaacaataaatacttatcaaataaacaataaataccaaggcatgaagtggtctctgctcatgtccaccactgggtggctcagaagaacgaccatgtccatccatggctggatcagacgaaggaccaggtccatcaaagggtgcatcagaaggaccatgggaatgggtgtgggtcggtgcacgctgaggcagtggtggaatctgggaagtcgcctcctcatacgcagatgaagtcatgaatggatgtgaaatgcggaagaaccaccccatgtatgcagcaccatagtgacctggataatcaaccaagtctccggtgtcgacaatgtgctctgcaaagtgaacccacctgtcttcaatggcctccacagaaggaacatctgccacaggctggggtggaatatgctgaacatcaccaaactggcgaagcaccctctcaggtagatacctagtgacctgaggaccccatctgaggaaaccggagaataaactgatggactgaaactccctgtgcggtcgatggtcaacgtacggtgtccaacaaatatcagacggtgtcaacctatctatacgtctacgataggtggccactcgtaaggccttcgcactcgtccatctgcaggatcgaggctgcctctcgtcgtagtgctggtcagcaggaacattttctatcgtaggaaaatgctcgtatatccaacactaaaaatttaaaagcatgcaaatcagcaaataatggaaacaaaagacatataaaatatggttttctgattatacacatcaaacgatattagtacctgtaaaagcgtgatgtatcctgtaagatgcttcccgtgatgctgacatgcgtagctcaagttctgatgcatgtgtatcagagcagccgcaccccaggcgaatcccgcagatcggtcgaagtctcgaaaggcctccaagaataccacggctatatgtgtggcactcttgttggcgaacaatgtgcagccaacaagatgaagtagatatgccctggcggccaaaatccactgcctcgcctcgaccttcgcgtaatatgtgtcctggagccatgatagtctgacataaggcccatgacactgagatgtctctgctgcagcctcctccacattgacatcaagtaggtccaccagcaatgtcatcgcctcgcccacctccaggtgctcgaacgagtcgaatgtccccataacagggagatgcagcaatgatgacacgtcatcaagtgtcaatgtcatctcgcccacaggcaggtgaaacgaacatgtctcagggtgccaccgctcgacaaatgcggatagcaaccccctatcacctgtctccactgagcatccaatcaatggactgaggccagtggcagccacaaagccctctatctcaggtacaggcttcccaaatttaatgaccttacgaccatgggaagcaagcttcaactttgcacaatcctgcatttaacatattatttaaggtaaaacattcatgaataatcaaatgtatgacgacattcgactatgtgattcaacatgtcaatacctttccggcccagacgcgtacggccacatgatcgcgaaacccggtcagcaaagatgaatcctttggccctccaaggaaagattcagacactatatcctccctgaccggatcaccctcctaagtgaccggatcaaccgtctccacatgtggttcctgcacgataggaacatcgtcaatagcaacacccgccctacgacgacgtgcagatgcagtgggcctacgccgctcaggggcatcatgtcgatgacctctcccatgtgtaatatcggaatcatcaggacggtgtccaacaggccgacgcactcctcctctcgtcctagccatgtgtaatctacatccgcatagtcactcagtgatcaaagaatagttgtagtcgtaagtgacatggtaaaaactcatttcaagatgtttgtttcctatctttcaacggaaacatgaactatcatgacccttgggcccttgggtttaacccctatatgacaatcttaatgagcttccaacggaaacatgaactaatgagggttctactaaggtcaaacaaaacaaacttagtctcactagtaaacaatggacagaccacaactaactaagagcatcaatcttatatttttttagaatgctcaaaatttacatttagaatgtcaacacaaatacattctaacagggttccaatacaatcagcaaaaacattatcataggagcgatctatgtcagctaactgcaattacattatcataggagcacatgttacacatagtgatgttaatcggaagtatcacacaagtcgaactctaattaaaaccaaccaataaccatattccatttcaaatcatatgtacacttcaaattatctattttcactaacaagcacatatatattggctattttccttaattatttttcatttttttcctcaaaaatgcttttttttttttgcaaattgagactttacggattgacggatccgtatcccctttacggattgtttaatccgtatgaactatacggattatacaatccgtaagggggatacgaatccggcaatccgcaggctatgtagggattaggtgatccgtgaagggatcacggattaggtaatccgtaagaagattatggattggttaatccgtaacaactacacggattacacaatccgtaacctgcttacggattacctaatccgtgatcccttcacggatcacctaatccgtgcatagcctacggattgtcggatccgtatcccccttacggatgtccaggccaccatttccgccattgtcgaccaccacacaccaccaacgacagccagtaaccacccaaaacccagcacacacccacatgacacgcacaaaagacttgaaaacactaatgcaccaattaaaaacgaacgaacttacctcggactgacctcacaatgtcgagccgaccaaacggagaagacgatgtagcaacggtcaccacgagctgttcaacacttccaatgcaactggtatcaacaccttctgcaatgccggcgcagggagcttgaagggcgcagggaatggtgcgtgtacggagaggaaatggtgtggcaagggaacggactaaaatttgaaaattagaaggggaaagtgggaagggaaataaagggattgcactgtttaaaaatggtgtatcagaaaaaccaatggtgcaagaagctcacccctcaaattaaacatgaaatgctatttacaaccacctttccataacagcacccatttccctattgggccttgcccattttgaacaaaaggtgtattgctgtttgcactcattcgtttcataactgcaccccgtttttaagttgggcttggcccactttggggcagtacatataatgctatatacacacccatattcataactgcacacccctttatattactgtttgcactacctttttcataattacgcacccctcagcagttgggcgtagcccactttggggtagtacatataatgctgtttacatcccccatattcataaatgcaccattatctggtgaccaggcccattttgtaattaaacaatttctgccggttgtatcccctgcccttactatatgcacctctaattactaagtgtacccccacttctattctatcccttttctatttccactttatttatttgatcacgtaatgtttagtacgcgcttatgcttcatgcactccatgctgggtctccgactcgcttggtagtgtttcaataacacctggatagatttgtgaatatcatgttgggtctccgacttgcttgatttcatagagtttaccacaaattcaaaatcttgtctaaaacaacaaaaaatatccaaatgaaggattactcaattctcctttttctcaaaaattacatttttacttgagatcgcttcaaggtccaatcccttaagcaattctcaccgtttttttcttcaaatttcatgtcgtttcaaggttcaacgccttagcggctctttttcacgaaattaaaataaatctttcaaaaaaagataaaatcaaatcaacccaatcaagctttttcaaacaaaaaactacgtaagtctgatttcctcattgcacttggggatacgtaggagcgagggcaaactccttgtcgacctaaaaaacaaaaaaaatatatataaaatcttcttttctaaaattgcaaaaaaaataaatatatatatatatatatatatttctttttcaaataaacaaaaataaaacaagcatagtcatgttcataaggaaaaaacaaataattaaaaagtcattttatttttaacacactcgattaaaggctgtcgtcttcgtgacggacgagtggggtgctaacacctttcccgtgcgtaaacgactcccttatcctttttctctaagatcgtagaccatgccttatcttttggtttttccgacattttccttaaataaacgttggtgacgactcccatctagtttttccatttttgggaaaccataattcttttcttttttgggataggttgcgacaatatgaaatgtattttaggaaataattcaatttaaaatgtgaataatcaaaatgaacttttttttacataacaatcaaaatgaattttaagaatttaagtatggagattgctgtaaaaaacatggagttaaaaatataatgtttttcaaatttatcacaacaaaattgtcagcaccaaaaaaaaatgaatagaactttatgataaataaatgaatgaaattatattttttactcattaattgtataaatatcatcattattataaatttataaatctaataataagtttgtatgacatgtgttgaattcacaaaattacattatcttataagatttggactttggactacacttataaactacgtagtgatttagataacacatgtttcttaaatatttagttcgattataggtaacgtttataattattatgatggttaaattcgtccttttataaacctaaaatttaaatttttataatataataattttggaattaatgagatttaaaaatgtaacttttactatgtacatttgaattttaaataattttttacaaaattaaatttcatgttatttaatctttgtaaataatttttggtttgctccatcgcaaatcatttatttagagcaatagttcatgttaaaaacttatctagaaaagtatggttaaaacagattttatttacggcaatatcttaattgtagtttcatggactaaaataattgtgatgagaagttgtttccataaacaactgctatgtggatcttgatgttagataagctaagaaaagaggttcacatcaaattgtccatgtaacatttttgacttctcgcagttctcacactactacatgttacgtggtagcacttcactcaacattcttttagtcagaaccctcggtaggtatcccttttcaagacctcgaaaattagctctgtatgcttctaagattaatgattgaccccacaaaccaacacaaggcagagctaaccctccaatatgtaatttgttagttgtttaagagcttcatcctacatacagtttaatgccactaaactggtcctgcccccaaaatatcttgacataaactagttcgttattgagggattccaattccctgctatgctagaagcttaaggactgaagaagtttcttgagttaaacggtactttctaccctgagttggtcaaaatgttctacacttgtgtcaaagctagcatggatggtactctttgttcccaagtaaatagagttgctatggagattaatgcagaagtctggaatgttgttgttgagatctcctatgaaggagtcagataatttgatgaagagatagaaggatacaacaagatagacacctactgagaaatgttgcaggatcctcaatcagattagggactggaagcatgactggtgaagacacctaggtccactaaccatgcttaagtaacagatgaagaccttcaattggtgtatgggatgaagacagcaacacaactcaactggattctcatcattgaggagataatgatgaaatccaaaaggttaatcagttatcaattcccctgtgttgttttagtctctagatttattgactattttggggtggatgtgtccaatgagattgtggacaacaccacaaacagcctcatcacaatcaagcacctcaacaagttaggcttaatgaagaccccgaatgggtggttaatggctggagaacaagctccacaagagggtgctaatgaaggaagaggatgttgaagttggtcctgctcaacaacaatggacaccttttgaatccctaatgattcaaaagatggatgatataccgactctgcatcatgagcatagagctgaaacaaattcctccatggaagaaattacctctaggctagagaacatagagactaggatgactctcaaagattatgacaatctctagtttagttgatgtaacttcttgcttgtggctatggtttttatgctttcttattttcagttgttatttttgttgctttcttattttatgttttcttgtactgcactttatgattaatgaataaaactttgtttttttggttgtttccatcctccttgcttatcttgttctcactagtatattttgtctgtaataagtcaaaaggggtaaaaatgaacatatagaaaaacaggataaaggtgcaattaaattgttcattgctcttatatgaacttaatataaaattacctaagatagggggagcaatataatgaatgtacactgcttatgaaaagtatacttgacacttgttcttggcaaaaagcggaattgatttcagatttcaagtataaagctcctagcattcatcccttaaaaagtacatgaaggctaaatatgttcaatttgaaataatgtattccatttatattggtcaaatccaatattaaaaaattattattattattttactaaagtttggcataagccaaaaaggggagcttgttagatacagggggaacttgaagaagatcaagatgttgaggctatttgtctcagacatattttagctttttacatgtcattcaattgaagacatatgtaatttgttagttgtttaagaacttcatcctatgatcccttaaattgcataaacatcattcattgacatgcatacatgatttttatcaagttacatgatttctaaaaaagcttaaggttttcatgtttgcataagatgtcaagtactcatggttaagttttggaaaaaaccactttttacactgacttaatcgattaccagaatatggtaatctgttacttaagccaaaaagaactaattaatcgattacacggtaatggtaatcgattaaacagtacaaaacacaaaaaagtcttactgtgttaatcgattatcatctaatcgtaatcaattacattagcatgtttttgaagctagactgtctgtggtaatcaattacatagcggttgtatcttttccagaaagaacaaagaacactttaatcgattaaatatgatattaaatgattacttaagtgaaaataatcgattacatggatgatttaatggattacattcagttaaaacaattttctataaaaaaaattgttgggtcttttgatttgaacaaaatatcataatttgaaattttctgttgtcaaaagccttctgaatttgagagaagatacactgagtaacaaagctcttgtcccataattcaagagcatgcatcattgatagaattctttttggacaagatttcaaaggagtttcttggagagcttggtctgaaacttgctttctttcaacttgattccagattgctaaacacatgcattttcattctttggatcataaggttgtatctctcatctaaactctagttgtaattcgttttgacatttcaattgttaattgttattacaaaaggtttctttaagcttgtccagagtagggttctctagagggaagagtagagaaggatttctctatgttttgatcattagaagtctaaagggtgtttagatttcagttctttatctagggttgataaagagtgatcttttgtaaacttgtaaagaatagatttttgttaatagaggaactctaatcaaggtttggttagaagaaactagatgtagcttctcttgttgaggagtgaacctgtatagttcttggtattcttttaatctcttattgctttcattgattgctaatcttttggttaatcttttcaagatcaatagataaacattttctgctattgctttctatgaagggtaagccttgattaactgaaagtttgatttaaaagggtgtccttgtgatacgatccaaaatcctctgcttgtttcaaagaaatctttaaagaccctattttaaccaattcaccccctcttggttaattgtgtgtgttcatattattttcaattactactccaaatcaagcacacttaactattaagttcttaagagataggctaccaaaaagtatatgcatattgttggtataggtagtaccaattaattcctttaagtgatccttagttatacaatcacatatgtgcacagccgcctctagatccctttcattttggtgtgagtcgatcagggtgttacaacccacatttactgactaatatacattacatttttatctaacataaatgaaggaagaaaaactaaattaacaaaactctaactaactgaaatcacaattaactaattaacttaactaccaaatgactaaagcgcctacgaatgtgagaggttgtgcatcacacatcttaacaagtaaagatcccagctaaaacaatctcagagagaaaaaataaaagttgaattactaagtcaattacaaatgtgagaatacaactatttacatctcacaaatactctaactaactgagtccactcatactgactaactaattgtttacaataaagacataactacagtaagtatagattcaaatccatacttgagcgacgtcttcttgagcatatggattcaaatccatatgtttacacccctcgcatgtttctaacagtcgagggcatataaaatttgccaatgaggtcatgatattaaaaccttcatttggaagaaaattaaattctcaaggattggcacccatccatgttgctctagtaaataaccgtaaagaaattatatgtcttctactttgtagacatagacaaagaacttgcccgagcaaaaaggaaggcccttgcatttagaaagtccaaagggtggaaaaaaattgattaagtttttggaggcttgtgtgccctaacttcatcaatgatgtgacaagtacaaatgagactacgttgcatattgctcttaaacatcaaatgtcaaaggttgttaaagtcttgattggatggttcgtacacacaggactttgtactcaacaatcctcaattggaagagcaatgttgtgaacaacactttacacgtttcagcctacaaacagtgtcgatgataacctaatttgctaatataggtatttgtcttattcaatttgctctttacgaatgcggcaaatacctatattaggaaaattagactagtaccagcaaacaaatgagtttgcaatgcgtctatgtcaaacacaatgcgcaactcatttttaatattggccaatcttgctatgacatccagctatcatgcattcttgagtctccaacaaagacttcattagactaatgccgacattcaattaacttttcattccattgtgaattttttgtgctttgcatgcacaacttctctactcatgtcaaccatatcttgattttacacagacaattgcattgttgacaaatacatggattgattttgatgtcaagaatatggaggatcaaacagtttctatgtagcaggaaacgatgtaaggagcaaattaaatgtcgcagatacctataataggaaaattaggttgtcatcgacattttttgatgctccatattcttgacatcaaaataaatccatgtctttgtcaacaaatgcaattgtttatgtaaaatcaagagatggttgaaaatatgacataacaattttgtggaatcaacaataaatttaaatatagacaactagattagaagatacatctaagtaattgttgtaggttgaaacatgtaaagtgatgttgtcagcattgtcattcctgttgagtataaagtgtgtttgtgtggagccatccactcaagactttaacaacctccaacatttgatgtttaagagcaatttgcaatgcagtctcgtttgtaattgtcacatcattgatggagtcagggtgagcctctaaaatctttgtcaaaagctcattttctcccttttgacttgctaaatgcaagagactgaggtcacccctctcttttgttcaaacaagttttttgtctgtctaaaagtagatgatcattttttcacgcgtcttaaaaagtttattggatcctttatcttattttttgtgatctaatttgttcatttatcttattttttgttcaatttgggtctttaatctatctaaaattgacttcattaatcatttaaaagtaaatttttttgttcaattttctctttttcctccactttatttttaacaaaaaaacaagtttagatgattaacaactttaatcttaaatgaatcgaaagactatactgaaaaaaaaaaaacaaacaaataacctgtaacaccccgtgtatacccggtgtattatcattatgattaattagattagcgcttaaaaacactttaattaaacctttttatatagcggaagcataaaatcaaaaccatatttctcgataacattatgtatggaatcacaacccacataagcatcaacaagcccctgcttaaccagatcatacaaaccaaccataggaagaaacataaatatctcaaagatatacacaggaggaaacataacagaacaaaaccagatatatacagcatcaattatctggcacccgaggtgcacatacatgagatacaagcaaccgagtgctatctgatccctaggatccttcctcacacgaggacatacatataagcaacataaactacatgtacaacacatgtcttccctctacaggggtacaaaacataacaagatgctgagccgagctccaagcatacaaaacaccacaataagctgagccgagctccaagcgtacaaaacacatcaatagctgagccgagctccaagctatcctctgctgcccgaggccgagcaggtaccgtctctactggggcctcccgccctgagactgctcctctctaccagaagcatcacctgaaaaagcataagccccacacggggtgagataaacatctcagtaagctcagggtccttggaggcatctcctccaccctggctcactcaccatgacacaaatcatcagggtgtcacaaccatctgggccatcccggccactcacaacaatacaaacaagctatccaagctctatgtacggcggaccgagtcaaacgccgacctcagtgtgaaaccggaattcacacccgtgtcatcccattgggtgctaacccttcgcatggacgcacgtatatggtacctccgagcctaggcaatcaaccgcgacgggacacacctagctcttggtcttagggaatctccgcatcccgggatcgagtcaaccatgagcataccaaactaggaggtgcgcttccctcctagggaggtccatatatatcttactggccagaagatctaacatcaggcttaatacaatctcaagcacagatacaagcatgtatagtatgagtatgcaacatccacataatgcatgagtcatgaatgtaaccactactcccacggagtatggtggagcacaagcaagtgggaaacatccccaagggtccagaacttacctggcaaagccgagctctgcagttcttcccgtgctctgtggcccacgccactgacacccgtggtgtcacgccctatcaaggcacacacataacatgtatcaacatacaagccacacaaggcacaagcaatacggttcacaaccgctcacaatgaaaggactcacaatcctttcccaaccatcaaggtcatctatcctatggttcaacaagacttggcattcacaagccatcaccacaatagcctctcaaggccattcaaaccacaattcaaggccctagcatgttcacaaatggctaagcaactcagcccaacaacaacacatgcctcaaaaagagccaagaattcaacattcaccaaactcacatatgagagctaatcctacatcctcacaacattctaagcacatgctttaacatgacccaaggctaaaactagctctatcaaaagtgggtcactattcaccctaaaccccaactcacaaatcaagaggtgaatcttgagcttcttacctcaaatgtcgcaaggaagacccccggacgacttcccctagcttgggtactcacgaatcgtcgccgttcctcgctgagctcgagttccacgaacttcccttgagaaagggattcttacaatgagtgggtttgaggggaaagaaaggatggattcaagctctagaagtgatttccatcacaaaacaagcttaagggatggattttggtgagatatggtgaaggaatggagcttgggtgctcaacaatggaggtgggggtctgagaaggaagaagggagaggtttggggctcaaaatcgcgaaaatcagctttatatagtgggtctgcccgagctgcggcgctgatcgcgccactctggcgctgatcgcgccagctgcagacatccacggcgccatccgcgccagccccgcgccaagagcgccggcccccagaacctctggtgccaagagcgccacatcccgcgccaagagcgccaactcccagagcctcccatgccgtcagcgccaactccggcgcccagaacgtcaacctccagaggttcccgtgccacaggcgccaactcccgcgccaggagcgccaacctctagaacttcccgcgccaaccgcgccacacacagcgccaagcgcgccagttgggaaacacaacatggtctagcgccaccaacgccaccttggcgcccaaagcgccaaccatcagagaccatggcgctgggagcgccgctcccgcgccatcagcgccagacaccagaacttgtggcgccatccgcgccaccctggcaccaagagcgccacactccagaactgtggcgccattagcgtcgacctggcgctattagcgccgcaattatgcagaagaattctgcataaggttttctgcagaatcctgtgctaggcgcctcccgattcgcgtcatacgcgcccaaactcgcgccgaacgcgctagaacttggggttatcacataaccagaataaaattcttgcaaaataaaggtctaaattgaactaaaaattaaaaaaatgacaaattttaactttttaatgataaaagactaaacttaaaaaaaaaattaaataggttatttcaccttatttaaaatgtttttttagagagtacatcgccacaaattgctagtataaactattggacttacccacaagcttcgtttgaataaaaggcttcttaacaccaataataccctccctcaccctcaccctcaccctttgcctatataaataaaacaattctgtgtacggttccgtcagccactgcacccaacggcatcatggaagacagtttcagagtgcgagcagagagagcctttggttctcttccaatccccgcttcttcttccctcaactcgctctggtctctcacccaagacgaaatccaaaacaccccttccaatcgcacccccaaacccaaaaccaaaactaaacccgaaccccaaccctattcttcttccagttcccgggttcagctcgagaaggacctcaatgaattcgacgacgacgaagaagaagagccacgtggaccctctaaaccccctgattacgatgatgaacagtggcagattagggctggtattggccgagattgcaccctcgattacgaggtatgtaactttcatccctcttttattctcccccggccccccccccccccaaataatatttttatatatttattatgaactaacatcgtttaattataattttaaacccatttcgctcaaccaattagatgaccgaaattgatttcttttttcatttataatttagaactgcaatggaatcaattatttttctttaaattttgcatcttttttttttttttgtgtagaaaaattgggtagcaagaggaggatgtgaatgtattgaagaagtctattatgacggtgatggactaagattatatatttaaatttcaaatacaacaaaacatgtgaattaattggagcgggattttcaattgggacgttgttatttaagtttaataagttgttttatattattattattatttgtgtgagctccaatcaagaatttaacttgagagtattattttttttttcatttttgtgattcttgttgtgactaattgttactaatttttcatcttcaaagttgggattagtaaagaaaattgattgaatctcactttatgcaggaagaggaggatcaatatgacaagcaggctataggcaaagagaactcgggtgatcgcttgtatatgaaggatataaatgacgatggagttgagattagttcttgcaatgttttccccacttcgttcagagattttgtgagagacccgcgtgcaaatcatttggctgctaggattaggctgaagcaggatgacgaagcagcagctaaaaaaattgatgctctgcatgtctctgagaaatctgcaccagacattggtagtggtagtgttggtgatgctgttaacccgaagtcaatcttgagaagtaaggataatcctttggagcccaggccgcagaaacgtgttcggtttgattctgaatgtgacgatagaggtaatgatgatgatgatgttgatgggcatgaaggaaccagggatgttcgcatgaagacctcttcaatggaagatgctacagcttcggatcagttgtcaaagtcgcaagaatttgattcagcagttccagattacattcgtaatccttcaagatacacgcgttactcctttgatgattctccaagtgacatggatgacaaatcaaataaggaagcatgcatgagcttcctttcacagttgaaggggtcaaatgctgccaagggaactggatctctagcagatgaagctttggaagatcttccatcggtaacctttatatcaaagaagaaatctggtgatgccaatatgtgcgacagtgaaacggtgtcaaagccaaagcttgatgctggcatggaggccatgaatagaagagccttcgctgttggcatagctgctggtgactctgaaaacagtgacgcttgtgcaatggaggaagatgaaccagaagttgaagacgataaaaagagctcgcggaagttaaaccgccagtacaggaagaaagctcaggaggagcctgtgtaatggcgtagttagttcctagacttgcataatttgacattatcagactttacccttttccccctttgtttccctcagactagtgcgggatttcgtaaatttgtgggacgacatcatgtgccaagatttgcctatggccaagttcattagtttctagaagtagaactgctgtatgtataagcttcaactcaagcataatgatcagagctaagataagatgtgttaaaaatgtatttttctcaaagtatcaaatagtgaacagttggccagttgcccataatagcagttttcacttggtttatatttcaaagcgtttaattctctctttgaatataaatatgtgaaatgtagtccataattatttttccacaaacttaacattatgaaatattctctctttttcctaatagttatcgtgtaagaaaaaaaataaattttataataattattattttaactttttaatgtaatattaattattttttacttatattttttattaattatgagtaacaatctaaaaataattaataatgaaaagattaatattgtaaagttattattttcttttatttatttattatttttctttattacaatagtaatagaaaggagggagcaagtcggtcaagtataatttaaaccacatgatatattattattataataagtagttataataagcggtccagattctttattgattatcggttgagtttgttttgttcgattaacataattttttttcttttctcccacttaactcccctctatcggagacggttgcgtctcctcttcttcatcactggaagtagctcctccaccccttcttcatctccttttttcatgcattatatgctcaagattcatgtactcaaaataaaaataaactattataaaaaaaagccaccaaaaagaacaacattgaaaacaattttaatccaagaaaaaatggtgaagtttggtgtgactgaaaacaattttaatccaagaaaaaatggtgaagtttggtgtggtggccattttttgctactgatttcttcatgtgcaatccctcttagtgactactgatttttaatattttgctactgagttataatattctttttcattttttctaaaaaaatgagaacgaaatgaacgcggcgccgttccaaatgcttctcactctccctctagtgttagaattcacatgcgttaaatataccaaattaagaattgtccatgaactgcttgatagaatgacaaaatgaattggaatttctgaaattttgaagatgttgtgcatatgtgattgttgggcttaacttgcgtatggtagcagcgataagaatagatatgtccaccagagggagagcgaagcggtagcaagcagcacggcggggggagagggcagacagagagcgatgtgttgggaggaacgcccttctctaccaacgaacagagagtcacaccagactcaacactcaaacaatcaaaatagaataatgcggaaacgtgaacgatcaaacgcgagaaagaacaggagagaagaacacaatcaaaataactttacgtgggagaaaaccttcttcaacacgaagaggaaaacccacgggacctagtccagaaacaatccactattatcaataatggttacaaacaacctcaacagcctttcgctgagacactctcctcaccaacaatggcaacacactctcaacgagggttgctcactcaacctctcagagacactcacagaagaagctctcttttctctctgcactcaaaacgagaattctctccaccctctagtttctgaattctaccgcctccatctataaatgtcgtatttatagagaggaattaggtttagggatttcaacaccctaaaatggaataggccagggtcagccctcgggaattgggcccaagtcaacaaatcatttttcaacacattgggatttgaaccaaacattaaaaacggaaatatccaacatggtgcaagaggatagatgaagagaaaggatgaaccatgaaggtgtgatggccatggtggacagtgaaggtgaaggtgtggtggccatggtgaggaagtttgggtggccacagtgaaagtgcggtggccatagtgctgtcatccgagaaagaatgagaaaagaaagatgaaaacataaaaaattattaaaaatatttttgtttaatttatatttttttcttccgatttcgaacctgctatagcctgtcaaaattctgctacaccggtgagggagggaaaaaaatactacaccttagaatctgccgagcaagtcttttctctaaatatttaaatcttgacccttctcttttctaactttaagtgtagtccttgtaggtaaactcccttcattgttaacgtgaagaaactcctaacaacctcttttgcaaatatgctcgctcaattctaccgttaaattcacttttgtgcgcagcacgagattagtctctgaaggttcaagtggaacattggtactttcagtgttatctatgacgttgggagataccatgaaaatgatttgaattaagcaaggaaaatgtccctctacaacatgttagatggtaagttataccgacgagttcatcaccacttttttaagtgtttcgttcccttaaattcataatacatgcttgtttctgaaagttagcagcaaacaaaataagtaatattatgctttatcaaatcctagatgacaaaagttggtgaaagacattatgcaacatttattataccaacgttcaaattacaatgaaaagaataggggagctttaacagattataacatactctacaattctctataaagccttaaaggaactaatgcaaataataattttttgtttgaattgtagtgacatcattctatgtgctttcttgggaacgtgcttcatacaccatttctttttctcatacaccatttggtattttcataatacccaaaatggccttaatgaaagaaagtaatatataaacattaagtaaagcaaacgggagaaagctctgagctgctgtagttttggatccattgtttgagcttgtagcattgcttggaatcgccatttgtgaggtttttggaggtatgcgagctgtagttggaggtctggggtcgccggagaggaagcgcggaggttgcagttgaggtgagtggttttttctgcagtatggattcgataatccgtagagtaatggtgcgtggacgtacggattacgcaatcctataggtcacacggattgcgtaatccgtatgacctatacggattaaccaatccgtgtagctcatacggattgcgtaatccgtatagaaaaaaaggtttaaaaattaagtaaaaaagaaatttaatttcaaaataatagcttcaaatataaataaggacattttaattataaaaggtaattcatacaagatagatggagacaaacatcagaaaaatgttattatttaccgtgtatgtgtgtgttttcacatggtatgttaagttgtattttattttgttagaatggacgacgatgagtggatgtacgagagtataatggatgaagatatttacatgaatgaagacattggagcagaccctgctgacgttgaggacaatgactgttttattgattgttctgcagcattccaaacaaatgaggtgattatgttaatgacttaaacataaagaataggaatgtagttaaagttgttgaatgagtatgtttgaaacattacatatgaattattcttttgtgtaggtgtttgaatcgcgtgatgtcgtattgaagtgggctcgttctgtggcgtctgagaatggttttgtggctgttatcatgaggagtgacaccaagacaggaaaaataggaagaacgtcatttgtcttaattggttgtgaaagaagtggaaggtatagagcatggaaaaaaggtttcacaccagcaaccacaagtagtagaaaatgcgagtgtccttttaagctgcgggctaaaccaatcgcgcgaaatgaagggtggatggtgaaggtaatatgtggtaatcataatcatgcattggccaactcattttgtgcacacccatatgctggtcgaatgactcatgaggagaaaaacattgttattgatatgactagggtgatggtgaagcccaaaaatattttgctaaccttgaaggagtacaatgcagataacgtaacaagtttgaaacaaatttacaatgcaagatatgcataccggacgcgtacaagagacgctaatactgaaatgcaacagctaatgaagcttcttgagcgtgacatgtatgtccattggcattgagtgaaggatgaaaatgttgttcgtgacttgttttgggcacatccggatgcaatacaattgagcaatgcatatcatatggtgttcttgatagacagcacttacaaaacaaacaggtataggctacctttgcttgacattgttggtgtcacacctactgggatgacattcagtgctgcatttgcatatttagaggcggaacgtacgaacaatgtggtgtgggcccttgaacggtttagagggatttttcttaaaagtgaatttttccctaaggtaattgttacagacagagatttagcattgatgagtgcagtggaaaccgtttttccagaggcaaccaatttattgtgcaggtttcacattgagaagaatgtgaaggcgaaatgcaaaacttatatccgacagcagaatgcatgggattatgtcatggaagcatggggaagtgttgtcgactgtgctaaggaaaatgaatttgatgattatgttatgaagtttgaacaatatgataaccctgcaacatactgaaatcaaggcatctttggaaagaagtacacatatggttggacatgtttttaaagtgacgttatacaagagactcattggcatggtgtccaggtatgcgttaaatcaaattgctgctgagtatgagcgggtgcattatgcgggaaaaaacccatctcgttgtggatgtgtgcttagaacagcgtatggtttgccttgtgcatgtgagttatataagtatgttcttgcaagcattccaattaacagcgttcgtgtgttttggcggagattaaacttttcggataatggtgaagatgaaaaccaagttaccataacagatgagatggaagccatatctaatcgttttgataagcttgatttgtgtgaaaaaataacactaaagtcaaagcttaaagaaatagcgtttcctgataagaattccatgtgccctccagctgctaaggtcaaaactaaaggtgctcaaaagaaaaacatctccaagcacgaacgttttacaagaagggacccgtcttacttctagtatgccgatgagttacattctatgcagaacagttgctctactctcatacagtgcaactcctcatctgatgttctaataaggaaccggatggttcctatgctcgatcaatttcatccatttatgcacaaatttattgttgacattactgatgtcaaagctgatggaaattgcggatatcgagttattgcttccttattaggttacggtgaagaggcttggtcattagtgcgcaatcatctccttaaggaacttgcacaatggaccgatcaatacattgcgttgtttggtgggatacataggtttgaaatgttaaagcggtccctattagttgatgggttgtccaaggtaaaaattcgtttttattttatttaacattatttgccaatctgttatattatccatgcatgttttattaaacaatgatgtgcaggtaacgatggagaagtggatggatatcacagacatggggcatgtcattgcatcaaggtataacgttatcctagtatccctgtcacgacagcaaagtatgaccttttttcctttgaggggccaacctcctacagatccacgggttcatcgagttttgtgcattgggcatgtgtttggaaaccattttgttaaggtaagacacatcctaattaattcggatgcatgcttcaaatttaatttatcagattgatgatttgtgtaacaatttatttcaaataggtaactctggccgacaattgtccattaccgttgactgcatgtttgtggcctagtcattgtacaaccgaagctcagcagtggccttactattacgttgattgaatgcagttgtatacgaaatcgatgaagttatgcacaaaatatgttgatttgggaaatgtttagacactcagttgacaattgaaatgtatgtgtttacttgtttaatgcatgtgaatcattaaaaacatgttgcgtgtcttaagtaagtaaagaacgaagtaagtgcaacatcatgacggtgtccaacctatctatacgtctacgataggttgccactggtaaggccttcgcactcgtccatctgcaggatcgaggctgcctctcgtcgtagtgctggtcagcaggaacatttcctatagtaggaaaatgctcatatatccagcactaaaaatttaaaagcatgcaaatcagcaaataatggaaacaaaagacatataaaataaggttttctaattatacacatcaaacgatattagttcctgtaaaagagtgatgtatcctgcaagatgcttcccgtgatgctgacatgcgtagctcaagttctgatacatgtgtatcagagcagccgcaccctaggcgaatcccccagatcggtcgaagtctcgaaacgcctccaagaataccacggctatatgtgtggcactcttgttggcgaacaatgtgcaaccaacaaggtgaagtagatatgccctggcggccaaaatccactgcctcgcctcgaccttcgcgtaatatgtgtcccgaagccatgatagtctgacataaggcccatgacactgcgatgtctctgctgcagcctcctccacagtgacatcaagtaggtccaccagcaatgtcatcgccgatctccagctgctcgaacgggtcgaatgtccccataacagggagatgcagcagtgatgacacgtcgtcaagtgtcaatgtcatctcgcccacgggcaagtgaaacgaacatgtctcagggtgccaccgctcgacaaatgcggatagcaaccccctatcacctgtctccactgagcatccaatcaatggactgaggccagtggcagccacaaagccctctatctcaggtacaggcttcccaaatttaatgaccttacggccatgggaagcaagcttcaactctgcatgatcctgcatttaacatattatttaaggtaaaacattcatggataaccaaatgtatgacgacattcgactatgtgattcaacatgtgaatacctctccggcccagacgcgtacagccacatgatcgcgaaacccggtaagcactgatgaatctgaaggccctccagggaaagattcggacactatgtccatatcctcggtgaccagatcaccctcctcagtgatcggatcagccgtctccacgtgtggttcctgcacggcaggaacatcgtcaatagcaacacccgccctacgacgccgtgcagatgcagtgggcctacgtcgctcaggggcatcatgctgatgacctctcccatgtgtaatatcggaatcatcaggacggtgtccaacaggccgacgcactcctcctctcgtcctagccatgtgtaatctacatccgcatattgtatttcagacataacaattcgttcatatcacacaagtgtcatcaacactttgtcaaaaagtgttggacactcaaatctacataacttgtccagcttcatcctttactttcgaaatttacttcttttattcaatcaaactactatttggatgaaaatgtggacatacaaagcatgctttcaaaccatacctaatcaacttagatgtcttggtaaatattaacaaaactatgatcatattgaaaaattttcaagaaatttgtgtaaacaatggaaaccacaagtaactgtgcaaagagcatcaaagttttcaaaagagcgatctatgtcagctagctgcaataacaagttctcataattttttatcatatttttatgtttccatatatatatttattctaagttcagacaatatcatccttaatataacttataatgcataattatgatatatgtacattgccttagtcaataaatatttaacaatatatatacacatacatactggaatttgaagaatttaaaaatttcaatttatttcctgtttttaaatgtttgtatacaaaatagttaaaatagttttaaagtaaacaaacccttgcatgtgtttctaggaaacaattctatactattaaacattttttccttttgcaaaaggcagttactgttttccctagctaacagtacctttagattcatatgcatgtgtctcctaaaagttgaaatataaggaggggaaattgcatttttcaacacaaacaagaggaggagaaaaataaaaaagagacaaggcatattggtctttcctcatatatcaatggcataattgttttttttttaattacatcaatggcataattgttatgatctaggtctgtgactctggtatcatgttgctctccaatatatttcctgtttttccttaattatttaccatttttttttcaaaaatccatatttttaataaaatagattccctacggatttcacaatccatatcctgcttacggattgcataatccgtacgaattatacggattatgcaatccgtaagcatgatacggatccgggaatccgaacgaagtgcacggatcagtcaatccgtagatacttcacggattaggtaatccgtatgtagtttacggattctgtaatccgtaaactacatacggattacgtatttcgtgaagtatctacggattgactgatccgtgcacttcgttcggattcccggatccgtatcatgcttcccagctccttgccaccatttccgccatgcccgaccaccacgcaccaccatccacaaccataaaccacccaacgcacacgcagaacacacgcacaaacaccaaacgaaaatgcagccattaaacttctatcacttacctcccaatgtcgtgcccacgaaacgaagaagacgaagcacaccccaggtcaccacgagctgctgaacacttccaatgcagctgctgtcaccagttgcagcaatgccggcgtagcgagcaggaacggcgatggagagaacacaaaatggtgcaggaagctatcggaacaggaaacacaaaatgatgcaggaagctaaagggtgcgcgaagtgaagaggggaaattgattttcaaaataataagctgagggcaaatccggaaattcactgttttaatatggtgtataagaaaacaaaatggtgcaggaagctcatcacgctttcttgtactttgtaacttcgtgaacattctgagtgtataggctaaaaggatttcatgtcatcaaggacgattgcctcatgagtttaccttgtaagtatatctcagtgatttgcgtagagcctgtaagaagactttgttaagaaaacaacattaagtttggttttcaaataatagttacaaaaaaatttcataacataattcaatcctctttttcgtgtttagataaaggcttagacaaataaagggtcaagaaggaacattgaattgaattaaaaagggtatgttaataataaattttaactaatgatgaaaataatgctcaaaggagtatgtttgctagtattttcatcttacataattttcgctataggaaccataatctactttaacctaaacttttttttttctatcttttcaatttgtccagtcatcagttcaattaataatcaccaagttacatgacgacttagaaagtcatacactcatattttcaagcataataatctattatttattgtttttatttctttccataaagaaattcaacgaatatatgaacctggaaaattgaaacaaatcgtacaaaaaatataaatgcagtctatcaggcacacttaaaccgtaaggcaacctccaatatttgctatttggttcttttgttttttttttttttttcctcattttgatcgggtatccttcagtatttttagtgtctactaactagacagttaatacttttaaaagtatagtctccttatatctttaaataagggttaaattaattttttaatttcaatttgatctaattttttttcaggttcagttaaatcttccaatttaaattttaagggcattagaaaaagcatgtcatgccaatgtcatctcactaaattttacaaacattgttagttcaatttagacggtaagacgaaattaaacctattttaaaattataagatttaattgaacccataaaaaattagaaaattaaatcaaacctaaaaaaaaagagaatcaaaaaactaatttaacctaaaaaaaattaaaaacaccataaacttgcagtaatcagtaaagcaggttatttctagcaaaaaaaaaaaaagcctatatatatcatttacttgaatcggcacaaaaaattacaatgttcctttgctgcaatttcagcccaatgtatatactgcacacatcaaccacgcatgaatagagcactttgcagctcaagttttgaacatccaatacttaaccgcactaattttgcaaaaagaccacatacaacttttcctacagtggattagaataatcgcttcctgcagacggatgctccacaataacatggcatttgcttgatcttcccatcagagtccaagacgctatcaagcacataaccatagtcatacgttaattcctgcaagcaatcaaagagattcaagtcattgcttaaaatggtatcagataaagtgggagaaaatatagaaaatgagttacctgcaaagggggtatgttgtcagcagcaaacagcattacacgagccaatctcaaatcattgtgtgtgctcaaaacacattgaacaaacagattaggctcacaacaatggtttataaacctagaaatatttccagtagatcctgcatcaatacaaaactctggcgcactttcagaacattgatcatgatatttgtccaaaagatttgcaggaatatctccatcttgtgaccgccgctgtcaaaattaacatcacccatgagataagacaaaggttctttgcattaaactgaagcaactgaaaaaaataatgttacaagatttcttaggattcaatacctctcttccccctagcccctttatagtttgcaagcaatctatctcaaaaatataattgttttctaaaacgctatccatatcctctgccctggcaagtattcctgtgtactcacacactagtgctccagaaggtataaaatcccaggatctaacagcccatcctttttttgcagtacggaaaacctatgcaataatttaattaaatacacaattaaaagcacaatatattttaataaataatccaaaaatgtggaaaccaatatgcaacctccagacgatatctaagtcctctttgagaagttcggttcacacaacctggaccacaaccacattccggaccacattcaaatactacatctttagcttcaactaacctgtcaatatatacatgaaagccatatcaaatattaaagcaaataaaatttaatatgcatttaaccagttgagtttctaacctgccaccatcccgagatacatagggaaaatcagagccattacgcaatgcacatgcacaggttgttgggtcattacaaatgcctttacatttgcatccagtggcattcatgggaagcttcacatttttggcaaccttaagagacttacaatatgtgaaacctataatataaaaaaactacacatcaaaccaaagtacgcagagaaaaaatttatccaatatttaaactaaaatagtatacatactatttgataaccattacaacattatttgtttaaaaacatcaaccatataagcaaattagcaggagaaaaataaatacaataaaattagcaaatctacttctcaagccagaaatgattttctactgaagcctgctcaattcatcttatttcagaaatataattattgtgccagtgtggtcttccccaagatagcttcttttttttttttttttcatgattttttaacttttctttgaatcattgggtttagacattacttcgggaatcttaaatcattccatgttagtttatgtagttagctgtttaactatgtagttagttagttagttatggcagtagtatttgttatggttatacttcagttagaagctagtatcacaagtttataatgcataaataagagtatgttgattctccattcttgtaatcagaattcaaattaattcacaactctctagttattgttttctaagttcatgtcccctctatttaaattcgaatagcaatcctcaacacgggtgactttccaacaagagcttttttaggaactttaaattgaatttcgataattttttaagaaaatatcatcaataattaaaaatagccatgtatcactataaattattcatcataaatctaaatatagttatatgttaaaaactaaaacgtatttatttataacacattttaattataacaatttaaattttaattatttaaatgaacaggagggggtaaatggtgtgtatggttgatagttggttcctcaagatttttttgaaaataataaatcccacaaacagggcacaggaaaaaataaaggagttaatgataagagagattcatggaaggaagagttgctgaataataaattccatgcactaaataacattgaaaaaccctatagaatttgttttcaaatcaccccccttccccaccatttcaggataagagggccactgacgttgggagcagggatggaacaatagtaagaccttgaccactgactgatgaaatatgtattgttatttactctgtcaatcaattaagaatcactatagatgagttttaaaacacttattataaaagtcagacatttagtccttgaccattgactgatgatatagtgttatttacactgtcaagaaattagaaatcactctagatacaagatttaaaagacattacaaaagtcaacaattttcaattaatggcaattgatgattgaataataaaaaaataatgtcaacaaccttcaatccatgattgatttaaaaataaataaattaacgtacccctgtgccagaaacgactccttactatgtgaaggtatggaagaagatcattgtacgcaaccttacccttgcatatacaaaaagactttccgaattcgaatccatgacaatcgatgattgaatgaaaattttaaactaattatatcactatatatgtgtgtgtgtgtgtgtatgtatatattgcaaaccccttattgaacttgcctgtgggtggaacaggggggtcatcaaccaaatttgtagccggaattggcatatcttcttgacctccagtgatatcctcacaaaccaatctaggcaaaagtataccgagatattaagccaatataatttatacaaggtacattaaatattcaatttataaaagtttcttttaccctcgtatttctgttagagtttgaggtacacgtccataagtaaaatatacctgttaacaatgtaaaataagcaaagatattttaaagccccactgcttagattacaaaataaatcaccctaaagaaacatttggtagttgggatagaacaagacagaacatgtggattctgttctacatttagtgcattttaaaaatagacacaaggttcaaaacattaaaactttgattccactaaaaatgtaaaacaaggaggacaacattaccattgcatcaaggctcaccatcataaataaacagcaatttcatgtaaaaacaaaaggcaacaaaacaagaaatgtttttggatgaaattataagaattataataaacctgatttgtggttaaagtaggttgcccttcaagcctcctaagtctaaacttgtagactgtaaatccagatattcccttctctgcccaataattgacaacctgcaatacaaaaaaggcacataaaacatttgaagtacaacccttaacttgcatgcaaatgttgtccccattttccgaatcactctttatcagcaattaacatgttcaacattagagacgagagcaaatgccacaatgaagacaactacaataaaatcggaattagaagaaattcaacacaactcctagctcatctcacgaactcttctctagtgccaaaataaatcatgaaaataaagcatcaatcgctttctcacaacagattatcaaaacttcctaatactaattactaattgactctgattaacaggaggagattatctcaaatatcaatgaagtatcatcaaaatgcattagttgaaaaagaaataaattggcttaaaagttaactaatcaaatcttaaattagaacacaaaatgccaatcttcaggcatcaactagttagtttccccatcaattcaccacgttttaaaatttacataaaattttaaatatgaattaaaaagtaagaatccttgtactgtgtttttatatatatatatatattctatttttgctgataaaaaaaaaaaatattaatagtatcgttgttaaacaatgatgaaatcatatacctcaacaaggaatcaagtataataaaaaatccatcactatcaataatctggatattgtttcattatatagaaatcaaagtgatgagacattaaaaaaattatataggaataaattaaaaaattaagacgtttgaaattaaagagtaaaatatggagtgtgaatcaactattaatctgatatagtgtgtcaacatgtgaacctcaaatttgtagacctagaaagttcaaggtattaacatcaagacaagttaaatttgactaatttaaataatatttggaaaaaaaatagaagaaaacacggcacattgaaagtatcaagaacgtactcactcatcaaagtcctaactcagaagtgtgagaattcaaattttaagattttaaaaattaagatttgatatgttaagctctctatgcagatacgttttgtcaaaatgaaaatccaatcactgatgaacaacagatttgagtaagattttcatagaattaccttgtacaagccatcatatgtgtatactttaccagtgtaactgcttgaagattcgtgaccacgaatgactctaacaggcacacattgctcagcacaattctacaattgaactcaaagcatgttagatgtgcctttgtaacatcaaatcaaataggttacagtggttaaggaaaaagaaacatacaaatcataaaaaagtaacgtacaaaagcaaaaaaaactgaaaagcatggatacagcattggacacaaacatgttacaatatagacacacaaggagctatgagattggcttggtaggagaagggagagattggtggtttgaatccctcccactaacattctaacaaaactaacaacattggttgataaaaaagacatggatacgcaatacgacaaaaattaaatattatagcatgcaatggaatcataatacaacatgaaaatcattgtttcaaaagtgagagtgagtaacataataaaatactataatttatctcattattttaaatattataaattgtgatattagagggtgagccttgacacagagataaaattgtgttttgatgacttgttaatcatggtttgaattcggaaacaacctctttgcatatgcatgggtaaggcagcataaaatatttctctcctttaccttcgcatagctaggagcctctgggcaatggagtatgtagtttttattatgaattgtgatattcccatttgtgttgatattaaagttttcaaaataaaaggtcaaaaaaatatataatatgcagtttagagtatttgcattgtctatgaaatctctaagggtctatttggataagtttatctagaagcacttctagaaaaagagaataagaagaaaaaatggaataaacttctctttaagctaaaattagcttatgcataagttattttgtaaaagttttctcatataacttctatcaaagatgagacagctactagaaattaatttgagtatatggagaaattcatttcatttttcttcttattttcttttcctagaaatgcttctacataagcttacccaaaaggccttaagaatctaaatattgatgcatgtcaaacaattatgacacacaattacttttttcaagtggttgtgattccgggaatacaacatttcaaaaagataacctagcaccagactccaaagcaattaacataatcgacaaacatcatggacttgaataatttcaggaatgcctaaaaatagaagtttgttaatgaaaaataaaaatcactcgctcatgatttatgacctgtgatctgaaacccaatcatgcttgattataacctaactttacctttggttcttgtatttaagaatgagagatattcaaaattaagcaaattgccaaaggatgaaacaggagtcatatgatccccaaatggcgatgcttgctagtttttttagtcaatttagagatgagagagaggtagagagagaaacagcgagttgggggggggggatagagagcatgtgagtcacaggccagcatggttgtcaaacttgcgatttaaatcgcaaaatcgcacgattaatctcttgcagaatcgttttaggggtagactcgaacgattctgcgtagaatcgtctgattccaggcagaatcgcgagtgagcatcgattgagcaagtccgattttgtccaaaacggcaccgttttggaaccaccacacctctgtcaaattcacgccaccactgcacctccattaatcctttgcaaccaccaaacttctgtcaaactcgcgccaccaccgcaccttcgttaaacccgcaccacaaggcggtggctctgccgccactgttgcgatggtctatcttcggcgtgttgatgcctgaaggtggaggataggcacgaagcaaggttatgttgggctttgatctgcctttttctactgcatatgatctgccttctctcaattagatggagaagatgatggattgtggaccccactccaaataactacacgtagccagtatcatttttctttttttcttcttcaaaatcccatatgggcattggcccaaccattattagtgtgtttatgaaaagccagttgctatatccacctcccctattttcttatccacttccctttgaatttatatttgatatttataagtattttttttgtctgaagtagactcttacgattctacgattcgattctacgaggcctccacgagtctacgtagaatcgcgattctaacaaccttgcaggccatgtcctaactacgccggcaaatggtacaagcatcatggagcgtctccaacagagacagcaatggcgataacaaaggggaagggaaggagtaacaactggagagatgcaccggacataatgtagttctatttcacaagattcccagaagacatgggtgaaaaggagctatggttcgagttcaagaagtggggcgacgtaagagatgtattcatcataaggaattgtaatatgagtggacgcagatacatttgtgagatttaaatgggttgaagatgccaaaaaattagagcagcaactggataatcttgttattggtggcttaaggttacacgtgaatctttgcgaagcacagaagagattttatcattgcatatctccttcatatttctcctttgtctcttccttgtcttctattactattcctaaaaatgttcaagagacacttgatcatcccggttggcgacaagccatgattgttgaaatgcaagctcttgagaatagtggcacatgggaatcagttcctcttccccccgggaagaagacagttggctacagatgggtttatggtgttaaagtcaggcctaatggggaggttaatcaacttaaggctcggttggttgccaaaggctacattcagatttatggccttgattattgtgacaccttctctcctgtggcgaagatcacaactgtttggctcttcctagctatggcagctatttgtcattggcctctttatcaattagacataaaaaatgcatttcttcaaggtgatttagaggaggaaatctatatggagcaaccttttggttttgttgcttagggggagtccggtttggtgtgcaaattgcgtcaatctctctatgggctcaaatagtcaccaaatgcttggtttggcaaatttagccatattgtttagaattttggaatgaagcgaagtgaagtagatcacactgttttttattgtcatacttctttcgggatgtctatgttgatgacattgttattacagggaatgatgttgccaaatttttttggcaatgttattcatcaattccataatcagtaccatttttacccattcccgctccaccgaaaagtcctatttttcctccatgacgataaggagttaaaagatctactacttttattccaatttcaaaatggctaattttgtatctaattgtataaatgcaggcgcaaatctatgaatgggagatgttgtgcgagtatatgatatgcaagtgaaacaagttcttgctaatggtaaaaagggagctttgaatgtgggggctgttcttattttaccggaaggttttgaattgacaccccccgattgtatttcaccctagattaaaaagaagataggcaatctgtcttttcaaaactatcaccctacaaaaaaaaatattcttgtggtaggccctgttcctggtcaaaaatataatgaaatcacctttcctattctttccccggatcccactactaagagatgttcatttcttaaaaatatccattcttgggccagtaatataaggatcggattttgtaattaggggggggggggggggtgattttataggatactttttgtggaggggtacaaagacctatatagtcgtatggattcctaaatcttgcaatactgcagtattaggaagtatttcagggttctggattgtttgtttggggataagtcttttaggaagctagtatgtgacagctggaattcaaacccgatgtcgggctggggtgggtttgtgctgaaagaaaaactcaaaactttgaagctgaaactaaaaacctggaacctgcatcactatggtgacattcagctaaatattaacagaattcagtatgagatgaatatgctggaaatggaaggcaaggtaagattacttagcgatgatgaactgaaaaagagaaagcaattgcagcaggatttgtgggatgcctcacaggcttatgcctcaaccttaagacaaaaggcgagatctaagtggatcaaggaaggagactgtaattccagctttttccataagatggttaactggaaaagaaggaaaaatatgattagagttatggttgatgggtgctggctgactgacccgtgtaaggttaaggaggctattagattatctttcaagaaagatttgatgaacatgtgcggggcaggactatattagacggggtcaagtttaaagtcgttgatcaacatcaaaacaactcactggtggcgcggttctaggcgaaggaagtgagagatgttgattgggagtgtgggagtgataaaagcccgggcccggatggactgaacttcaagttcattaaagaattctgggaggtcattcaacctgagtttttgcattttatggatgaattttatgttaatggtcgattcccaaaaagtggtaatgtctccttcttagctttgatcccgaagatgcttgatccccagtgtctcaatgactatagacctatttctcttattggctgtatgtataagattgttgctaaggtgctgtcattaaggctaaagaaggtcctgccatcaattattgatggccgccattctgcattcatagaagggaagcacttgctgcagagcatggtcgttgcttctgaagtggttgatgaagcgaatagaggtaacagaagctgtcttgtgtttaaagttgactatgagaaaacgtacgactcagtcagttggaaaatttcttttttacatgatgcagcggctgggctttgatcataagtggatcacatggattgaggactgtcttaaatctgcctctgtttctattttggttaatgggagccctactgcagaatttaacccacaaagaggactttggcaaggggacccacttgctccattgttacttaacattgttgcatagggtctttctgggttgctgtgggaagcgctggaaaaaaaaacagatttgagggctataaggttggtcatagaaaggtggatattagcatgttgcaatatgcagatgatactatttcctttggggctgcaacagaggaaaatgttagaacacttaaggtccttctcaaaagctttgagttagtgtcgggttagaagataaattttgctaagagctgctttggtgcatttgggttgattgatcagtggataagtgatgctgctatgtacctgaattgtcgtaagctgctgctacctatctcatatctaggtatccctattggggcaaatcctagacggcaatgttgtcaagatcgcgagtatgatcatatactcgtgtgatcttacaattttcagaggggtcgccgagcttcatcggagggaggatcgtggtatttgcagatcgttgggggatcgcgagtctgctcgcgaggtggacggatcgacgatccgttttgatcccagtggcttcttagaagctctcctctgcgcctcttttgttcgtcactgctcgcaccaccgctgctcgttgctcagtctcgcatcagacggagatccgcgtccgctctcgcgccagcccttggagatgaacaagaacgcgttcgacaaggttgaagtttgcggatgcgtcgccatggcataaccccaacgacgctggcttgtgtttcagagggtatgtgtgcgtgacccggaagaaggtgttatgtttcgtaggagtcacacaagcaaggagcaacgaagtgaagtagttggccttgcttttctctctctcagtcactactcttatcactctctttgctagaattttattttttttattgcttgtttctttctagagtcttcttttaggcacccaccatgtggaccttgctcttctgagaagacaactagatgcccgtgtacaatcatttcatataaatattattaacatttgtttctgagaaaagttttctctctctcactcactactcttaataaaattataaatattattattaattaaactaattacttttttaattgtaataaattaaataattgagttttatatataaaaaggaggaagtatattatttttaaattaactattgtataaaaataattatctttaaattatatagtatttttatgattagaaaataccgtgataagaatattttgagatattttctaattctaatcattttctactttgcttaaatgtttttggaaaatgaatttatgttatgacttgtgaacttattttgagttgtgttatgttttggatcttaatctttatgattattatgagttataagttgttttttttgtctatgttatttttttatgtatatgcatatgtataaatgtaattttacatatacacgtaactcttacgatccgagttacgatcctcttccaatcctcgagtttgacaacattgctagacgaagtgaggcttggggttctattgtgggtaaatgtgagaaaaaactagcactatggaagtgtaaatatctttctttcgggggcaggttgactcttactaagtcctgaatttgatccctatttttcttttttcttttttagggtacctaagaaggtggtggacagattggtgacattacaaaggagatttctttggggtcgcaatgctaaccagcagaagattgcatgggttagctgggatgacgtgtgcaaaccaaaagcgaaagatggtttgggtgtaagggatctctcgtctttcaactatgccttgctcgagaaatggaggtggaacttgttccattgccaggaggaattgtgagctcaagtcttggaatctaagtatggagggtgcaggtatctagatgccacgacaacatctgaccatgattctatttggtggagggacctatgcaagatttgtcagtccaatgatgtagaggggtggttcaataagggtgtaatctggagtgttggctgcggatctagggtgttgttctgggaagatgggtggatggaaaatggtgtgcctttgaggaggaaatttcctagactttatcatatatcccaacaacaacaacattacgtacagcaaatgggatcacaatcactagcagtttgggagtggaggtttgtatggacaaagagctttatggagggagaagtggaagcagcaatcaacttcatagatgcaatccagggtttgtcaatacgtgcccaacaaaaggacctgtggaggggattcgagtggtaagtacatggtggacagtgctaacaagatgatatgtagggcgctggataccctggccaacgtggatgtgtataatgacctttggaagctaaatgtcccgattaaagtcttatgttttgcttggaggctttttcagatataggctgccaactaagaggaaccttattagtaggaatgtaagtatgactgatgacagctgccctttttgtagctgttctattgaagaagcctcacatgtgttttttagctgtcctaaagttatgctgctttggtggcagtcattggaatggattaaggtgcaaggggtatccttgatcaagcctattgaccatttcctccagcatacgtattgcaactttaatggtcttaggactcaaaggtggaagatttgatggctagctttgacttggaatatttggtttcaccgtaataggattgtctttcataacgacagcttcaatggcactaaactgctggaggacgcacttttcttctgctggtcttggctagttaacttggagaaaggattcaatactcctttctaccattggtctagccatattagagaaggtatttttgtatgttagggggcctagcgtttgtattttgacttggatgtgagcatgtcctttgtctgatctttggcaattttttcagccatgaacagctatggttttcagggagggtttcaaatgttctatctcctttttgtcctagctcttagttagaactcagttggcttttttcttctgtgacctaagccacctaggttttgcttttgttcatgctaggttgtataccttgcagtattacttgtactgtgtctttatttctaatatatatattagctttgctgatcaaaaaaaaaaaaaaaggaagtattatggctccataggattatacatagtagggtaacaatgtacatagaaaagtaccacttgcactcatctttatcaatataatacattattttgctgataaaaaaaaaatgagtcactttgaaattatgaaaaaaggtgattgagcttagattaagaaaatagacaaggattgcaaagaatcaacttagattacttgaaatgtttgagtgcgaaaatatgcacacaaaaaggatcctcaaccttagtttgctgagagatgaatatatatatatatatatatatatatatatgagaattgacagatagtacaaaaaatagttcatgatgtaaggctatagcctagcctatggtgacagattataggacaacttctaagaacttcaacaaccagctagaaatataaaacattatcaaacaacaactttaacactctccctcaagctggagcatataaattgtgtgcttcatgcttggaacatataaagtggatccgaggacctctcaaggacttggtaaggacgtctacaagttggttgttggagttaataaattcagtactgatttctttggactgcagcttttcccaaacaaaatgacaatcaatctctatatgtttagttctctcacgaaatacaggattagaagaaatgtgaagagctaatgatgaactagaacattggtattaagcatcaaggagcatgcagtcttaactaaatgttgattctttctttctgctattccattttgttgtggtgtgtgtggacatgtggattgattcagaatatcctgtgaggatacaaacgaagaaagttcagcagaaaagtattctttggaattgtcacttctaaaaattttaattgttttaccaaatcggttcttttttttttctatcaacaaataatatgtattataataatttagggagagtacaagtggtacttttctatttacattgttaccgtactatgtataatcctatgcagccataatactccctaatactgcagtattgcaagaattaggaatccataagactataaacatcttagttcacctccacaaaaaacttatatagccagcccccccaattacaaaatccgatccttatattactggcccaataatggaaagggatatcaaatccttttttccagatttgagtcataaccaacagagaaagacaacatcatgcaacaccttttgactgttgaagctttcatttgacaagaccaccctattcctgtgattccatatacaccacgtcaatgacatccaccatgtttgccagcgctgagttcttatgcccttgagatatccatgagtgtgctgaagaaagtgagcataaggtgtttccgggtaaacaccgacgatgcttagccacgacacgacaatcctttccaccaaagaggccggattttgtaacaaaagaaaagctgtgacgcatcctcttcactggttctacaaaaagggcagattacgtcattcagagtcacattcctcctacttagattcatcttcgtcggtaatctatcccgaatcaacctccaagcaaagcatgacactttacttggaactttgactttccatagctccttgaacacaccatcattattctcaactgatataaagctactaaacaatttgtacgcattggccactatgtatcttcccccaacaccaactatcttgctgatcaggttgcacaaccaccactctgatgtcctccatgaattttgcaaccataacaatctttgattccctaaataatcttctccattgtagttgccaatcccaaaccccctcgaatgcgatccttagctgttgtataaagtgatgatattgttgggatatgctgtacatacatggatacgtctccaacaatgactcccctccacccaaccaaccatcttcccataactttacctttgatccacgccctatgttccattttacactactcccctcctcagaagacttgcaaatgatacttaaatcccaccaccaaattgaatcactattattccttcttggttcatccaatgacctccaacttccatatctggattccaataccttcgcccacaattcatcttaatgctgaaaaagatttcatctccattttccaagtaaagcattgttgaaacttactagatccttcactcccaaactgccattctccttggaaagacagatggttccccaattcacccatgctatcttctgctgatctggatttacccccccccccccccaacaagaactgtcgttgtagcctcactaacctcccaaccaccttcagagccctgaaaaaagaaaaaaagaaaatagggattgaatttaggatagactttaacaaggatactctttcgccaaaagataggaatctttgattccatttggacaattttctctcacatttctggactataggctcccaagtctcactgcaccttgggttttccccaatgggaatacccagatacgaaaatggtacggacaacaatctacagctcaaataagtggcagcattttgacccaactatgaggcataccaattgcctcgaaattacttttcagaaagttgatcttcaaaccagacactaattcaaagctcctcagcactatgttatcaatagcggtcggagcaactgcgatagtggcggagcagccatgcactgctacgaagggtagtgtagcgatgcggttcaaggtagcggacgttgcgcccgcgacaggtggtttacggatcacccgcgatcgcggaagacacggccgcgatttggttacattcttgtgcaaggctgcgaccttcgttcactctgacggttctacctacgaggctgcaaccttcgtctacgattctctgtgaggggcgttcgggtcgggtcagggagacgaggggcaatcgggtcgcgcgaagggccctactgcagaggaggacgaatcgcgttcaggggaggctcgatgcacaaacaacgcttcggtcgccgccgctcagccgcggcttcttcggcaaaggataaggcagtgagttgaagagagttgaatatacgcagagagttgaagagaagctttgaagaagaagagtacccaatacatttaagctatattctagtgctctgagcctctgagttagtccagctgtaatattatataatattatatgatatgtgttgtgagttgtcattgtgtgatgtattggctttatgagctggagagtacgttccagtgttccactatatgaaaagccttttaaaatttttaaagtttaagctatattcactattcagtatattatattgtattttaaaatggacttaaggctgaggtgtagataagagacaacttttgctttccaacagggattgattcaagtccattttatttacctttgataggattttaacattagtagtaataattaaaaaatatattttaataactattactaatttttattatgtattttaataactattactgttttaataattattattttttgtcaaattctgttttttttttaaaccaggtttgatattctctgtttccttcttagtttttaatttctgtttttttcctttcttaataccaggttattcattttctttgttttttcttgacttttttttgtctttatattcttaagagtttttattgttaatgataattagtgcatgattttttagttatattttctttttcagcttatatatttatattttaaattttttaatacatatattaaaacattagaatagcggtcatcccgctatccactatctcgctatcccagttttgagggcagccgctccgctccgctatccgggattgataactatgcctcaacattaccttaatggcttttacattggccatcgacgctttcccaaaaaaaattgtctcatcaacataccatagaagactgacttccaccctgtttcattcctaccttaaaaccttcgaatacattcttcgctagagattctctcatcaaaccagttaatccctcagctataatattaaacaagaatggggctagtgggtccccttgtctgaggcctttctgaggggaaaactcatttgtggaactctcatttaccaatacagatacagaggctgacttcagacacccttcaaaccacttaatccatttgaaacagaaacccatccgattcatcatataaaaaaagaaatcacagtacacggagtcatacgccttttcgaagtccactttgaacactagatagctcttatgacatctctttgcctcttcaacaatttcattggctataaccacattgtgcaccaaatacctaccctccatgaaagcagattagcattcatcaattatacaaggcagcaccttcttaattcttcttgcaagcacttttgccacaatcttgtacatacagccaattaaagagataggtctgtaatcattgaggattgtggaccttaggtagtaaagccaagaaggatgcattgctacctttgtggaacacaccattagcatgaaattcgaatacaaattggagcagatctgacttcatgatatctcagtactctttgataattctaaaatttaatttgtccggtccgaggcttttcgcgtttccacactcccagacaactgcgctcacctcctcctcatcaaaaggagccaccagcaaaccattgtgttgtaagttaatagacttaaatctgaccctgtccaggctaggcctctccctgccaattacatcaaatctcctcttgaaaaaaagtttgatttcctctttaactctgttcggctcatctacccaacacccaccaacaaacactcctctaagcatgttgtgctgccgcttccaatttaaagctaaatgaaaatatttagagttgcagtccccttccttaatccattaagatattgccttctgtctagccatagattcaactaaattcgctgccctctaaagatcctcctgcaattgcttcctcaaaagttcctccacctcatccagctgcctagtatctcattctttttccaatttgttaagttcacctttcactctcttgaatttctgctcagcatttccagccaacattcctttaccacttttttaaatgacttatcctctcaagccaacaatcaaagacccgaaatggcttcaacccccaatcaacactagtagaccgcagcaagattggatagtggtctgaaaaattacgatccaagataatctgggcactgtcttgccaattagaaaaccactcctgtaatacaaggattctatcaattttgcttttggctgtcccatttggtctataccaagtaaattttcgccccacgcatggtacatcctccacctccatatcagcaatccagtcattaaattcttttatgttgctcctgccatgtaccctatgacacacacactctttcagaagaccttctgatactgttaaaatcgccagaaatgcaccaaagacccccactgtttgttgttcttagctgactcacttgattccatagtatttttttcgaaactggatcacatggtgaatatatgtttacaatatttacttttcccctatcacctgcccatgctccttctaaatatataaattcatttcccttcacacttttctccattttaaaattttatcacaccaaatacacaccaatccaccagcactattaattgctggctgcacttcccatctaagcttagtatctccccacaaagcgtgacatataaccttgtcgatcacttctttcttttcttagtctcttgtatacacagcatgtccacctgttccttcctcaccaaatttctgattgatgcccattttacccccatccccaaaccccttatattgtatgtaactatcttcatcaaacaccatcaccaaatccagtcattagcaaattggttcttaggacttgaagatggacaaaagttcagatctctcattcatcaggtaaacccaagttcataggaatacaaacactcatggttaactgttaactaactaaacagtagtagtgacagctgtacaagtcacaatacaaagaaaagaactcttgtgtaggagtaagatactctaatatcgcacataagatacaagctaattggtcaaaatggagaaagatgccatgggttatttgtgactttaaagtacctacaaactcaaagggaagtgttttcatactcttacatgaccaaatatgctctatgatagtaaatgttgaactataaatagagtaagagaccaacataaatggatggatagtggtcacacgaaaaggaacaagatacagaaaaaatattatatacaaagatattttgctgaagaacttattgagaaaaaaatattagaaaatcgactaaggtggttttgacatttgcaaagaaagcgactataggccttagaaagaaaggaagattgcacagtttttaagcaagtgaaaaaagataaaagacgaccaataaggacactagaggaaattattaaataggatctctcatgttgaataacatccctgagaattttgtttttaaccaaacccaatgacagtgtgatccaaacaataaacctcacctagaagaacaaatttacaaatttctacttacattctatagtactgcagataatttacaaacaatggcataaccttcccatggaacaaaaccataattctcatcattaaataacacagacagcaaaattaatcatcaattatcatactgagaataaacaagaaattattaacaaaattcagaggtatgagataataaaaagtcaaaccttgagagccaggttaccacgctccaacttttgatcccgaatttgacgcttatcaccagtcagattatgcccaccttgaccagtgtacacaacatcctcagcattatccagatcatcctcatacatgcccgaaataacaatggcaacagcaactggaagttcatagctgtactgtgacaacaaaagaaaaaaaaaaagggaacaaggagcataggtttatatggatgataagaaattcctatcaaattctgaatatgtattcaatttagtgaaagaaaaggcatacaagaaaggtctattttttcaaaaaccaattacaattaaaaaaaccatgatacctcccaatattcctttattcccttaaataacagactaatatttttccatcttatgactaacttttcactcacatctttaagggtgcatttgttttgctaaatatttatccagtgtttgttttagataatagttaaaggacagcacaaataagaacagtactggacaaaagtctaaaattttgtaattaactaatccaggggacaacttttgtcccctgcacaaaatgctcaaaagacaaagaaagtccacttttccctcccccactctctcatgcccccacgtctctttccccactctctttcctctttctcttacctctcccttctccctcttccattttctcaattaaaatcagagtggtatttagatgttttgatgtcaataagagagatgtctagagagagagagcattagatagaaacaatgagtgggtgagagcaaaacaaagagtgggtaaagtgagagatcttgtctcaattaagccgagaaggggtacgatcaacacattgcgacgacagtggcggcacaacaaggggaggggaggaggaaaaactggaggcacgcatcagatgtgtcttctttctacttcatgcgcttcccagaagatatgggggaaaaggacttgtggtttgagttcaagaaatggggcgacatcagggagatattcatcgcaaagaacaaaaacaagagcaaaaggagatatagttttgtgcaattcaaaagggtttgatgacgtcaggaaactcgagagacagttggataatttgattatcagtggacttaaactgcacacaaatctcccgaaacatggaagggagtggaagttgatagagaaaaccaacaagatcgatcagtacaagaaggggccgatcagggataagctagtagagagagacgaggaaaaaggcacggagataaaagcacaaataacactgaatgaaggagcccaaaagcattatcctcaacgacaggcattaccggttttgtacgcaaaagtggtttcgacaggcagataaacgacgacaaagagatggttcccaacatatgcattggagacgataaagccatcccactcgtcaattcggttaactatacccatggaaaaaaggaaatgattcagcggcgcctaggtaggcaaattaaggaatctggcagtgttcgatagactagaagaagaactcttgtaggatagaggtgaagacattaagccaaagtaccttggtgatgacatggtgctattcattggccttagtgataccaaagcaaaggaattgtgtagggaagaagacaaaagtggattgtccatgttccatacattggagacattaagccaaagtaccttggttaggacagacaactgaatgatatcaacatcaacagcacctttaacccaagttaattaagatcgatggtagatgaacctaatgataaatcggaaataagacaaaacgagaaagagaaaatggaagaaaaagtggaaaaaagacaagagaggaaaaataaactgaaataaaagacgggtgaaaagaggagaaaagaagagaaaaaaactaaaaaagggaatgactggaacatggaactactaatgtgttcaatcctccaccaagcttatagattatctccattccatcctaagacatactatccaccaatctatatctcactccattagatctagtttagctacctttccccaagtaagtttcgatcaacctctacctctttttgtcgagctcttggtaacaaactcttgttcttatgggagcattcagtggtcgtctcatgacgtgtctaaaccacctcaatttatgctctctcatcttttcacatatcagtatcactgatacctttctccgaacatcctcatttcttatcttatccatcttcgtataaccacacatccacctttacatcctcatttctgctacccctattttatgtttatgttacctatgtgctgaccaacattctactccatataacattgtcagtcttacaattgttctatagaattttccttttaacttaaagggaattttgcgatcacacaaaaaccctgatgcactccgccatttcatctaccctgccctgattctatgatttacattcttatcaatctcaccatctttttgcaaaattgatcccaagtatctaaaaacatctttcttgggtacctcttgatcaaatagatgcactgtgtcttaatcatcatctcttacccacaaaaactcacttcatatactctgtcttgcttttgcttgacaatggaataaaattgcaaaagcaactgcaggaggaattgtgggcaacagcacattcaaatgcatcaattttgaagcaaaaggcaaggactagatggatcaaggaaggggattgcaattctcagttcttacacttgactgtaaattggaaacatagatacaatatggtcagaggagtgtttgttgatgagtgctagttagaggagccaggcaagatcaaagaggaaattagacactttttcaaggggagatttgaggaacctgagttggagaggcctaagttagagagggtcagatttaagtccattggacagtaacataacaatcacctagtggcgcgctatgatgtgaatgaagtgagggatgcagtgtgggattgtggcagtgagaagatccctgaaccgaatggattcaatttcaattttatcaaggaattctgggatgttatcaaatcagatttgcttcgctttctggatgaattctatgtcaacagagtttttccaaagggaagtaatgcatcattcgtagcgttgatccctaaggtccatcatccctagagattaaatgaatacagacctatttcattaatagaatgcgtgtacaaaactttggccaaagtgttatcaagaagattgaagaaagtgctgccaaccatcatagatgaatgtgagactgctttcatagaaggtagacatatgatgcacagcgtggttatagccaatgaagtggttgacaaagcaaaacggtgtaataaaagttgccttgtgttcaaaattgattatgaaaagacgtatgacacagtatgctaggattttcttttgtatatgatgaggcgcagatgggtttctgtgccaaatggattagaaggatcgaaggatgcttgaaatcaacttctatttctatattggtcaattggaacccaacaaccgagttcactcctcaaagaggactcaatcaaggggacccacttgccccattcctgttcaatatcgtagttgggggcttaaccaatctgatgagcgaagcacatgagaagaacttgtttgagggctttaaggtcgggaaaaataacgtggacatcagcatattacagtatacagacgacacaattttctttgggacagaaacgatggaaaatgttagagcaataaaggtgatgttgaggagctttgagttggtgtcaggattcaagataagctttgccaaaagaagatttcgggcgattgggacgactgaacaatggataaacaatgctgccagctacttaaattgcagaatgttgtcaatacccttttcttagtagttgagaaatcaaaattattcaacccaaatcgtaacagattacaaaacaatttatatagttgagataacagtcaactatactaactgtcaactaaccttatttagttgatacagctgttactaatttgtcatagactaacagacttaactactaactaataacaaacttagttagactaacagcttattactagaaagtaaaaaaacacacttgagtaatgtatactccttatacacttataagtacaaataaataaaaatgcaacatagcaagaaattccattaccgctttggcatagttctggcccatataatcaatgccatttaaccagtggctatgaaagccaactgcaaccatttcagcacgagaatagaactgatatccaacctcaatacctaccgttgcaagaaaaattaagacaactgaataaggaattatcagcacaagagttgatcaagcaaataacgatattatttaagagaaacatctatcagtgttaggagacagcaaatagattatatccattcagttatataagccaagagtaatagcaatgtaactaccaacctggaatgttgccaattcttttctcaggatacaatatctcattattttccatcatctgccaaaaatccccaaatcgaagatagtgttaaaagaaaacaagtacatcttagaaagtataattaaattgatttcagttaatgcaattaatcaaatcaaaacaaataatagtataaattacattaataaattaatacatttatacacattttttaaaaagagttactttttttcagacttttaaaacagtcctttgaattgtttcaaagatacggctcacaattaacttaataacaaaatacattgataagatattgagcatccatcactacaaagaaaaaagaaaataaatggtaacataaattggataatgtaacttaatggcaatgctatgacacgtaccagaagagcaaaatcctatctagatcatcacagaaaaaaaatcccaagacaatcaatattctatggaaaaaataaagccattgaattttcacttgccttgcttatggcctttagatctggtcgtttagcagtggtctttgattcttcagttggagcacctttctacaagattaattgatgaagctttgtagttaggttatagtaaaacaattaacgaagaaaaaataatcagtaaagctttcagtttaaatttcagtatacaattagtaagatgtaaagctccccaaggacatttaaacacgttgctaataaaagcaagagcttccagctttaccgtttgactccaattgccaggcgctttaccatttgactgagaaagggaaaaataacttctagctttgaagtattaactaataactctgaaataaaaaatcagcctggccacatttaactacaaaactattcaggcaatactagattttcaaagacaaaacatgcatgatgaaaaaaaattcatcttaaatttggaagaaaaaagaggcaaaatagagagcagagcaataactaaacactggacagacccataagctacgctatactattttagttcaataataaaataaagaaacattataaacgtccagctaaaaatgaaaacccagcatccacccagcccaattaaccacttttaagacacatgtaaacattgttagacatttcaatagcctcaagacactactaaccacttatgaagtatatttaaccattagtgttgtaagtacaaatcaattattttatacaacattcatttacttatgaggcaaaattaattgctattgaacatttcaataaccctataacactattaaccacttgtaagacatttaatcattaaagccacaagtacaaattgataattgtatacatacatttatctacacttaatctcttatgaagcaagttaattgccattagacatttcaataacctcatgacactattaatacactcgtaagatatatttaagcattagtgtgtgtttggataggcgttgacaaaattgattttgtaaaattgattttggttaaaattgattttgaagtgatgtgatttatgtttggatgttttgttataaaatcaagttagaattaaaattcagtacaaaattttgaatccaatgcagaagctactcaaaattgcttcaatctaaaatcaattcaaaaacccataatcaattttaaattcttccctaacgtgaaaccaaaaaagtgaaaatgtatccaaaattaattctggactcagaatcaattctccaacaccaaaccaaatatgcatttagtgcaacaaggacatatcaataatcaatcatagtatacaatgacactcatttactcttacccacatgtgaggcaaagttagccatatttacacatgtgattaatcatgtgttacatttgaacgctgggtggagaattctcaacagtacattaatcagtactctgaaataaaatgcagctttaaacttgcaagaaaattctgctaacccgcaatcaaaagtccagtcataccaagcaaaaagtctgttattactggaaaacctagcaagctaaaatgacagttaagctgagaccagatcaaggcaaccatcaaatccaaaacaaaggaaaagcaatacaatgcagaacatcaataattattattcttaatttcacccgtaaaattaagatcattaagaacaaccttcttttttttataaaagagagacttcacacagggggtttatcattgtaagatctatttccaaaacagagtagggagacataatcacattaacattataatccacaacaagaacaactaatggttaattagacacaaaccttcgattttgaagcctttttagcaactttccgctcagcctctgccttcccacacctcttttcttcttcctacacatagaatcataacttcaaccaaaggatacaacactgaacaacaataaatgaatacagtagaaacaccatatcaatagtacaatatcttatgctgcacacaaaacatactcacctgaactaattgaaggtaatgcttagtaaacagtcttatcgtctctttgaccttaagcaagtcgctcttctcccctaaaccccctcccgcattttccaatttctccttcgcattcacttctctcaccttaccatttccactcacttcttcacctttaccatttcctttcatttctcccatcaccttacatttgccgtaggccacccgctttttctttgccggcgaaacaaactctacttccactactacactctcctcacttccactactttttctattcatcttcttcactttctccggtgtcaacttgtcacaattatctttctcctcaactccctctactcttttacgtgcaaaaagctcctcctccgccttctgcaacgcttgaatcctcgcactcgacctccgcgggagcggcattgtggaaccctccgattctctcggcttcttctcggccttagctctgttcccgccattcgccatgacgattttggataccggactcttatccgccctggtggaaaccatcaagtgctggtgaacaacgtcgtccaaagactgcacaaccatctaaatctgcgagccaaaaaaaaaaacgataacgtgagaagggaaaaaaaatcggtaacagaatgtcacgaagaaatggaaaacaacagtcaatcgaacatgaaaattttccgagaaaacgaacgtcggaaggagctgctgttgttgatgttcttcgatcggattcgaagtttctagggtttggagatggtaaagatgacgaggagagagactgcggggaagaagagggagtttttgttttggagttgggtgatggaaatgggtaataatagctacactctcggggagtgaactgaagaggcgccattgccgaataagtgggaataatattattataatatatgtcatttcatttcgtacaaacaaaattgatttattattttttcttcagttttttatttttgttttctttattcagttcccgccttgcattttgatctccctcgcattcacaaggaaaatgcataacccgattgcatattgttttttgtcaaagttaaaaggttatttatatgtaccttttatatatttgagattaattgttatgtaatatctggttctcaattctcatttcatatgttttacaaaatttaattaattggatgataaacttttatattttatatgtataaaaatatcaccattataaatataattaaataagatatatcgagtgacattctcattctctcaaactataataacaaagtgagaaaaaaaaacattaagcaaaaacattgagcaaataaaagacaaaggataaaaaagaactgatcctaaaataaatcgttaatcaattaaagctttcaatgcacgaaagaagtatgcaaaaaaaggtatattttttatcaaatagaacaagtcaataacaaaacaaaataagttttgtatgaaaaacaatagggacaattaaccaaaaaaactaaaataatattaagataacttagcataagttttgatttcttaaattaaaatcttcatttagtaacataatatttactattagtctattactacttaaaatcaaaatcatctaaattaatgtttgagatttgttttaaaattatttattaataaggattataatttcagtttgactaaattatacattaagcatattgattatcaattttttcatgagattatcattataaaatataatatatcaaatattatagtttattaaagtaatttattagatatttacttataaactatatatttcatatttattgatgtttaaataagaaaaagagaaaaaaatataaaataattaacttatctctaaaaattttaaagatatgaatttagttttataacacataatcataataataatgattctgaaatgagtaaatttcatattaatataatttctcactcacataattaatatgacttaagtggggaaaatattttattattatttttatttaattatcttgatgtctaattgtttgcataattgattaggaaaatgaataaaaaagaagaagctatcaaaagtgaatagttaaagtttcatactttgaaatagtgacataaaaaaattgcatttgagtcaagttttgcatgttgcatatctcttgcaattgtttgatgcgtatatttctaaaaaaaaattcttaatatgactatccttcatttcttatctatacaaaattaaaaaagataaagaatgaagaaatacatctctttaattgacccctaaaacttcatggaagaatatatatatatatatatatatatatatataaagagaataataattctaattgtgatattagtgaggtcaattcatgttttcaataaaatttaaaatattttataagaagttacaaaatttagatcaattttatatgttattgattaatttaaaaattgaatgaatttttatttgccttcaaaaccaactgaccaaattagttgatgagatcaattgataatatttctagcatttaatccaactctaatcacgaatgaatatgtaatgctacttattcattggaaagaaaaaagaaataaaaaggctttaaaagtatataccttttacattttaggaataaaaaatacaactttttattttgaagttgaaaaatatatcataattcctagctttatatagattatgccatttgaaagtaactaaattaaatatatattaatccaatttattcaaaatttaaacatatgtttacaattttttttagtagatcacatgtctacaattattccagtcaaatcattgtctcgcatactttatttttatgatatcgtaagtataagtttatttgtaatacaaaataaaattaatgttttttttaaaaaatatattattgtaatttacatagatatataaatataaattattttaaatatgtgcataaattatgaatatacatataaattaaatatattagataattattatttaaaagtaaatattctaaaattaaataattatttaaaaaacaatttttaaatcaagactacattatctcttatttatttgggtttttctatttctatttaataaatatataaaatataataataataagagtaagaattagaaataatgaacaattttttaaaattcataatttttcaaaatgtttcaatactacattatctcttatttatttggttttttatatttctatttaataaatatataaaagataataataataatgatagtaagaattagaaatgataaataattgttttaaaaattcataatttttcaaaatgtttcaatctaattggctacaataaagttaaagtttcgatttaatggtgctaaaatgtccaagtaaagattacataattgaatcaaatcaactcttgttacaaaattaaaattttgatctatatgtaaaaacttcaagtgaaattatatatatatatatatagattgagattgtagttatatacttcctttgttctgaaactaaggctaatgtacacttgttaagaaattatcaattggtatatttctaaactaaaatacccatatattaatcacgttgttggaagttggacatccatttttggatagcggatagttaagagactatgttagtagactttcttttcttaaaaaatgttactaagattgagacaaaaactaaagtagtagacattctcattggtgggtggcggaaaattggcttcggtattcgtgccttaacaataaaaatttaattcattaataattgtaaataagggtataattgaaaaaaatattatgaatttaatcttggaattctaaaacagcaatagttttaaaaaaactaaaatgttaaagatatataatttaggaatggaaggagtcatttttaattccaaaatttaactatatatgttaagatatatatgatgtctataaattagtttgacttagtcttatctcatgttatcgaattttaattgaattgtgggtttacaaaattgaccctattaaaatttcaggtaaaaacataagtaaactcatcccacaaacactcctactggcgatggagaaatttgtcgggtaaaaaaaatgaaatcatttggtgtgtcacttgagaaatgtcaagcttagctaacatgttattattgggttatgtttgaaatttcatataccacatcatatactctctttttctcaatatttttgaatttttttagtatctaacatgtattttataacatttaaaattaaatatcaaatatatgtagcaacagtttaacaattttgcaattaaatttttggaattgttcagattttattacattttggaataaaggatgtgaaatgttacaagattttaacatttttgaaaactaaaattccataagataacgaacaaccgagaaaaacatcaatttgtaacgtggtttggaaatcacttctcgaaattacaaaatataattttagactattatttatgaatgttgttaacttatgcaacatttttatcaacatcatatatgccatgcttttatattatgatgagcaccttatttaactattgataataacaataataaaatgttaatacattggtaaaaaaatattaaatgcaattaatttatgataatgaaactgctaatcgtacatattatgggacatttggttgggaagaagttttttcatgtttggaaatcatgattcctgcaaactatgaatcttgataatcatatttcattgtaattaataaaatttgtttggttggccattggaatcttaagataaattttcttgaaatcaaagagttacccaatattttaagtgatttctacgaaaccttcccattttaaagggttttggaaccttggtctgtatggaccaatagattacaatcgcctaaaaaattgattccacatcatgataagttaataaatttgaagcttttgcaatttggtccctcttgtaatttatttatttttaaattaatttttaaaaattaaagcttaatgatattcctagtgaagtaaacgaataaagatgcaaaacacttgcagatcctttgtatttcctaggattttggataccatgtaggtgcactaaaatcttcttttttttttttttatttaggatgttggttggtggtttgtgatgatcaatatttgcataatcacgatccattgttagctagggtctttcgattctacgcaccagggaaccctctccgtgttgaatcggggttgtgacggctggttagtgtaattggaggatcgttcgattctatgccataaaatgcttgtgcgtcggatctgcgatcctattggaggtccatgggccagaaaaatctgggtcggatcccacattcacccttctcttctctttctctttggataccattaccaaaagccacaacacttaaagcaacaacacctttggatcctattgctaacctgctttttgtgtatttataaactaccatttttttgtaaattttttaggaaaggtactagatagaaaactagtggcaataaaattttcaatttatatatggctaagtggctataataatagtgagacatgcacattatgttgtttcagattgagaataagtatggagcacatagtaaattacttagagtcagggtccaggcttatattttgatattggaaagaacactagaggttttacaatgccaattatttgcctctttcattttcattttaatctttcattagcatcaattttgaactaatgatggtccatataaattctttatttacctcttttgtttatgttagatgttcttcacaaggactatgttaaacaaccaccaatccactataactacatattcttgaattggaatttaaatctctcctgtcaaggtaatatataccagcttttcaaccctcttgctattctttttgcttttctttaaaacgtgttattcttaatatagttgtaattatagtctactgaatggtccattagatattctaaacttagttatttattttgccattaggtgggtgggattaggaaactatggacatttgtcataaagagatttttgtatccaactagtgtacaaaaagttgcatattacaagacaactacacacatggtaacttaaatataataaaattgtaaagagggaaattttatctatatgttaattgatttagtgtacaaaagtcatgagacctagtttggtatggtatttgagcatataaataaagggaatcagttagtcctcaaagatgtacattacatcataagaaaaatatgaatatgtttgaaccctaaaatagccctagaatttcatatttaataattaagtcttcattttcattgtatctaactaatttttgggatcaaaatgatttcaattatagttggaaattcaacacttaagtaaattcagtgggtttagtgcaagcattggattatcgggagaagcaaaaataggatataaccttgttgcaaacatctatggtcatataggaactagaattctcaccctgggagataatattgcctatgacttatcaacaagctcatcaacaaggataactaacaatctgaatgttgggtttagcctgaacagtccctaccttgttgttatcgcaaccttgtgagctatcctacaatatagactaattttataaaaaaatgtagactagcatcagatttgtgatatgttaaaaagcttaagaatatatttataaatataaaagaacacaagctgtggtattaacaccttaaatgtcctacaacttaaggtttaatattccatgttgccaactcaacttttttggcatgtagttcaatctcaatttctatccattttaatctctttagtcttcagttcatgcttttagtaacttacatcaataaagaacaactcgtacctcctttactttagaagtatatacgaacctttactttttgcactttgtattccttcatcaaacctattccaaaacaataataatgaaattttttcaacttatgcaataataggaaatgttaagtatggttgtgtccaagtcatattggatataccaaacaattaaatccataaggttttgatgttaacaaaatataaattttatgtgataacctttcatgcttaagctacaagtttatctctctctatgagatacaagcagaaggtatgaacaaaaaggctttggactatagctaaagtaacagtcattggataatattgcctcaacgtccaatcctaagaagacaaatgctttagcacttggctcatagtacaaaggcaatggaatatttactcgatcctcaagtactgaaagtaatcatcaaaaagtaacgtccataggttcagtaagtaattcatgccatagcacacaaaagagaagattttaattatattgttttgacattcttaatttcgtatatcttatgttgttaatattatatttgatttgtacgctgaatgtaacaccctcatatttccctgtatctgtgtattttcttagaaacacgcattcttagataaatgacataaatgcccttggatatttttgaaaatgaccaaaatgtccctgaacaatttcataaatgacaaataggtccctaggataaatgactaaaatgccccgaacatttgcccaaatgaccaacatatccttatagctttgataaggtcatataagctctagtaaggtcctggaaacctgataaaatatagagtaatcctagataagcaattatcgacattatttgcgaagaaaaaccctaagatagaattattagaaattttgaaagatagttcaaggaaaaattgaatttaaaataatctaggttcggttaaagcacagaagaaagacagatacaatttaggaaaatttctcttcattatagtaggatgagattggttaataagtagtctaaaaatcttttactaattaaaaaccaaacgaactaatagaaaattagataaactattagagaaaaaatgaagtaaccacataatgaaatattactacaacctaccttaagttctaatttaatttggaactttaatctcaagaaaacaagttgaaataaggattataaattatgaaaataaatttaccataattttacttaattacaagatataaaatgataaatttaagtattaaattctttcaacaataattaaactatctaagcaaagctttagaccccttaaacaattttaattgaaatccatttagcataaacaccaaaacagccgtgcacctccaggaatgatgcagaaaattgtagaaacttggagaacaaaggccacttggatagcttataggctaagacaaatcttattggaccaaatggaagaaaagctttaataagtatctcctaaaatctaagccacttcacgtatgattaaaatcaagtggcaaaaagttaaagcttttaaaaaaaaagagaaaaaactgcacggaccaagctagggagctaaggaagaatatagaaagctcttgaatcaagcaaggaccaatgaaaattgaacaaacaaaaagctaggatgagatattttttcaagacaaagaaagttagcaatataaaagcaagtggggaccaaagtggggctggagaaattctgcacagactccacccacttcagccttccttttcacttctcctcacataaaatcaaaaagaaaacagcagcccacaactagagaggaacacgtgaagggttagaattttggacagcttgaaattcaacaaatactaaggtatgggaagctatttaataagcaatgattaagatagttgatagattaatttagcacctacttattgagagttaagcaatttagtctaccaaatgcttaattaaaattcttaataaagaacaacacaaagaattaattggaaagctgtctcaaataattaaatttatttagtggctgtatttgatttgttgtgttgttcttagcttgagggtgtagtaattaatattgttggtggtcatgttaaaactaataaggctgtataggaactgaaattttaaacaaataatgctttgaagttgtttagttatttgctgtaaataattagagtgctgtatttaaagttaacatatggctgttgctggatttgttagctgtatgttattatttaatttgtttagggtgctgaaaattttatttggtggctggaattagtagtggattgttgtatttaaattgaattaataggtcactgtctgtacaaaattatttgctgtctgtttttatgtttctgttttgaatattaactgctgtctgttttgaaatttatttgttgtctgtttgaatattatctgttgtttgtacgaaattatttgttgtctgttccgttttaatattgctataatctgtatgttatttaattgctgtatgttattctattaggtggttgcaaaattaattttgtaattgattatgctgtttagtattttaattcggttcatgttgagctataataaatctctaaggttcatcctattaattaggtcatgaacatatgattaaagattcgtactatatattgttaaagttgattccttaaaattatgggcacttacctttgatactgatggaagattaatttttagtgccaaaatatgaggcttgagaaataaaagggagaagagaaactgaaagaaaaatcaaatcatgcatcattttcatttgaccctcagagtggagggaagtttcactagagtgggtgaaactactgtggtaccctttttaccctcagagtggagggaagtttcactagagtgggtgaaactctttaattttaaccctcagagtggagggaggtttcactagagtgggtggaactattttgcttctggtaccctgtgaaaattatctaagatctcagtcatgcatcatttaataaagagagcatgcatcactcatcatgtatctgtctataaatattattttgtgttcctgtatatatttgttgtttattttaaagtttgttatgtatttattttattttctgtcaattatctgatcatgtttattaaatacttacccgagtgtgtctgtggttgacacctgtgatgaccccaatttatttgggcgagcagaggatcagtgagatgcttagatatggaggagcttgatgaattatgtgctgtgttttgacttgatgtatggatggtatcacctgctgttgctgcttttgggaagttctatactattttggtgatctgcattatattttgatagcctgtattctattatggatgactgtatcacggactattatatttacttatgcttaaataactctgactgtgaattatgttaaaattatttaaacgtagtaattcgactagaatagtattttatgtcactaaatttcatagaaaaaaaaaatttcgtaacgtaatagcgtagacaattcaatacgaaacaacgtaaatctaaaataataaaataaaaacgaagtcgttatactgaaagtcagctctgagcacaaggcaacactggcaagttgcacttctctaaagacatgctacaaaaagtgtttgtggtctcgacactctctctgcacagtaacgacctcatgtaaagtgctcaagctattagacaatggcaagctagcatctctcaatggatcgaaactttaaagtctatataaagcttgaagatgttcatgataaggttgttgaatcataagagaataatctaagtcaaaatgaacaaaatgttgtaatgttgtcagtttagttggacgaaggaaaattgagcaaattaagtgaatcttagctctgctaagttgacaagtttcattgtattcgagcttattatgtaaacactctttggatgattagaatacatttttcatcaaacatctcttgtttgtgaaagccaggagtgacttagtgacaaagaatactttagtgacaaacatctattgattacagtttgtacccacagaagatcaacttgcttatttatttagaaaactccttgccaaggataggttaatctctttaagagaaatccttggcatgttccctgtggaatgaagtttcaaatccatgtgtaaagccttaacacatcactaagcacctaaagaacctatcgtccaataagcttagtcagtacttgtgcactacacacatgcgtccaatatatggactgtgaccctggatgcaagtttagtgaagacacatcattttgagtgcacttgtgctaagtcacctaaagtgggtcaaattccttttgaaaaaacccattcttctcaacttccccccacgatcagtttttctctcttcaccctaaaagcttaaccgtcaccatcactcatcattacgtcttttgactatcaaaaacttctctctctcataaacctatttgaactctaacctttcttcctcccagaaacttcctgaaaccctaataatggctaagaaatagaaccaaccccaagttgtccaaaccgtacctgacttcagaaacaaccctctgatatcacgttgtcgacacgcaccaaaacaattttactaagctaattctgtagaataggattaacctaggtcgactcagagacacttatcaatatggttctagcttcaaatcactaataatagagaaggggattttatcaaacagtttgtgtgcgtaaggaaaacttgcaaaaacataaactaaaattaaagaacagtgcagaaattaacaagattcaaaagaagtaatgtaaaacagaatttaaaacatcaatccaattcacctcaccaagcaattcgaatcatcattgttctctgaaattaatcctatcatgaaagttcattcaatctcattagaagcaattcaatcgacttaacccctaaattgattgaaaccacaaccctaactgaaatatcatccaattaattatgtgattaatgttcgagattaggaaatgaattcataacctaatccattttcaatcctaaacgcattcataatcatgaaaatagaatagtaattgaagaagaagatgaacattcacatagaattcgaaatactaaaccagaactcaaattctccttgtgcttgggttggatccttgaattgattgaggatttagccttccatgatcatcatcagtgaaagccccatgaaatggttgcacgaaaatggaagaacagaaaaacaaaaatgaagaacaatgaagaacaagcaagaacagaagagagaaaatgaagaacaagagtttgattctaaaaaaactaaaggaatggaaaataaaacttgtttattgaaatgtaaagagtggtgcccaagtttcactaaagtcactaatatatgtagtgattgagttctaaaaataaaatgggccacaaacaagcccaacaatctaattatttgctatttacaaccatgaaagtcaaattcgcagcctaaaattacaagtgcagaggtgctaacttcaaagcttaaaatgaccctctaaattatagaattggcctcgggctatttctaggaaacttgtagatcttttcgttatctttctagggactcctagaacgctccattcggagatcgatagcaccctataggtcctgcacaagtcagatacatcaagtgagccaaaaatccgaaaatacgcaacaattagcaattaagcccacttacttgcctaggccaaaaactgaattagaataaaaaaataaaggtctaagagaggtcaaataagctaagaaggatagaaaaatactcaactaaaagcactctatcaccctccctctgcatcatttgaggatggttcccctgttcagattaccagacctgcacttgtgaccatccttgtttccaaagtcactatgaaggacaaggaaccatgagttcatgtcaaacacttgttcgatatcaaatcatttgaaaatgttggctagatcattaaagttcatctcaagccgtgtggcattcaccacttctttgaagaccctaaagtggtggtgcctgaacttatatgggagttacgagactactaaagtgtaaagaaacgaagatattggaggatattttgctggaaaagtgcttggcatccaagtgaagctgtttgttgagactattgctcaagccattggctatgagcgttgaggcaccaagttcatgaacaattgcagagatgaactacaaaccacattgggcactccttgtggggacctaattgggttaagaccccaaggcaggatggaacactgctgaacaaggccaaaaatcttttaatagatagtcaacaaggccatcattcaaaaacaagactaaaaggattttttgtccaatgcccacaagtttattatgtaccatcttatggagggtactccctttgactttccctagattctcttcaattgctttgtaattgaagtgatgaaggacaagagcatcagtaaggatatctaccatagtgttgtcctcactaaggtatttgaaatccatggtgtcataaggaagtttttgtatgagacaccaatagatgtacaagacaaaatctacctgaatggggtgtttctacctaaacaaaaatcattcagctaagagaacatttcaagatgagattggtagataaaagcttctttcaacaagttccctagatggatgactccatacttgctaaacttcaacagaagtttggactcaacattggatgagacaaccagttaaacacaatttgggagaaggctgctaaagaagaaagagttgacacagatgaagccattgctaaagcttagcagagaaccaagaagaggatggacgcaccttcgtccaaggttgcacctgctcaacatcatccacctcccattcttgttgctcccaacgcaacaggtgtcataagcaatgtgtccaaaaggccttcacctaagaagccaacacaagcccttcatccactgctaaaaacttaaaggcacttagtgaaactgagagtgacgatgaaaggcttcttgtctttaggaagaaaaaagttgcacccacttcagatgagacctctatgcctcaagtgaaaaaggtgaaccaatataacaggtttctcctcctcctactcatccttgtaccaacaaacgagaaaagagaggagcccattgacccaagcgtttagagggtgagcaatcctccattcctgctaatactaccaaggatactccaccaactaatattccaccggttcgacaacagacttcaactgttcaatagtttgaacgaagccttcaaagaactaagactattcattgcaggaagaagaagataattgagtccagtgctgatatagacgatgaagtgtagtatgaagcacctccatctcccatacaccttgatcgcttccaccatcaaggtccacctgtcgtagaccccaacctcacagctaaaggcatcgcaaggttgcgttttcccgtggactttctttctaagaattcttacaaaattcaaagaagaatagaagtggaattccaacctacgatagattggacgcaattcccacttgatatagaagaagaagaagaagaagtcacctactctccgtctacacacaaagtttctcaagatagatccaccaacagggatcgaagttcttcatccaccaacatggaagcgacttcaccccaatgtatccaagccttcatctatcacagctcaagacaaaatgtctataagattccttctagggcctacagagaaaaagtaagctatgataaggacatcatttgatggttttgcaagattgacacccaacagattagtccatcttctgatgatttcttgcctctttttctctgtccaaagcacatccagctgttgactcccatgtccaagtttattcccttataatatgtccatcaaactcccccttttactaaggacgatatctacaattttgggatgaatatgatgcaatatgggtttacaggtcaatagccaagctatccgatgcaccgtcgccattaagtttaggcctaatcgcatcactccaaggttgccacccttagacctcaggaagaaaaaaggcaaggttcatcctcacagtaagcccatgcctcatcaaggcccaaaggacaatattgccctgcgttcaattccttattgttggagcatgtactttataagggatactgctacgaagattgttgctttaaatccaaatgcagagtttgatcaaaatgacgttgtgctcttttattttaaagacatgtatgaaaactctcatcttgtgtccacctcagaatatgacaaggaagataactccaataagatatgtatggtgaaaatcttgcatccaaccaagttatacaacttcaacgattggcagatgtgcttcctgaggcaagaatgagataatgagttttatcaatgacttatccatgatactcctcttcgcttttggtttgtctttgacttgcacaagtactctgaagttgcaatgggaagagtcattgtcacagcttgggtaaggtttcctacacttaaagagcatccattctcttttgatcaaaacgcttgggttctaggtcaagaaatgatgactggactttagaggaaataagacaaagtaaatcgccaaatgatggaggtgcaaaaaaaggccgaagccaaacaatagaaggagaagctcaaatctgaagagctgttccacaatcttcatgcacatcttagacgtcacccgatgcttttgaaactctgctgattgaagttagttcacaacctccacctattgttgaagatgccttagtaaccgtcagcactgccaatactcctcgtgagacaactcccgtaaccacctttgttgcaattggtgtgtctgaagagagaattcaagaatcgttgcaccttcaatatgccaacttggaagaaactatggaaagaagtttccctgctaaacacatggagaccactctgctgatcaagaacaccttggaatcatcactcaaatccttcaacgactcattctattcaacatgaatatgctgcgacaacgactttcccatccattgaaccagctccgccaccaccaaccattgttgtgcaacctcatcttgaggttcctacattagaggctgcaataattgcttatcacgtacatgtgcctccgccttcgcctccaaagtcaccgtcttccatcccttaactgttgatttcaattgaagccaagcatcaatgaacaagattcaagcttcaaggagttttgagctttcaacatgaccaaaggctaaagaatcatgggaagctttaaagaactaatttgattaattgtaaaagggagttatgatctgataatccaagtgtgcatttcatgtcattcattattcattcatctaggatcattagattacatgaattgatcaaaggcagcacagaaaaggttaagaattttaggaaaaaccaagttttactgaagtaatcgattacatactaattggaatcaattattttgttcttcgtgccttagaaaaacaaatcaagaacaaggtaattgattacagatcgaattaatcgattacttaagctaaaatatgaaaaatgcatcattcgatcttaatcgattacaacatttggtaatcgattacaagcctgccttgagaaagccttacctactggagtaatcgattacatattggtttaatcgattacatagttcaaatcagaatataaggtcactctggcttaatcgattacaacaattggtaatcgattacatagtacattttagagaaacaggtcactctggcttaatcgattacgtatcggaataatcgattatttagttcatagccaaaatccagaaagcatcaggaacattttaatcgattacgtcttgaattaatcgattacaaatgataaataatcgattacaggagcgtgtttaatcgattattatcagtaaaaattctgttataaaaaggacttctcagactgaagttcacagctttcacaattattgagttttatgaatcctaaggcattcacacatgttctgagctttcattagtgaatttttctctgttctaaacacattaacttcaccaaattcatatgggttgttgaatcaagaaagtgaagtctcatcattcattcaaggcataaggaaatgtttgaatatgtttgtgtgatcagtcaatcaacctgagtttcattcactttgcgtacattcttggattatcaggtgacatctttccttgtcctttgttggtgtaaactgttctttgaattctttcaagtttttgtttattgtaaaatggatttcttgcaagtgtagagatagtgtttatctagtttttgctgagtagtgttcttagcaaagggttggtctctaagagtctaatagggttttagacttctaaactttatctagggttgataaagagagacttgtataattgcttgtaagaatattttgcaatagtggaactctactctagtgttgagtagaagaaactggatgtagcctcataggttttgaggtgaaccagtataaatcatttgtcttgatttatctttaacattcttggtaattctagaaattaattctgttgtgtgaatttatcttggtagtgtttcaagtcttgggttgatcattggataaagtttgttcaagtgtttttgtgataaagatccaaagggcattaaactctgatttgtttttgaaaactctgtttttcattgagaaacttttattttatcaagactaaccaattcacccccccttggttaagtgtgaagtgttccttatttttcacattaacctccatccactaaaggctgacaataatgcttaagtcatttcctttttctccttaaacctgtatcttttgataatgacaaagggggaaaatgtagaataggaattttgatttgtaaacacttgtacttacctttttttaataaaacaagtgttatggtggtgacatacgtttgtttttcatgtttttaatttctctactcatatgctatgcatgctctaattaatacatattctctgatacatgcatatggtaatgaactccatgaaagtctcatttatctcaacataatctgctcatgcattctcataagatatttgctctaattatgtcttagaaagatctccttatgctctgatgcttaacaaatttgttgtatatcaaagttacattcttcagatacataaataaagagtaagtggtgtacaacaatacattctaaacacttttggtaccttgatctaatatcttcatcatatcctttttggtatcaaagttcatactatttgccatcatcaaaaaatgggcgattgttaagtctagctgcatccaagtcatattagactataccaaacaattaaatccttaaggttttgatattaacaaagtataaattttatgtgataacctttcatgcttaagatacatgtttacctttctctatgagatacaagcaaagggtataaacaaaaagactctggagtattgctaaagtatcagtcataggacgatattgcctaaacatccagtcctaagaagataagtgctttagcacttgactcatagtaaaaaggaaatagaaaagatacccaatcctcaagtactgatagtaatcatcagaaagtaatgtccataggttcagtaagcaattcgtgccatagcgcaaaaaaggaatgatttaaattttcttatcttgacattcttaattcattttctcttatgttgttaacgttatatttgatttgtatggtggaagttagctataagcataaggcaacactgacaagttgtacttctttgaagatattgttgctcattcggcaagtgcaccgatcgttccaagtaataaaatgataagtagagtatcgtccacgaggattgaggcaccaaattcatcacaactatttattttaaattggataaagaaaggttgataagattgagttttaatatcttgacttaatgaatacgaattcaaaaacaacaagatttggattttaaaaaaattatgtataatagccttctctctctttcctttagcccttctctctctttcctttcttccttttctctgcttttgccattgatgaactaaataagcatcttaaacactcaaccgttgaccaaaactcttcacacccaacatgaaagttgaaaggaactactcaatgagctagattccgtcatcacttttctctgaaaaccatcaaacagggagatccagttctctaggggaattcacaaagtttgattctaaggagaaaagaaggcgttttaaggacgttcaagcttggaaaagctgttctctagcctttcttgtcgatttagaggtaagaaactcaagttttaccgtttgatttgtgaaattgttcttgggatgaatagtgaccactttgtgatagggctggaattaggcttgggttctttagaaaagtatgctcaggaggttgttctaatgaatattaaactttgaaacatgacttttgatgaagtttgggtttgactctgagttatgtatgaataggaagaatgttgatgaaatggaaggtgttatgatagatatgagcctaagtgcctttacaaaagttgttcaggaggctaaataaacggtgaaaacgtgttgaaataactgttttagtcaagttagataattgttggaatatggtctgattagagcattgaattgaacttatgcagagtctaagtggactctgtgatcttggttggaccaagatagatcctgttgagggtctgtgaatcgcctataaggtggttagctctgaaaacactaagatagagaacagagagtttttaatggaaaggaataacgtttcctttcattctaacggttgaggaccgtttttgattgattgtttgtatgccttgtgtagggtgtgatagtgacattgctggtggttgtgaccacgaagccgggagagccggtatagcgctgagagcaggtaagctctttgttcttggaagtattttccttgcttgtgttccaccataccccaagggggtgacggtcattgtatgtcatgtgtattgaaattgtgtgttactgttttattgataacatgtatatgatatacactgtaatgttgtgttattgattgatgagttttctttggctagtagaatagagtactatggatttctgttggaaatgtacctgtcacagatgatcttccctcggaattgccataggtatccaataaggtcttaagggaatgtacctgttcagatgatcttccttaggcattagattaagccctaagggaatgtacttgttcaaatgatcttccttaggcattggatgaagtcttggaggattataccactgggtggatgatccctctcagaccatgtgatatgtgtgtatctactatattgttacacctgtgttatgatatacatgtgatatgtttatgggagccgtgatggctggattgtgtgtgatgccaattttgatactatttgccatggaagtgaaccagggggaggaaagacctccaaggaccctgagtttactgagattgttatctcacccctgttgggggattatgttttgcaggtgatgctcagggagtggctgataaatcgcagggtaagaggcccgagctgggatagattttatgagaatcttaggcatagtaatgaagagcatgttggctctatttttgttttatgcctatgttttgtaactgataagagatatgtacagatatactttgtatattatgagaattcaccatatatgatgtacaattgatgttgttaatgacgtttgatgacgtcatttttgtttactgcttccatcctcattatccatgataattgttgcgcttaaccaccataagataatgttaatgaaccggatgcatacaggtcgttacattatgagagagaattgtagcaaagacacaccccgttttgatcccaacttatctaattagattgattactgcattcaattatactaattattcagataatgcctctttacttgaacactagttaaagactaattccttagtaactttaaccctataacccaagtaaaaatcctaattccttagtaattcctcttcgatcaagcattaagtgagatgcatcaatttatctacaactttacatccctatccctagggtaatgtatcgattgttattccacctttgtcagaaatcaaagccccaataatcctattgtgaaccctaactctcagaactttatcaaagtgatcaatctcaataaagatatataattcatataacacgaggtgaaacaaaataatttaacataaaagaaccatagaattcaatccaatattaaagaagttcacattaggttgtgaccctcactacaatagagaatttagacaactctattcatgattggcttcaagagtatgaacacgatatacctaagccaagaatctcaaaggaaaagaggaaggagtatgacccccttcaatcttgatttgatcttcttgacctagcttcaattaatcaccaagctgcctcctttgctcttgttctgttgttcttagtgtagtcgttctttatctcttcccctcagtccatatttataattaggtcatcgaatctatccaaaacctcctattttcgtgcaatatcaattcaaatcttgaaatctcgtgtcgctggggctaatggcgtggcttctggcgctgatagcgtgacctgcttaaatgttggcactgacggcgccacatctcacgttggtagcgtgagatggcagtggaatttggcacatttcaattccttggcactgatggattgagacatggcgcttatggtgccacattccagggagattgccttatgtttgtttcatggcgctgatggcgcgacttcccgcgttgatagcgtcagacatcaaaaaccttggcttcttgacttttctttccttcactctttctcttgattttcctgctataaaattacacaaaatgagacatgatgtgaattggattgaatcaatcaaaaaatccacaaatgaggttgattatggttccattatgatcgattcttgcttcttttagcttgaaaaacattgtatgctagacgcatatcaaataattccaagatttaaatgttgctgtcctcagcaatatcaaaagttcacaatgggaagcaaggatcaataatcaagcacaacattgcactaacaatctcagaattactatgctagaatatctgattttcacatcaaattttcaacaatacttttcaattccatcaaatgtgaagtctaacttgaatacccctcaccaagatatatcattcactcatcactcaagtgtttgggtattatcataatatctccatccaccacaggcatggtattaccataagcttgatcatattctcaaattcctaaagatgaggaacataaacacatgcacaatttgatcaaaaggtcttgataaggttgtaacttggctaggcttaggggtatgaacatttgggaagtagctgaataataattgattgggacattgatcttctttagactcattcatatctcaattgggaattagttctccactacttcttttcagaattttcattcctttcttttcttttctctcatttacatttgacttctttctttttctcctgtgaactattgtgtagtagttcttttctttccttttgcattttacttctagtggtgttcacctggatctctttcttcttctttttaacccaatcaaggattccaatctcaattaaggtaagtcaatgggcatggtctaagcaattcatcaggtgattgaatgggaaaagtctcaggctcaaagggggtagcaatgaaaaaatttccaggtaggctagtttggccctggcaaaaagaacaaaatgcctttatcatatcaaagtgtacatgcattgtagagaaacatatcaagttctagaatattaccatagtgaggtctttctaaaacaaattattttctgtataagctcaattctcaaatgctatggtatcaagctagactcttcaatttcatatcaagtatcatttcctatttcaacatgtaattcagacacaaaagcaattataatctcaaatcatgttcatgcaatgccataccataattcatatcacacatgcttcctaaaattcagtccgatttgactactgatttagcacatctaatctgagattaatttggatatgcttctagaattttatttaaaacaattactaaaacctaacaattaaacactacttgaaaattaaaattccgtgtttaaaattacatcccccactacaggcttaatcatcataatcatgttgcctttccttttgacgtcaacaaatttacctctgaaacttctatcaatcataatttcaactccatttcgattcttggttgtacctatataccacaacttgaaactggtgccctccacttccttaatcttttctccaacccacttagtttcttacaagcaaacaatattcactttccttctggcaaaaacatcagctaactccctcagtttacccgttaatgttcctatgttccaacttcccaatttcattcgaaacccctgggcggtgtttgctcgtcacactcgcccatctgcatattgtgacccttgcctatttgttaccaaattcgggtgaagacctggcgccttgcctttcggcatggaccctagctcacttatcactacatcccaggatcgatgtagcgctttgccttgtggcaaggaccctaggttatttttcgctacacctggggcccgatgtaacacgtcgctatgaagggtacaccccaatgaaatatcataaaggttcatcacataaaaataattggttttttacagctggttagtgacaaatatatcataagacattcaaaacatttgcattcaaacatattcttattttaaatattttctcttgacaaaatcacctagtaatattaacaattagttataattcactggttgggctaacccaaatcagtttgtcattttctgtggttagttgttaagtggtataaaagtgtctagttaccccaaggtcagttgagctccactcaaatcagaaatgaaattccccaaacaaccatgagcgaaaaccaaagtgaatccagaacgccaattgtttatgctagcttgacaattttttggagaaaaaatatcaattattagaaaattcaaatcatttttttatgaaattaattgaagattagaatggcataccgtgggaaacacaatagcaacatctgacccaaatttagattctagctttacaactccaatagtgttgtgaagatcaatgcaaacaggcacgggaaaaaaagacaccaatatgataaacaaatgattcaaactgaaacttaagaatgaaaaatgttgaaaattagaatttgcattgcaggtaagcggcctaaattagttgaatccaacatatgcaaaattcacatatagctcattcagacaaataaaaaaaaaaaactgcaccatgcacaaacaaaaattgatctcacaacaaatagaaagaaaacacatcaaacatagacttaccagttaattcaaaaaaccagactgatgatgaattcatacttgcatcatggggtcgaccatggtgatgtcagcgctcccctggaaccatatttcatttctactttctgatcctgtaaaataattgtaaaaaagaaaggctccttagaagatggaaacaataagctcaattttgaaaatgaagatacatttaaaggaaaatgatagacaatttttttttaagaaaaaaacaccttagtttttacaaaaaaaattgatgcttataacctaccaataatatttcaaaaagacaaataaattataaaatatataacatgcagatacaattgatggagtggtcacttgtaatgaatagaacaaaattacttgttaatttgcatatcatatactaacttcaactcatatcaacaaaaagctaaataaaccagaccaaatatatagtttaatccttaaattaaaagatgttattcaaactgttgtggtccttcaagatttttgtctatacaaatagccaaataggtcatgaaagtgttagcttgctaacaagttcactctaccaatgtaataaacttgctaacaagttcatatctttggggatcaatttgtaaagaagaaaaaacccaaaacacatacacaaaattacatgacaagtaacatctttaggttcccaaaatctatacctttccctaaaacaaaaacagagaaaaagaaggcagcatgaagcatgaatgtatcaagaatttgtgtttgaaagctaccattttcacatataacagttaaatgatcaaaagttacattcttttattaatagttaaatgtgcttttaagaataaacaaatactttaaagtactcgagcatataccaaagcaaaagatgttaatggtaattttaaatcttcttatattttatttttttcttactgaatgaatatatttttatattttaagatatacaaaatggtagtggtagataatttgtttacgaaacaggtaatttcctatattgtcttttctattgtttgtgaccactaatcattagcatcataaaacttaaaatacaaaagataaaaggcatcataaaattatcttcaaatccgaaatattttattacggtgatttccttccataccctattccaaacacgacacagtagcataccatccatcttcccccaaattattcattccattcctttttttctttttcttttttttcccaataacaataataatcaatccaaataatttccatgaccatgcccataacactcttactccaagccaacccctcccacttgaaatggaaccaattaccttcccttcaagcgtcaaatgtctctccttgtcgcggaatttgaataacacgttgagtttgcagtccccttgggaggttctggcaagcacggtgtcgaacaccctgaaaaaactgaccatagctgtggtgttggtggggttgttattaatgggagcaaggtcattttcttcttcgtcgaggatgattcaacaaggtagaccgaagcaactcttcgatcagctatcaccacatcgttgccgagaacggcatagtgcagtgccaaggacttcgatcgagctcatggttccctttttcggcaccgtattacgggccttcttcattcaatgggacttatgtggggcgtcgaagtcggtgctggctcgagtttctttttgatcttagtgggattcctggcttttgttttggtttttggatttctttcggatctcttgcaaagtaaacgacacgcgacgaaggaaagaagggagggggtgacgtagagggaaggggtttgggttaaggcatgtgaggatgaaaggagaggaatggggtgagggaaatgaaaagttgaaaatgaaagagtagaggaacggggggaatatgaaaagttgtaagttgaacacgaaaattaaatatggtttctttgtaaaccgaccttaagtatctaagttcaaggacgattttgaccaaaattgtttttgaaaagatattttaaagacggttaagaaagaaccatctttgaaaacttgtaattatttacaaaaatatcaccgctacttaaatgacgacagtttttttataaccgcctttaaacaagcatagtagaaagcgacttttgtagtaatgcatgatgtgaccagaaagataagtcaatgcaaaatacaagttcatcttattctattcctttttcttgttgattaacaatcaaattactatttcttatgtaactttccaaaatatctaatcaaggtgaaccattatttctctaaaaacaaagttggagcttaaggtgatgactaccacttattgttttcttgattcaaaatcttgatgttggaccttccaagaccataccatgaggtagagttgaagaattggtgatatttcaatttaaaaaatattaatattaaaaaaatagagtccatcaataatatattaaaaaatatttatataaaaataaataaaaataaaatattattttctaaaaaattgcaagagttatgtgtggaattttatgtggatttaaattagtaggaaagttacttgcggatatcaaattcgcaggaaaattttatacggaaaaacatatggtggaaaattgtataaatttttaaattgcgtgaagtttattatctacaaagattttatctgtaggtgttaatccacattaaacacgtttccaacgaatttttcatgaaaagctgaaagaaaatccccatagaggaatttcttgtaatgagttatgtcatgacatattttgccattttaaagttagaaaaaggagacttgctacaaacaacacaacccttcctcaattcaaccattttttttttatctcaattgtttttgtacttattagcatttctttttcaatttatttattgtcgtgctttgcctttatattactcatttatcattctttgctcaagtaaaatttggattatgttgtaaaatcttttttccaataattattctaatgtaaaataataatgtccaagaggtagaattttaactactcaaaatactaaaagtattacttatataataatgaaattgtttgttgttttaaagtgtataattgtatcatgttctgtaatcgattattatagaaacattcaattttatgaaaatgagtttctatgcagaataattgattattttgattatgtaatcgattacaaaagctcagatttcactctgaatcatgatttaagtgattttaatcgattaatccgacacttaatcaattattacagagcaagtatcagaaacaataggatttatgccgtatgacatggaaatttttaagtttttgtgatgaaggattcaattgacaaataatttcacatgaaaagacatacaacattcaagctaacagagattagattcatccaagattcctagcatgtttctaagagcatagaatctatctctagccaatggtttagtaaatatatcagccaattgattatgagtgtcaatgaaatcaattttgatattacctctttgaacatgatctctgagaaaatgatgccttatctcaatatgtttggtccttgagtgcattattggattctttgaaatgttgatagcacttgtgttgtcacatagcacatatctatttaaattgcattgattcaatttattatttataagaattaattcgattgtaaaaaatcaagaattcttaagtaaattcagatttatttcaaaatttcaaaattagtgtcattactattactgatcaataaaaaaatctataaaaagtaaaaagcgaagggaaaaactttcatttttttatggtaaaaaattcatttatacctgttattttccaggattggttgaatttcaaatatttaaatttaccactagaatacgaagacttacttcacattttgaattgcaccgaaaagactatttatctcaaagaggtttacgtaaaattttgggaaaacgacaaagattgctgtcttatttgttaaagaaagatagaatacggtataaaaaattaataaatcagtttgatattagagagtcacaaattcgttaaattgaagagtaattctcaattattcgatttattagatcttgaattttgatgaacttttttttaagcgattcataaaagaataaatcgaggaaaaatctatgaatatctcaactacaagaaaggacttcatgatagtcaacatggggcctcaccacccatcaatgcatggtgttcttagacttcttgttactctagacggtgaggatgttattgattgtgaaccaatattgggttatttacacagaggaatggaaaaaatagcggaaaaccgaacaattatacaatatttgccttatgtaacacattgggactatttagctactatgttcacagaagcaataactgtaaatggaccaaaacagttgggaaacattcaagtacccaaaagagccagttatattcgagtaataatgttggagttaagtcgtatagcttctcacctactatgactaggaccttttatggcagatattggtgcacaaactcccttcttctatattttcagagaaagagaattaatatatgatctatttgaagctgcgacgagtatgagaatgatgcataatttttttcgtatcggaggggtagcgactgatctaccttatggttgggtagataaatgttatgatttctgcgattattttttaacaagaattgttgaatatcaaaaacttattacgcgaaatcctatttttttagaacgggttgagggggtaggtgtagttgatataaaggaagtaataaattggggtttatcaggacccatgcttcgggcttccagaatacaatgggatctccgtaaagtggataattatgaatgttacgaagaatttgattgggaagttcaatggcaaaaagaaggagattcattagctcgttatttagttcgaattggtgaaatgatggaatccataacccctctttggtagaagtgattctttattgtaaagaacccatttcagtactaagagtgggttgataacccacagcagaaggcattcgacccaataaggcagatacttcagatcctgtttgaacgaagcggaagatattgtcgatacatagaagttcatcttgttcattgacatctcaaaatattccgccatagtcaaggcagttaaaccaactctcatacgagctccgggcggttcattcatttgaccatatactagagctacttttgattctgcaatattttgttcattaattactccagattctttcatttccatataaagatcatttccctcacgagtacgttcacctactccgccaaatacagatacacctccatgagctttggcaatgttattgatcaattccacaatgagtaccgttttacccactccagctccaccgaaaagtcctatttttcctccacaacgataaggagctaaaagatctactacttttattcctgtttcaaaaatggctaattttgtatctaattgtataaaggcaggcgcagatctatgaatgggagatgttgtgtgagtatctacaggacctaaattatcaatgggctctccaagcacgttgaaaattcgtcctagagttgctccacctactagaacacttagggcagctcctgtgtcaatcacttccattcctctcattagaccatctgtcgcactcatagctacagctctaactcgattatttcctaataattgttgtacttcacaagtcacgttaatttgttgaccaataatatctcgacccttaactatcagagcgttgtaaatattaggcatcttccctggggaaaagctacatctagtacgagaccaattatttgggcgatacgtcccagattttttttttcaagcgcagaaacctcaggaccagaagtagtaggattgattcgcatataaaaatatatccaatttttttccggaaaatttttgaaataaaaagaaatgttcgataacaaagcaagttgattggttaattcaataataaataagaaatgggagttagtattccatttttttgataccattcgaccaatccaatttaattgtttacttatttaatttcaataattgaattcttaagtttatcccagtcattttttaaatttcaattggataaaatctttcgaaagttttttatttttttctatcattatagacaatatcatctatattctctatggaagtcgaacctcaaccttatttacgattcttttttttttcaatatcattttgtatttcatcagtagacaatttatacttagtatatttttttacctactttttttttccggggagaagtctgcctatttttacatctaagatttacatatacaacatatatcactgtcaagattaagagttaattttttgattatttagattagatatttcgattccaaaattaaaaaaagggataagagattaaaaattgaaaaaaaaaaacaaaaattgggttgcgccatacatataaaagagtatacaataatgatgtatttgacaaatcaaataccatcatttaataataacgaactttggggattaattgacaatattagttgattatttgggaaagattcctatgaaatgaaagatttcattaactcctaagtcatgtcgagtagaccttgttgtttcgagaattcttaattcatgaattgtagggagggatttatgtcaccacaaacagagactaaagcaagtgttggattcaaagctggtgttaaagattataaattgacttattatactcctgactatgaaaccaaagatactgatatcttggcagcattctgagtaactcctcaaccaggagttccgcctgaagaagcaggtgccgcggtagccgccgaatcttctactggtacatggacaactgtgtggactgatgggcttaccagtcttgatcgttacaaaggtcgatgctacgaccttgaacctgttgctggggaagaaaatcaatatattgcttatgtagcttatcccttagacctttttgaagaaggttctgttactaacatgtttacttccattgtcggtaatgtatttggattcaaggccctgcgcgctctacgtctggaggatttgcgaatccctactgcttatgttaaaactttccaaggtccggctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaaaatgtgaattcccaaccatttatgcgttggagagatcgtttcttattttgtgccgaagctatttttaaatcacaggctgaaacaggtgaaatcaaagggcattacttgaatgcaactgcgggtacatgcgaagaaatgatgaaaagagctgtatttgccagagaattaggcgctcctatcataatgcatgattatttaacggggggattcattgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagtaggtaaacttgaaggggaaagagaaatcactttaggttttgttgatttactacgtgatgattttattgaaaaagattgaagtcgcggtatttatttcactcaggattgggtttctctaccaggtgttatacctgttgcttcgggaggtattcatgtttggcatatgcctgctctgaccgtgatctttggggatgattctgtactccaatttggtggaggaactttaggacacccttggggaaatgcactaggtgctgtagctaatcgagtagctattgaagcatgtgtgcaggctcgaaatgaaggacgcgatcttgctcgtgaaggtaatgacattatccgtgaggctagcaaatggagtcctgaattagctactgattgtgaagtatggaaggagatcaaatttgaattccaagcagtggatactttgtaagcagagaattaattgcaattaaactcggcccaatcttttcctaaaaggattgagccgaatacaatactacaaacaatactacaatacaaagatacttattatctaaagatacttattatatatatatatatatatttatatatatatatatatatattagtttttgttttgtattggaatagattggaatagaaacgtagtaagtagacgagattttacgaaaaaagttattccaatttctaagagaaaacgtctatttccttttttgatgtgaatttcatataatagggaggttactttatttttttctatttctatattaaatttatattttcatatttatttatagatttcgattatagatttcgataattttttataagtttttagtttagaattcgaatagtttagaatgcgaatataataaaatttatatatttaaagaatttttgttataaataattataacttataacataatatttcaaaatgttaagttatgttggattggtggtagaaaattaaatgagattgattgaaaaataatgggatgagatggattgaaataaaaacatcattttattgtttgattttttataatgaaacaaaacaaaaaattattctattatttgaaaaaatgataaaatggaatgaattataacttttaaattcatattattattcttatactaaagatacttataattaaataattttataatctagaaatattgttctatcaagtgcaccccgaattgggggcgggaggtgggaggattacggttaagcagtgtaatagatcatgatttatcttcttctattatgttttattcctatttttacaaaccaaacattgtttgatttgaaaaaataaaattttattttttaattataaaaatataattttattggttatatttttgtaattaaaagtgataataaaataaaatcttaaatcaaaccacaccctaaacttgtctcatttaccaatcccaactcccacatttatgtctgccaatgtgtttgttttagcagtccaccagtacttctacaatgcactcgatcggctttgtatttgctaaacccaaagacgtcccatgccatcaagaaattaaaaacacacggattttgtgtttcctcatgaaatgtattgtcaaagaggtttccttttgtcatcatggtgtcaaaaatttgaacttttcttaaaggtatgcgaaggcattgattgatgagctctttagtatttattagccgggtctgcccccaaagtgtttggtattaggagtgcagatcaagctacgaataaaataaaatatccaaattggccgggaaacattcttacccaattgcttgagaattcctacttactctatgttaaatgttcaatgcatgctcaacttttacattaaaattaatttgaagatacggatgattatttatatgatatatcataccgagaataaagtttctctgttgccccttggatcaatgatgcaatcacatatcttggctatcagatgcttaggatgcatagagattatggggcagttattttttttttcatcttcaaggacacagattacggtcggaagtaattttttttgtatgatgcaaaaaaaataaagatgtttagattgatctcattaattccatgctattatgatacaccttttacaccttaccaacacctcttttcttcccaattatactttaggtcgcttcattttatttctcatcgacccttcatttatagtctccaaccacccctcctaacaccacccccatcattgtcattattttcaatatcaaaactggtgacaattgatagtagtagctatggtggtggagaatcaacgatgtcttgatggtaacgatgtttgctgatttatagatttgagctcgaatcgtctgtcgatagtgcatggtgttcaacggtggtgtatcaacaaggaagagcatgatggtaaaactagcgtgcttgagcaagattgcttcccatcaaaacgcatcacgaaagcaacaaattcgtcatatctacggtgctccacgccgaccaatgccacacaccaccacaaaacccaaactcgaggcaccaccacgaaagccaaatgtggtgtaccaccacaaaatactgtttgacaagatcttttagagatttgccgccaatagacacgaagtggtgatgacacaacggtagtttacatgacaaagtgaattgacacaacccagatcatagagctctattttttcttcttcttaaatatgggtttgatttttctttctcttcatgttgtaatagttctaaaatttctatttgtttagttaatattgctgttgatgcatcataaagacctttatcttttgtacaccatacacaagaatatttacttttccaccataacctgcgccatcttcaagttgttttttgcattgtaatcttaaaagagaaaaaaaatcctaaaatattataaacaaatttataacaattttaaatttaaataatatctcaaagataaaataagatttgaaacaaataataagttcttaaaaaataaattaaattctttttctaaactaaaaatacaacactatagacatccacgatcagattcctttatatatctactaaatttgaaaagaaaaaaaaagtttattccccaattacaatagaaaaaaatgtttattgggattgtgccgtggtgaaagtgagtgggtatggaaacgacagaaaaaatattatttgctacacgtaatatctaaccctgacatgttgcccatctatctcgtgaaccatagtaaaaaaaaatccaagtactttctacgatcgagttacccgaaagaaataagaattttccaagtttcaaacggatacttataaatggtagtcgtgttttaccctaatcacgtgagatatatctgtcagacattgcatgaacaatttaaatattttttgttgcattttaattatttaaattcttttaaaaaattacattgattgcatgaacaagtctgtatcatataatatttgtgtcctgatgtatcgtatccatattttcttggactgttgttcgtctataaaatgaacaactctactcgttatatctaactatctattacctcgagcgggacagctgaaatattttaagatttcagctgtgttttttttttttaagaacttaatctttatatattattctatattatcatttaattataaattattatttgaattattttaagataattaatttaaaaattaataaatttattagaaatgatgagtagttgtgatgtgtaaaatttttataatattaatattttttctttttttaaagaaacatgttgtttgagaaatcatcatgtaggctaattaggctgtgtttaaaggttaattaaccgcatattttaatgggtcaggttttgctttttactataaaaaaaaaggctttaatgggtcagattactagcaaattaagcagcatataccctaattatctgctatcagatatgaattgttgcaaagtttgaaccgatcactgttccaacagccagtaagtttatctttgacaaaaatgtatcgcaagaagaaacaaatctgacactcaaagcttctcttttgtggggcccttaaaatctaattatctcctaccccaccacgctgattctctattcctagatcagattaatcaagatcataatattgctagttgctaccctgttggccaattgacatgtgggtccaaaatggctatgggtctgtgctctttctgctctcacatttacttaatgtacccatcctttgtggctcccctccacagacttatcccacgcgcctccctgttgtcattgatagtgaagtacttgattggctcgtctctcccattgcatccctggcccatcatcaatcatgcacacaaggcaggcttaccttagactcaattttctatcaaatggaaggttttgaattcaaaatcaatcattaaataggtgggaactagtagtaacactttcctttgggagtgactaacgaatatgactaattaagtgcgtgttacgttttttttttttttttgaaaaatatctaacaagtttaagtataattttgttttttctgtaaacatatactataataagtatgaaatatttaaatatttactaattttattaataattattttgtttgaatatttaaccgatcatttttaataaaatcatctttcacaatcatattttttcattcatcaaatttgaacataaagtcttacttaaagattttaaaattctaattgaaaaccaaacatgttatcataaagcatggctgagtttgaatacctaatgaggcaaagtttagttttaaaaggaaaacgtttcctcaaatgaaaccacttcctaagcaagtaacggtgtaggtatacattctcatttattcatttcaaaggaaacatatccatattgaaatatagacaaaatttagataaatctcttcattgcttatagtattattctcttatgaacatcataatgtgtactcatttttatacttacaaagacatgataaggtagttaaaaaataggaaacacattatgtttttattacagaataataccataaacactcggcggaaccttatcatcaaaataaccacaaactttaatctttactttatataacgtttataattgagcactacggcagcatttggttaagtaatcaaggctatgcttattaaagtaaaaacttaacatacactccagtcaaaacatcccaatgattatgctttgaatcattactccttactcctatacttggaaattaaaccaaatgataatgaactgaaagagacttatccttcatttattacactatattacaataacacaagataatttacagttgacatcgctgataacagaagaaaaacacagaaattgagaaggtgtatataccaaatgttatagtactataaattctatgaagagagtctaacagagcacctgaagcatccctactcttgagactaaatgtacaataacaacttcaaaaaatgcctaattacacaggaattataaattaatactttggtatcctccccctccccccccccccccccaagtaataatacagaaaatgagttgtcaagtattcatttaatcctccttattatacattatatatttcataaatttttctaaacatttattgtatatacttgacaactcattatgagtattattctcataatattaccatgacatgggatacactaatacagtaattaatactaataatactacgtattaggaagtagccggagaacccaccagagagaggtaaacctgactctgtatcactgtcttagcgattttgaaacccggcaccaccgtgaaacccaccctaagctcgccggagctggaatcagaggattccccggaaggcgaaacgggttcttcggtgacactctccatgtacacctcagagaacctcgtgttcttcttgatttgaaagacggtgacataattatcctgaaacgacaatgccaaacaatgcagggtccaaacgcgctttgccatctctgcaaacgcgacgaagaaagaagaatctgggtaccctccagagttcaccaccttcctctggttcaagttgccgaagaaggaacactccattttggcgtgcaccacttgaaggtacttggatttcaggaacttggagaaggaagagtttgggttgtgggttaagtactgttttggattcaacgatttgagctttttgaatttgtcaaagtagaggctttgtgctccttggttatgtaggattttgtcttcttggacgttgaagtttgggttgttgaagccttcaaacattgttatgcaaacaaatgattcaaacgcgaagatttggtgagttggtttggtgaaaaccgcgttaggatggatgaacttaaccgctgcttcgagatcccaatgagcagattccatttccgccatcataatcttggagaagcttctgactgatctcaaagtgtggtgaagaaaatgaacaaaatgtgttggactcaacgatgaaagtgtgaggttatcaaacaacgacaatgagccactcgagttgagtttcttttcaagcgatttgttgaagttaacacagtcgtcgaggtgtttcttgagcgatgagatgttattgtccttgaactcaacctcggcttcgagcctcttgatggtgatttcataggttttcatgagactttgttgttcctgaatctccgcgagcataatagtaacttgaggtgagagatcaagctccttcttcaagaacctgcgcttcaactccgagatggctcgaagttcatccaccacggcttgatccgcagcttgaatggagtcgttgttgtaagggtgctgagccatttggagttctgcatatgctgctttgatggttgtgacgccagcgaagagtctcgcgattagagcctccataactgctctattcttgttgtttccttggtggggtttgttgttctgatcggtgaagcgatcctccttgactttgaggtgggagttgagcatgcaaatgccattgtttgatgcgagtttcgttgcacttcggaggcttatcaccttctggaacgtctttgccagtttcttgctcctaacgttgagtgctgatttgggcttcatggtttccatctcaagacaaatattttcttgtttgaagaagcataagagttttgtgtgttttcacagcaaaaattgatgaaatccaataacaatgggagagaaaatgtttgcagtagcaaaaggagattttggttggaaaagcaggtgcaaatctttgactacaacactttcaaatcagagtctttgagcggaggatagagattggtagtgtggtgatattaatatataaacatagattttatgaaaataatgggagggagattaagtaaataggagtgtgtttaaagcgcgggaaaaggaaaaggacgaatgctttagctttctcatgaaagatgttaaatactccaaggtaggcttgtagtacaagaactttgacatacaagccactgattatctattttttcttttctttgcctacttgtttttggaataatatatctgtatagctacccagagagatgatagtgtggggcatattgccttaattacgtgattgatgggtatgatctaattgtggaccctattagaattcaaaatattgataaaatcataatatatcgtatgctaggaaaaaattataaataatgatatatgtttttattaaaagagaaaatagaaaacacacaggcgaattcaaaaaatgtgtgattatttgttaaacatgttttatataaaattaagtgattgaacgtaaataattaatgtgttgaagttaagttgaatcatttgaatattatttgagttaattttgataaaaataattgttgatcaaattttatttaatttttgatcaaattttagattaataatattttttttcatgatgaattagaatattaaaaaaaacatattttatataacaaattcatcaattaataataaaagtctattaattaaaaaaattataccgttgcaaacttgcaataactgtgaatctgtcatgcttgtgactgatggaggacattatgaaacatgtgagggataggaatccgggagctgttgttttctaatgttcgtaaactagaaggtagatgcatgttaaatatctttttatttgatttggaaaagcaaatgatggttaagcgcgcactctgcaataattaattatttttgcttatgaaacaatggtaatcaaagttttgaaccgttttcgtttttcattattccatatggcaccgcaacaaaagtttcaattaattattggaactggttcattgtaggtatgtgaacatgaacggctacatttgtgtagctaagtagctagcctgaataaagtttaccattatccaggctttatgttaaaaatataaaatgcgtactacagatatagcttttatttgtgggggacactatagtcagaaacattattgtggtttccaaaaagctttttcgacggtaataaaaactcacaagggatgaaggaatattacgtaagcagcactgcagccagcagcagaaacagaagcatggaaaatgctctgcatacattttcttattcaatgaattcaatatcacaactttttaaaagtaaaaaaatgaacaacttatgtaaaaactaaaatattattgagttacatttcttttggtacatatgatcaatgttgtctatcttaattttacgagagaaaattttaaatataattattataagtaatattttttaaaacatttaatataactttatatattgataggaattctcttcaattaaaaaaacatcatattcatattataagtacgatgactcaaaaaaacattaaatcgaagtccaaaaattctctaaataagaattattggatcatcacttattcaatgaatagatataataaaaaaaatcaatgaatagatataataaaaaaaatttaaagaaacgtttatcctttgatcaaaacaaagataaactcttggaaacttgaaacaatgaaaattatttcatttatttttagacttacacttgtaactatttattaagttgaaataacattgtgtcagttgattgtgcatttactagtattaagttacattttcatttttgcaagcaatatgatgacaagtttggtaatttaaaaaaatgttttttattgtttaaattattttagtttaattaatgattttaaattcaaattcgaaatttgtaaattaaatattaaagaaaaacattatcatctacaatacttttatctaagtaaaagttacatgtaacatatggtccaagtcaaaatgggcaagtaccaagcagaaaatgttgacatgtcataagtacttcgaattcttttcacactaagatatacaataaactttttcgtacaataatttgggttataaatttaaacttcaaaatcattgaaattaatgaataaataaaaattaatttgatagtttctattacttattttcatatgttttattaaaaaattgattaaaataagccaatattttgttataatttaaaataaatttcagtaaacccttccaaatatcactgtttgattttcttttcgtggattattatacttgtttggagttttgctactattaagtattcagagtcattgtctttgctggaaaatactgtgtccaatgcccatgttccgctcaaagcgcgaaactctttgccatagggttcattgtccaatgtccattgtaggcatgtgatcaaagaagctgagcacgagagaagcagaaaataaattgattgtgatgaaaacttttttttttttgtttaaatatatatagttgatttttgaaaatattttcagtcaccataattttcccatgaccccttaattaacactgttaatattccaagaaattgaaatccgtagtttatacatagaaagagtcacgttttcttttcagttgtttgagaggagctgtctcttgtgtgtcttcgaatgcgtcaaatgaagaagagttagactttttcttcatgttttcttaataattgcaaaattgttgacagagcaagaaaagaagctaaacgatgtgcttccctttttacgtgaaagaactttggcttttctttgatcgcgatcattgaattaaaatgacacaagattgcaaatattatatatactagtggaatcttgtcttgtattggaattgcaattaatttcaatttgatatgatattatatttttctttagttagttctacttagctgtagttcatgaatcccactgaagttaacaatatgggaccaaggttgcacattggtgggaaaacatcacaaaagagacacagccgaaagaatgatggtgactgaaatatagcctcaggtcttaattaaacttacaggagatggggtacaacatagtcaatttgggacagtaattgtaacatcccaactaattaattaattatttatttgttttattttaaattttattattttatcctttagtcttttaagaaaaaaaaatataaattgagataagaacaagaaaaactaaaattttacaagatcatgtattagtaaaaaattggtcgtcataaaatttacaaaatataaaggagtggtacattagtccatgtctctggtataaatatacaagtacaaattttttttccaaaattctcaactataatttatatactataggacttcaaacattgttatttatacacaagagtcgcagcctagtatttacacatagtcttcggtactgtctctgtcactgagaactattatggggtctgtgactgggtttggatacattggtacaaactgagagaacggatctgcagggttaaaatattcactaaacaccgatactggaaaatgggtgccaaaataaatatgagcacgcaacacaggttgcatggtaactacatagcagttgcggacttcatccatacaccaggcgatatccagagcatcaataaagattatgattgcagccatctaaaacattaaataaaatctaatgagaaataaatttctcagtaggcaaatctaaaccaccaaacacgttagaaagttagtaaataaagcaaatttaattcaacatacattttagcagattagtaaataactcaatatatctgaatgaatgcatgattatatgaatgtatggaaatgaatgtaattgtcacaggtgcacatggtctctacatatcgtactgtatgtagctacatctcgtactggatgtagacgctgcgatcgtcttacgcaaacatgcatgaattcccatgtagtagcaccagataagtagcatatgcccagtttcccacatttgaaactcgggtcattctcataacttcataagatatttctctttcataacataagatagatatcattttatgcatcgttcatgtaatagtgtatcccagaataaatttaagagctgctaatgttatgatatatatatatatgtatatatatatatatctacttatttttatatatatacgggaataaaaccggaaggatctgcatggcataatttatacgtagaagttatcttaaaatcggagtggtagtattcttatgacgcaaggttccgagataccgatttttgtttagtttatgcatggctcgtagagttgagtgccgaggtgcgtgtaggggttcggggtacatgtatggtgagtggccgaggtccgaggttcatgcttggtgagttgccgaggtctgaggtacaggcatggtgagttgtcgaggtccatggtgagttgccgaggtccgaggtacaggcatggtgagttgccgaggtccatggtgagttgccgaggtccgaggtacaggcatggtgagttgccgaggtatatatatgagatcggcagggccatgtggccgggctacataggtgaccgagatgcatggtggctgaagtgcataggtgggtaagtataatccggcatggctgaggatcgagatgttggcatgggttaagggtatgaccggtcttggtgctgcagccatatatattcgaacgggtatggccgggcttgaagagatgctatccgagttacaagagtgcataaatagttgggatgagtgaatccggaaatgccgagatggattgctcggctcggacgtgcatatactggtgagtgtattttttccggtagtgccaagatgtgtgcatatatatatgtaaagaagtgggtgtttgacaagtgagtggatccggtggtgcagaggtgtagagtaatggtgtagctgagagtgcagtttgccaaggtaatggtgtaataagaaggaaaagccgagatatccgatatatccgaggtgctgtagtgtaaaggttccaaggtctctactaatatttaagcctcgaatttacgtatgtatactattcacctttacttggaaaagctaggccgagataaacaaaagttggactttgcttttggtttgtcattatataaatatatatatattacttagctattacctttggtgccgtgtttaaaatttatggccccgtagtactatttctttaatttaaaacgttagatgcttaatataatattattatcttatagacccaaattactaataatttaagctctacgttattgctagcttttaaaaaaaatcactgcatcctatattacatttctaagcataattttctaagttaattctggttaaataaacatctaaataaaataactgttaaattaaagattgaagcctagcctaccttggataaatttgatgaatgacttagagaactgccaggataattttgagagagaaggattttacttaagagaagatagtagagaaagtttgggaagactggaagttgttagtgttctacgtatagaatttgatggatgcaggagtatttatactaatttatttggttgaatgacaaccggtaagatttagtttagttaatatgtaactaatttttttggaagatttttatcaaaattaatcattacattcttctcctcattaatgcatggctttacgtggaagcttgatggataaaatttggttctactgatgacacttggactcttaaaagattgtattaaggataggtttcagctgaatttcttcacgtggctggagttgaatactcaagtttgattcttattctaaaaattatctttgatattattatctattctgttattatatttttaaatcacatatatatacatttatatatatttgagggtattacagtaatggtttataataatatcattgctttgtctttaaaatgatctgaacatataactaacaagtttgagttgtacaaaaaaaagtatgatcatttatcacttacatttgactttaagctgaactgtggcgaattaatcttgaatataaagttagggattatctaagacatataactatattcttttacttggattttggagaccagaagatgatagaaattaaaattttccttttatttgatatttaatgtacataactattttgaagaaagactatgaggcccaaatacaccctaaatttatcaagtgtttgatccatctttaatcttaaaatttcctgttcatattaggcacactccttgcaaaaataatgagtcatcataaggtaatgttaacgagtgcctatatcagtttaacatgttaattatttcatttttattcttttttctggagattattgtttttattccttaatatattaaaggtactgttcattaaatttttaataacaataactaaaaatcatagcataaaaaacagtgtgtccaaaatgtttcgctatctaaatgtttactctatgtaactattagattgtataacaaattggaatgttggtgaacacggaggtagtttaatgattcagcaatgaagccatgaaggcatggctttaggtctaagaaaaagatgtaatgcctcaaaatgaatgatattcgtatgtttgtctttaacatctctcaactcattcatagtaattttatggtcttcgtcacgtccgacattcaagttataatattgcaggaatattattagtctaacagtgtccaaagttaaaattatcgcatcttattaagaatagacgaagaagtttcctaatactaattattttatcttttaagatccgtttccacattatattatctgaagtttaatatcattggttactggttagattgttgtattgcagaaaagtgatcgaggtccaggattcagtcaaaggcaccttgatctaattgattcgcatatatatagtacatattttttttttgggtaagtggcatgaagttgtaaatatcaaaatatgtttgttcatatctcacatagtcacattcatttagggctaaatcaagctttggattagtattattagatttgaataatgcataattatatcattgtttgcttcttgggcgtagcaattgtaatggccgggaagaaaaatcatttgtcctcctagattcaaactttgattgtatggcatgcagctatattatttgcattttgtcgttaatgatgaattctacgtcaagacttctactgttatactttgtagccttgtagacgtatttagaacctacctggataagttatatatatatatatatatatatatatatatatatatatataaaatatttgaataagttgatttaaaaggacttttaaaagaaaaaaaatgaaattctctattaagtcaaattaacttatgtacatatgatgctagctaaacaaagagcgtttcaacaaataaacaataacaacttatacaaacaggcttaaagcttaattaaaaactaatcaaatgattgaatataagtaagtaatgtactaaaattaaaattaaatagttaaggtaatagttgagttaaatttttaatgaaaataatttttgatcaaattttacttacctcctcactcgaatgagacataatctttttctcctaataaacatgaaaacgttaaaaaagctttattaaaagctactcatattagcaattctaagactaggtaaaacacaaaaacattgcctattacaggggacttttttcaagctggacttttttcacttttttctgtggacaatcgatgggttgttccttcctacacctccaagttgtttcttacattctttttagaatgtctgtttttaccttttaaattgatcattccagaaataaaaatctataatcaattcaaaatttaattttacattctaaatggatcattttgggaggaaaaaaaggagtgctgaattttaaagatacaggaaacaacagtccaaccggtgatatggaagaagaataacattagctcaaattttaagttgttctttcgcctccaactctttaaacccactaagcccaaattcatcgtggaagattttacttttttttttaacttttttttatttttattgtattttacttttcttcttgaagcttcctaattctgcaaaacatgctatcacatttttctaaatttctcgcgcataaactaagactggtagaatgggtctacttgttctaggttgttccaccgttgattaggtagggtgagttgccttaggttagtaatgtaggtcaaaaatcctaatacgtccagacatcctatttaacgacattttggcaggttgatgaattcatttgccaaaaaaaataaattgaattggcaaatgggtggattaattaacctaaaaaataataaaaaggatgaaagattataaaaaataaaaatatagatatacaaatattatctaaaacattttgaataactgactacataaaaaatcataaaatattagatcatcaatatttaaaaacatatcatcaccatacaaacagtaataccgtgttcacaaaaaaataaaaacccagtaatccttgtctaaaaaatctacaaaataataaaattccgaacaatagtaaataataacatagacacctcatagtacgtttattaccttttccgtctaaaaagaaaaataaagcatgaaaaattcaataagaatactgttatatatattttataatatcttcttaatgctagttagtcaaaattgtcgtcttagagaatgacgtacgaaaaccaacgcataacctaggaataatagaagaaaataaacatgtaacaaaagaagacgaaacatagagatgatgggaagccagaatgatgtgaaactattgagctttgagttgagtccagttggtcatagagttgaatgggctctgaagctaaagcgtgttgattacgagtatgtagaagaagatatcttcaacaagagcaatctccttctggaactgaacccggttcacaaaaaggttccggttcttgttcatcaccaaaaaccaatcgctgagtcactcatcatcgttgaatacatcgatcaaacatggaagcagcagtatccgctaatgcctcaacatccttatcaaagagctcttactcggttttggggtaccgtggctgataaggtaatttgtcacaccctctttctattgtaattttttaaatgttttcggttcattttttacgttgtaaatttctgaaagaaaggaaataattgcgaactcaccttcactccttcataagggattaagaataaattcaaatcaaagaaaaatttccttgtttatttatgaattatatttatttaaagaatatatatttttgtatagtttgctttttttatttccttcatatgcaccttactcctcgttgagtgcagagacagtaaaattcccttttccctcttaatacgtataagaatttcttcgcagtgaatgcaaaataacagaccaccggaaaaaaaaaaaaaaagaagcaaataattaaaatgttttggcctttaaaatgactctttcgaaacccacattgaccaacatagaaattgggcccaagtactcaacaacgaagatttttttcttattattaggtacatgacaatgattttactgtcaatcaaatttggccatgtgcattttatgtagatttacacaactaccattaatcgaaccaaaaaaaaaaaagtaacttacaatgacttaaaaacaaaactagctgccattaaccaacaaaatcaggtaatggtttaatagtaattagatatttagattttatattctaccgtacgtgcaatatgaagtaagccaaaagaaagaaagaaaaccactccctctagcttttacggtggtatatatacacatacacaagctctattaatttgataactcattttcaacacctgttttatgaatatatatgtaacagcttgcgaagacatcatatgttgcaatgtgtagcagtggggatgaacaggaaaagagtgtgaaggaagccatagaagtaatggataaaatagaagaagagattaagggcaagaaattctttggagggtacaatattgggtatcttgaccttgcatttggatggatcccttattggcttcctgtttgggagaaagttgggtcaatgcaaatagttgacccattaaaacattgcgccatctctgcatggaacaccaattttctcagccaccctgtcatcaagaactgcttacccccaagagacaagatgcttgcttattcccgccgtcgcaaacacgagttttcttttactcttcgtcgttgagtcatgctttttcctcaatatctaattcaataggaaaatgtttggtagatacccaatgtattaactaatatctagagagagtaaaaaaaaaacttatatgtatgattagagcttacaatatgatacgaagaaaaatatacaaagaaaaataagaagtgttattaaaatgtgtaaaataaaagatgatttctgaataattatccaattcaatatgatttaggcagagggaaaacctataagagtcaattcagagataaaatcgaatagaaaaaataaaatctttcttttcactaacctccagtaaaagaaattaataggcacgctaggattgactcaattgtactgtacgtttaatcttgggttgtgaatcatctgctgttaaataaattatataagccatgaaagacctacttacattttgggttcgtcattcctgcccctgcatatctctcggtattcaacatttaaatacatataaacaaatattcaacatttaaattaataatttgatgaaaaaaatgaacggaaagaaaagttgcctaagttaatgtcaatcaaagatacaaattgagtactatgtttattagtaaaaacaattttttcaattaagaaatcatattaaagtaactatttttttcatgtgttgaagtaagatagcgtttccttccaaaaaaaaattaaggtggcgttatggactagccaatatttaaattaaatgtaattattcatttaaagaaaaaattgaatgctaatttttaatttcttaagtcaatgtcaaatacagataaaaaaaaaggtaaaggtctgattattgaaaactatatgttacagtaacttcttttttttaaaaaataaaaatgcaaatatattacaataggcacaaacatcaacaaggtggtactcctactctcatctatcatttagagcacacttaaaatttactgaataaaagagaacaaaacaaacacggggagcaaaaatcaaactcattgcccaaaaagctaacatctaaaccactatagttaggcaaagctaacctattacattaaatacgttcaacattcaacattcaaaagttctaaatgtattaaatatttatagaattatacaagtcataaaatagttttcataaagcaatggatacatattacaagataaaaacggcattaataaaagagaaccaggtcaaggtgacaagttaataatttgataattaattttcataaattacaaaaataaccaaccaacacattaaataattaacagcaaaagaagaaacacaaggagaagaatagaaggaggtgaagctctgaattctaaaacaagatgtgtagtgaagatagtgtgaagctggtgaacttttgggcgagtccatttggcaaaagggttaaatgtgccttgaaactgaagggtttaacgaacggatacaaattatcgaatccgtaagatttttgtaagtttttttttaaagttaaaatatattttttcaaataatttaaaacaatgacacatgtagaactcaaatatatgaccttagatactccaaccaattaagttaataagtcaattatgttaaaaataattaatgttgatatatataatactaaatttttaatgtatatttaatacacatataagtttacataataaattatgttgaaaatattaaagtaatagcatgagaaataactcaataatcaaaataaaattcaaattaaattaattatatataactcaataattgataaaactaaaataaaagagaatcctatttaataggatcataactaacaattatcctaattaataaaatgaaactaatatccctaattaataaaataagaatctgaaataagaaaagataaaaaattagataaactaaataattaaagatttagatgtgtattaaatatatctcaaaaaatttagtgttatatatatcaatattaattgttttttagtataattgatgtattaggtcagttggtttgaacatcgtgttaataacttgaagatcacgtgttcgagtcctacatgcatcattattttaaattatttgaaaaaatatatttggttatggagttgaacccgattcacaagaaggtttcagattcttgttcatgcccagaaaccaatcgctaagtcattcaccattcttgaatacattgatgaaacatggaagcagtatccattattacctcaagatccttatcaaagagcactcgcttgcttttgggccaatttcggttagcaaaaggtatttttattccaaattctctattttttttttgaaggtttgttaaaccaatttggagattccatttgacgagataattcttgtaaaagcattttacatccatttttttacagttctaaattttcttagagagatactaagaatgaggatatatgttttattcgtttctaaatttttagaaacaatttacatatcattaacgaataatcggtggatgacatcaaaaagcactagggcaaatttgggtaatataatgttcatatttcatgcatattacaatgtgatgtttgattaaaaaataggtttattttgtaccattttttcttttttgagatttacaatgccacgtacactttcaacaaattaattatttttcagtgcctcctaatttgtatatatttttatatactagcttatgagtgcagcacgaaaagcaatggcaaccagccgggatgaacgcgaaaaggctagctcttaaggaaacgagagaactaatggagaaaatagaagaagcgattaagggaaagaaatattttggaggggacaacatagggtaccttgacattgcacttggatggatcacttactggcttcctgttgtggaggaatttggatcgatgcacataatagacccattgaaatttccagccatcacttcatggatgaccaattttctcagccaccctgtgatcaaggacaatttgcctccaagagataagatgcttgtttactaccgcaacttggttaattaaggtttagatggatgtatttgacaaattatgaatttaataaaactactagctcttgtaaaatgtttttcataaattatgatgaatttattaaaaattgctcgtgtaatgtttttcatcaacaattaagactttgttgttaatttctttatagagtgaatttcccgttttaaagagttaattaaatattaatcttttataaagaataatatctttattagttgaataaaagttatataaactatgggagtaggtaatagggaataataaataatttgggtttgtaatatgtagtcgtcatccgattacaaaccctagcctcttcttggttgtattggcgtgtgtaatgcttattttcattaacggtatatacaagatcgagccttataatattggatacaactctatctagctagttagttatgagtgaagttcgtgagtttgatggtcaaattatcttactcgaatacaactaacgatgatggtaacagatcataataaacttatcttcatccatgcaatctagggatggaaataggtcaagttgtctatcaggggcctttgccctggcctggtctagtttgtttattataaatgtcaagtttggactttttgaaaagtctatttaaataaaaaaaccgggctcaagctttacaaaaagcctgttaggcctgccaggctaccctatatatatatatatatatatatatatatatatatatatatatagatagagatattaaaattaaaaagatataaatcaatctttttaaaaaagagataaaataagataagataaatctaaatagcttatcttactatttaataaaacttacgatattttactttgcttattttgtttacaatattttgttgaatactgtgttatgattataattcttaattgagtttgttgtaattagtgaattttaatctcatattagagtgctctaattaattttaatttttttcacatacaaattaaaagggaagtatgtcaatatgtgtatttctttatattaaattaaaaaaatattatgcaaattctcgaagtttcactaatatataatatttattgtaaaataggctttttaataggttcataggccaagtcagacttttaaatagtctaagccaagcctaaaaaaataggtaaataggttaggtcaggcttgatgtttttaaataaggccaagatcaaaattaggcctaaccaagcctgacctgacctatttccatccctaatacagcttttctaactagcagcaaataaaattataataagttccatctaattaatgtcagaacccatctctaatgtaacattgactattgaatatgctaaatatataaatagttttaaaactaagacaaataactaacgactgaaaacgacccttatagtgcagtccaagcatgatgattacaaaagatagtagtaaaacatttcggacaatgttattatggcagggatattttcgaattatatatatatatatatatatatatatttttttttcaaaacatgtacctaacatatgtcagtccgtatacatgtttatgtacttaattaacataaacaattaataatacataattgtttgaataattttatttatactattaattatgaagaatataagtaagaacagtttagctaggaaattagaaaaaatcacgttaattgttggatagtgagatgaaggtgccaagtgcaatccaatccaacgccaatattggtcaaatttgtctgccgtaaccaaccaacaaaagataaataactaatttgtgtatgcatattgttgacgagaaacagtgaaacacacatattaaagagacacgtaaactataccaaattaaaaagagaggcgtgtaaactataccaaattaaaaagagagacacatacaactacaaatgtattagagatatagaagaaacaaattaaaggaattgaaattatattttgaaagaagatgggaagcgaagaagtgaagctgttgagcttttgggtgagtccatttggtaaaagggttgagtgggctttgaaactgaagggaatagagtatgagtatattgaagaagatatcttcaacaagagcaatctccttctggagttgaacccggttcacaagaaggttccggttcttgttcatgcagaaaaatccatcgctgaatcattcatcatccttgaatacatagatgaaaaatggaagcaatatccattgttacctcatcatccatatcaaagagcacttgctcgcttttgggctgcaactgctgaagaaatggtaacttattaaatcacgccccatctctaaatgtcttattattattctttatttgtttttctttctaaaatgaacttgaaggttccatttccaatcgatgattttttttttttatatataatttgcagaggttaccatttttccgtttttaatttgcttgaaaaaacattgggaatttttttttagcttctgatttcctagaaattaaaacgaacaatttactgttgttttatgttttttttttggtctaaatattaatcggtatattttatgtacacttttctgtactttttttgtcactgaactctttttttttttttattcggtatagtttttattttactttattcggattgtactccttatatgctatagcagtgatagcagtggttttaaacttattagcaacaatttttttactgtagttatagcctttaagaaagttttagtggtgcaaaaaagtaaaaatattaaaagatcaataattaagccatagctttatgatgtatgggtatatatagttccgatttcatgcacataccaaagtgcgatatgatgtatgattgaaaaatagatttattttatacaaaaaaggattagtcttttaaaaaatttgattttgggatacagaaagccatatgagtaactaattttcaaatgcctgttttgtgtgtgtatatataatgcatatatatagttcaggaaggttgtatcgattgctttgcgcagccctaccagcggggatgaacgcgagaaggctcttaaggaatcgagagaagtaatggagagaatagaagaagagattaaggggaagaaatatttcggaggggacaatattgggtaccttgacattgcagttggatggatctcttactggcttcctgttttggaggaagttggatcaatgcagataatagatacattgaaatttccagccaccactgcatggatgactaattttctcagcaattctgtgatcaaggacaacttgcccccaagagacaagatgcttgtttacctcaacgatctaagaagcaaatatatagttaagatgcatgaattggtgaaggactagatttgttcctccaaatttatgtatgtgatactttcaagatatttggattggtttaaagcatcgggtcaaatctctggctaagttatcatcttctagatttacccttttgaagtggctttgatctttgatgtcaattatcctactgttatgtagcttaactaatatatttatattgatggcaataaatcataattcaatgtctttagaaaattgtcatattaatcgagaattcactcaaggtttgtttcacgcgagtctaaaagttttagtatcttgttgtgggcaagaggatcggcacaacaaaatatgagaaatgatgaaaatcaggtggtaaaatatgtagataaaatagttaggtgacaaaatttgaaaaaatatagaaggtaagttgtaaaaaatgtgtagttaatgtttttttactataataataatttgagaaaaaaagttgttggaaagttagcgtccaagttatgataaaaaaaaccatcctaatgccatttctggtcaacaaggaaatgagaatgataaaagagaaccagccgacacattaatcatttgcgtaattacgaaaataaccaaacaaaccaacacataataaatagagaaaaagaaaagaaggaattgaacctctgaaacaagaagatgatgggaagtggagatgtgaagctgttgagcttttgggtgagtccatttggtaaaagggttgagtgggctttgaaactgaagggaatagagtatgagtatattgaagaagatatctcaacaaaagcaatcttcttctccagttgaacccggttcacaagaaggttccggttcttgttcatgcccacaaaccgattgcagagtcatttatcatccttgaatacattgatgaaacatggaagcagtatccattgttaccttaccatcctcatcaaagagctcttgctcgcttttgggctacttctgttgaacaaaagttttttttttttttttttctctttcaaattcccttaatttttcttattgaggttgaaccaacttggagattccatttaacgagataaatcttttaaaagcatattgcatcctttttcgtaatttgtatttgcttagagaacgaggatgctttttttttcctttctgaatttttaaaaccataagaccatgtgtctgtctgtcattaacgaacaaaaatttatgactccaaaaaacaccaaagaaattcgactgaagttcagatttcatgcatatgcaatcacaatgtgatgtttgattaaaaaatagcattattttgtacgatgttttttacacaaaaccacactttcaacaacttattattttccaattagtgcttgctctgtatatatttatatataatacaatagcttgggaaggctggatgggtagcaatgtctaccagcggagaagaacaggaaaaggctgtgaaggaagccatagaaatgatggagaaaatagagacgactgagtgaaaaatgtgcatattcgtaggtaagcaaactggattgagatctgatattccaatccaaacccatgtcagtaatctgtgtacattattgatcgggaaaactattttatgtggtcaaagtttatatacttttatatccatgaattttgtccttaaactttaaaaaaataatacgtagatttagtctattctctttaagaatttatcatgctttttaacatattttcttttaagtttaagaatcaaattcatcttgtggtgatttaatatgttctttaccttttcataggtgatttacagagcacggttctttcgaccagggattgtgcatgtgaggttagtgtagtttagcactgcttttgttcgggttttaagaattcatattgctctaatgaagaatcaacataactcacagagttggcttggctccacaccctccatttgcacccttcaaaatatttccagtacttcacaagggtttgagctctgagataagcctgaaatcattgcattccaagaagtaatatctctgagataagtctaagtgacccatctcacagtacatgtcaacaagtcctcgttaccaggttttgtgtgctaaataattgaaaaagttacgcatagagagaggtgaaaacaaataccacaaaaggtacctaaaacccccgcatcccatcagactgtctgactgttacataagcctagaataaatccaagtaacttctgtggatataaaaacataattagaaggatatacttgtgatcatcgacagatattaattagcagttaagttagtagaaaaaagacaagaaacagtacatcgatgcaacaatggttctaattaagtgaaattaacgtgctaacttgaaaatcaaaaggccagggccggtcctgtaaattttttgattcgggacgaagtggaaaaaatgggcccttattacacatttttttgaaatacaaagaatattaaaattaagggatgaaagaaatgggtccttaacacacaaattttttgaaataaaaataatattaaaattaagagatggaaaaaataggtccttaatacacaaattttttgaaatacaaataatattaaaattagggatgaaaaaaatgagtctctaacacaaaaaaaatagatctctaacatacaaattttttgaaatacaaataatattaaaattaacggatgaaaaaaatggactcctgacacataaattttttgaaataaataatattaaaattaagagataaaaaatgagtctctaatacacaaattttttaaaatataaataatattaaaattaaaagatggaaaaaatagacccctaacacacaaatagatctttaacataggttttatttttattttattttttataataaaaaattttacttaaactacccattcaaaaatttttggaccctgggcggaggccctgctggtcctgccccagggccgggcctgcaaaaggccttaacttcctttcctataatgtgaagtgaatcatctgcacaagagtatgaaaatgacacgttgttggatattcattttgagtcagaggtggaagtgaattttgaaacgaagtccatttggtcaaacttgtccccacatgagaaaaccaaatgaattacaccgataatttgcataaattacgagaataacccagcagacacactattaaaagagaggcacaaagaaagaagtggtgaaacacggaaggaagatgggaagcgaagaagtgaagctgttgagcttttttgcgagtccatttggcaaaagggtagaatgggccttgaaactgaagggtgtggagtatgagtacatagaacaagacatcttcaacaagagtagtctccttctcgagttgaacccggttcacaagaaggttccggttcttcttcatgcccacaaacccatcgctgagtcattcgtcatcgttgaatacgttgatgaaacatggaagcagtatccactgttgcctcaagatccttatcaaagagcacttgctcgattttgggctaatttcgctgagcaaaaggtcatttctaaacccccttttagcttttgttttccgccagtgggtttggcagatggcatttttttcttcataaatattaaagtgagaaactataatttttatttttaatatgtaattaataaataaataaataaaattcataaaaaacttactatgattctttgaaaattaattttaattcattttttcgtaaaacatttttaaggagaaaaaaagaatctaattttatcgagtaaaaaaaaaagttttagttatatattttacataaatctttaattctcatgattcatattaaaattaactaaacatatttaagatattgtcaagaattatgattcttaaaatttatatttcctgagtataaaaagtttcttaactaccaaacacctcataaaaacaaacctatagattccaattgaggacccaaatacattcagcttattgcatagtttattttatagaccattttatgtatcaaatttagactacaaagactagataatgtagcaaattctcgaagtctggtttggttttttaatacaattgaaatattgtgacagcatagagtttttgtctttaacaaattatcatattattaaactaattaacttttataaacctaatttaaaagtcatacatacaatattatctaagggcgtacttagtatgaactttttatacttttgatattttatttcatttgctttttggaatgaaaatgaacatgttattgtttttctatgttactctgtcatttattatctatatatcaagtgagttattcacatcttgttcgaaaatttgaacttaaaacaatataaatcaaagtgaagtgtggtaggccgaaaactcacgggtttcagaatggctcagacagctttagagaagcttcctttgcttcagtgaaagcattgatttgtaagccgtgattttaattcataatataggagcacaaaattattttttgacttcttttgggatatatatatatatatatatatatatatatatatatatacacgttaaactctattcaattaacttgtttttcaatgacatccatgtatgtaagtaataacttatttttcaatgcttgccttgtgtgtgtataacagcttttagatgaagcatggattagtatgtatagcagcggggatgaccagcaaaaagctgtgaaagtagccagagaagcaatagagaagatagaagaagagattaaggggaagaaatattttggaggggagaatataggataccttgacattgcacttggatggatctcttactggcttcctatttgggaggaacttggatcgatacagataattgacccattgaaatttccagccaccactgcatggatgaccaattttcttagccatcctgtgatcaaggacaacttgcccccaagagacaagatgcttgtttactaccaaagtcgcagagatgggctttcttcaacttttcagggctgattcaaggtttaatttagatctattcctattcctctatatgtttcttatggtccatgttataggccatgatattggattgccttagtatcataagaatatgagggaatcatactagctaagtttgtgtgttggggttttttgtgctgttattttctgcggatgccaatagcaagattgtggattagtttgatgtcttaagttcaaacttgtggaataattttgtgaattttatttagactttttcttgttatgtagagaagtttctttggttaaattttcaatattaaattatgtctttcttgttatcttttcgttgacgttatttcaataaatttaataaattataaatgagttgatgaaataattagccaccattcactaggatgtaaagcatgggaaatggaataactaaaatcaattgatttgcgttcttgattttaattgttaattcaaaaaaaagattaaaaattacatatttattttttatataaaaatatcgtatgatgcaaatttattcttttcatttctaacatagtaaagcgttgaatgtttttttaggataatgaaaaaataaacatataacattatattttattatgaataatcataatcaaaaccatctgagttttttaaaagtcacataatctctacatgtgaccccatgactttaaaactttatcacctatgaatggttataagtctcatatttatcatttttaatcattataagtctcaaatgtatcattcatataacttcttataagctcacatttttttgtgtgagaattcttacttttgtgtaaatataagacttataatgatcattttaatataattctatctcatattcttttttttttaagactctttatgattgattaaaatttattaaaatcattatatttaataggttttacttcttatataatgatcatttttcttaatttatattaaatgaaaaacaaaatatactaaaattgatgatttatgataaattctgatcaattataaaatgaatctttaaaaaagtgttaagaaaaataccactaacattcctcaatgcattctattgtaaattataatcctcatgcaaacttgtaaaatcgattccaactcatcatccttgggttagtaattttttttgtcatatccatgtggttcgtatggctaagctgctacgtatatgattcttacaagcttcaatgcttcatagttaagtggttcaatcctaaagcttttatatatatatatatataagaattcacttgagcttgtgggaaagctcatgggaaagctcaattagcacgcatgtggagtttgtgataatacatatttgattctcataaaatacactcttaaaaagaaataaaaaatattaagtataattaaatcccaaactaaaggattacaattgttattataattacccatataaaaagttcacaaatttaaatttattgactgataaattatacataaccttataatcaatagtcaacaatatttttgtcttttattataatattttatttcatctctattatgcattaattattttttttactaaaatatccttatttatttcaatttataattaaacgctactttaaaatgtcaattttccttattgaagaagataagtaaactctcattaatgttaatgacaaattttaaaatattacaattaaagaaggatttaatatcaatacctatattaactaattttcttaattatgtgttataaataagatgagagagggtatccttttaagtaacatctagtagttgaaacaatcagttttctttcgtccaatttgtcattttatttaaatttttcacaaattaaatcattaaattattttaaacctctttctcttaaaagctactacccaaaatacaaaattttattttttataataaaacatattttttttaaaaaaagtcgaaattttcattcttcaaaccccaatcttatcttttacaatttttgtcttcaaattttatcaaaatttcattaaatttctaacaaataaatttctaaaactcttatcacaaatttattataaactccccccaaatatttgaataaaaagtgaaaatataatgattttcgattaagatcactatttactgcaaccaattacggcctacctaagaatttctcatcgaaggtcaaaagatattatgtccaattaacataatttacaattataatttataaatagaaatagcaatcaagttacggtattccgactgaattttcatttagtcacctctgccaaaagaagaaatggtataattttacagtgtaatcatacctaagctagggatcattcgtattataaccaaaatcagctaccttacactacaaactatacaataatatgcaatggagacgtgaatatataaaacatcatcacataacatttgcattttaacctactcttaaattgccacgagacggttatattcatcagaagctaaaacctgtttacacttgaaccttaaaaacaaaacttacttaccccactcatgaacagggagaggagttagccttgtctcgttactctcaaaactaatatcatccaaaccacgacgctctgtaaaatttagcggtgactgatcacacaggtctaaattccaaaacaacttgagataattcaggcaggcaacttcagtttcgaattgttcttccagctgaaaaacaaagctccttaaattacctatttgttatatgagtatagtaaaaacaagatggaccttaacagacaataaaattacctgacaaagtaatagtaaaagaaatctgcatacaaagctgtctgaacaacacctgagacacaagctgtaatagtaaaacaatatagaagttagaatattgctaaggttgacataatgtcaaagtaggttttattttcaccctttattacctatccatctagtaaaatgtggctcagtcagatagcggtatatccagttcaggatgtaaaatgcacgatatgcactgcattttaaaaataatcagcacatctttgatcataataatcagtacattctataagagtttactcttatacattctgagacaagttcaaattgaaatgtatgtacaacttactaaatcctcaagtaattgtgcaaacatcaagacaggagacaaattaggaaatacataagcagaagagtccaattcaacccaataaacatcaagatttccaaatcaggtaccacaaaaaagttcgggcaaacatatacatatggagctaatttataatacatcactttcgaggagtctaatttcttagctatttcaagatagaaaatattagtataccattgtcactagaagatatctcaataacttagaaaggactatctgctaatgatcagcataaaggagtgtaagcaagtaagcaaccaaaacataaaggcagatctttaaaagagaactcaacagaagtgtgcatacccaagaaagaatacatattgcccagtcaaattgtccacatttccacttctttgcaacaaaaccaactggggtaatattgcaactgcctccaagtatattgaaaatgcccagaaaacctgtaacagattgacataacatcaactatttatgatgttacaatgtgtaacagaattatcataaaggtaacatgtaatgcaaaaaacaattttcagattggcaatcaataaggaattaaggataagcaatgtatgtttagacaggaagaacacatgaaaccatgtgatgtatttgctttaactttggcaatattaacctgaaaaataatgggaaaggccagttacacattttgcagattccataaggaaatagatattcccagaagttttataacacaataagcagcagcctatcgtaccattttatgactttcagcctttcccagttaactatgtatcagagccataagacatgtatgcattgcatttttcaaactatcaagtattaacgacgtatctttttctccaagagttggcatcaatattgtaccaaacttggtcatcctttcaagcatgataccacatgggtccctaacataatgttttttatatttccacctaaaatctgaagagcattcagaaaccaattacattttttggccaatcaggaagagaagcagcaccaaacaatagatttagcactaggtggatttctagataacataacaactagttgttaataaacttacaaaatcatcaggccataatataatttacttcagcttcttatcttggttaaaaaaattggaagtattcattccaataatgtatgacaaattgacaattgacagagtactgaactattggtaaattttcaactactgaaatttatcttagaaagcagcataaatgatccagtttccaggattaaaatacaacaggctcccaaaatttgagacttaaaaaatagagttatgaggtgatttatcatttatagaggctctatatgacatgagtcaaatggtaagacataacataaaaaatagagttatgtaagggaagaactacattccttagctgttagcacttagcatcactctgaaacaaaaggcaacatgagtcacatgacacagatcccctcaaagaatcaattgatatactcactaagaaaaacatgttattatcaataacacaattagaagaatatgttcacacagctagcattggttcattagcttaagagctatgccacatcatatggaccatataaatcttactcaaaagtaattgttcaatgaaactcatatatactaaactgtaacccaccaatcaatctcacggagattccaaatgaagaaacacttgagaactttgatcttaaagttttatttttcctcctgttttgtgtaagaacagcatttgaacacataaacatggttttcacgccagaaaacttaaatggatacactactgttcagagaagtttggcaataccatcagattcaataatttgacaaaattaaacactcttcaatgaaatattgaaaccttgagttgaatacaatctattgaagctttcttttaaagaagtaaaaattcgaagaaatgcacaatgattaaccatcagaaatcagaaactcaatacaaatgaaaaacaataaaaccccacagctcaaatacagaagaagacaacatgcaaatgcataaccaaaaaatcaatctatgccagtacaacactacttacataacacattcacaatgcaaaactctaaaacaaaaaaagaagatatcattcaacatatgaatcattagaaactaaaaccaagctaactagaaagcagagaataataagtgcaaaaagggagtgagttgaaaaagcaagggacctcttgaacagtgaacttttcatgcaagatgagtgccatagcaaagcttgccccaacaaggaaataatggcgaaaagtgtcgagttccctatcgtaacttctcccgaccatggggtgaaaacgcatacaccaaacaatggctaaggagctggcaatgaacaccaccttcatgaaggtgttgtaaacggagatgaagtccgtgaacagatccaaatagcgtgccacgaacacaatcgcgtagagctcttgagtcttgcgagaaatccctgaaaataaacagttccaatcaatcgatgaaatgatggaaaataaacatagggaattttgtttggcggaggaatgtgagtgacggaatgacactcgagaatgaaaatttggaaaatagagtaaaaaaatagccccaattttgggggaaccacgagaaaagagagagagagagagagaatggagtgaagagacctgagcatgatttggtggcgtagattttgaggaggaggacgagaatgctgagaagatgtgtcatatcaccggcgagcctgaagatgttcatggtttttgccctagcgagacacagagagaaaacgttacaaagggaacggagaaagaaacgaaatggaaaggaatcgaaaatggagtgtgtggattttattttttttgtttctcttatttatttttttggtcgttttggtaaaagcagaacagtataagcgtatgttcgtgtgccttccgtgaaaaggaagaagctgacggctgaggtgccactcgccctcgtctcaccgcttccttctttttttcttcttaaaattaatgaaactttaatgatttaatctcgcaataaaattaaaaataaatattaactcaattcattgtattttacaaatcatagtttaacaatttctttaatgtttaaatatgtcgtaactaagattggatagtttagatgttatttaaatttgaacatttgaaaataatttttttgttaaactttccttatttattgatcgtattctaattaaaattcattttcatttataaatcagaagattaagaaaaaaaaaccatagtttaataatcaaaatttcaatagataaattacactttatctaaaaaataattattaaacattttttcatgagtcaactacagagtcattcagatatttcatggcaatttccctctttcctttattgcttttgccccttttctttgtttctttcactctcggcactccaaccttcatttcgacaccaaatcaagaaggggagaaacaagcacttctattctggaactgatgctgccagaaaaacataagattccttcgatctgtgcacaaaaggtaatcatagtcaaatgatgcattgataatgtcctgctagttgaaactcaggaagaaaaaaaataatcatagtcaaatgatacattgatactgtcatgctagttgaaacttgggaagaaaaagagaagacaaaaaaaatgtgtagatatgattagatgatatgatgtaataagaaaagagataacagagaattgataagtgttgatagaaaatcttaaaacttcaatttactgttccgttttcctaatggattagtttctgataccgtgtttgttttcagtttcacatgaagactaaggaatatcatagagaaaaaaatgagcgctattgtttccattaccagaaagaaagtttgaggaatacccaattacccgacaactatgtctcatgtttcgcagcaattgcagaatggacgagtgccacaaaaggcgagatgggggcaaaagacgaatgtgaagagcctcaggagttactacttggtgcaaaaagtgttagtctgcctatccacataaagcaagcacgctctttgaatggttgtgaggtctctgaatccatgagctcaattttgaatcaaattatgatggctctggcgcaaccacatatcatcattctaggggtgtatggatcaagtaatgcgagaaagcgaacgtggtggagaaaatcaccaggagaattcggagggacaatctgtttgatgtggttgtgatggcaagtttgatgaaaaagccagacttcagaagaattcaagatgagcttgggaacatgctgggtctgcaactccatgagaagactctggagggaagagctacgcgtttgcgtgagaggataaagatggaggagaagatccttatcatccttgatgatctttgggtggaatcaacttgggtaggataggaattccgtttggaaatgatcacaaaggttgtaagattttgttagtagctgagagtcaagaagggttgtccaaccaaatgaatactcagatagaaatatccgtgtgagtcttcagaaatagaatggaaactagatttggaaggtcagagttatcaataaaaattttcaatggcaaggataaccatcccctttcttttaaattcccaagttgaaactctttctataatggtttatgcatcttatcttgaacacactcccttcttaattctgccttttcacatcattgactcaatctaatgtgttattatgatataaataaagtttgatggtgaacataacttattaaatataaaaaatgaacatagaggagataccgagaaattgtgcacggcaccccttataggattaaacacacttcgtacgctgggtggcacacgcatctcctattttgcaagttattttccttagaaatgaagctaataacatttcgtgcatcctgataagtcttctcacgcggcggtggcatacatagcaaatgaagtttgtggcattaattaatcagtacttttctctcaaatgtgaaatggtatatgccaccgcctgcagcttgtatataactcgtatttcctttaggccattggggtatatcagcttctgctattggtttcagacctttaattcttcaagcccttctataaacacaacttaatttgattcaatatagcctccccttaacttttaggacagttggtccttcacagcacacccaattaaggaagtagatattattattcaatgggggctgctcttgcaactgctaagaaattaaagaaacaaccttgtcatctcagtgacatgcacaacttggagtcccaagtagaggaactaagaaagagcaaaatgtcaattgcacctcttgcttgtttcttacatccacatcaagcaataatttccaattgttccaaggtctctggattgataaacacggctctggaagagaccatggaagctctagcaaatccaaatattaacatggttggggtgtatggatcaagcactttgcatacgaacaatttaattgaaaaaatttcaagaagagtaaagagagataacttgtttgatgtagctgtaatggcaagtgtcacaaaaaagccagacctgaagaggattcaaggagagctcgggaacaagttaggtttgcaatttggtgaggagactgtggttggaagagttaaacttctgtgtggaaggataaagaaagagcagagaatccttgtcatcctagatgatctttgtgctggaattgacttggataaagtaggaatcccatttggaattgacaataagggatgcaaaatactcttgttatcagggtctccagaggtattgttcaaccaaatgaacactgcgatgaattatttctcgtgaatctttcttctaagaataacacaactttttgcagagagatcagaagacaagagatattagtaaagtaatttaaacaactcagagtaaacaatatctcttttaattgaaagcatttttttttatctattcaagggtacctgaagctcagaaaccatagtgttgtgaagatgaattgtgaagactgaagaaactgtataagccataatagaatattataattaaagaacatggcttctatctggtttgtttatctcacagacagcaacaataaattgacttatgttttattgttccacagggagaagtgaggcatttattagttttcacattttggatgattaattgaaacaaatgataaaaaaaaaaggctttaatagtttatacagcttgcttaattgtgattgatttgatttcaaatcagcttacttgagtgataatagagtgtgtttcctttttctacactagtgtgcatcttttatcaactcacaaccaattgagatcttacttctctatcaactttatctgccttgatataccaccttaatcttcctaactgatggataaaagatatccccacaaaatacaaccgtaagttattttacaactaaaccttgtacctaattaccattcacttgacatctatgtaagcaccctctccataccaccttctacgcgccaaaacattctttgcaataacgacttccaattcatttgcaatttagcaacaaagcaagccttcaataaccaacaagaagatgaatcagtctcttgttctcactccttctacttgccccatttttctctttcactactttagctcagtcaccagctgcagctcctaaagcccctgcaaaacctgcccccgccacaccggctccagcacccacgaaaccattagtcccggcattacctcagtcaccctcttcaggtgttgattcttctagaagccaagaaattgtaaagatcctaaggaaggccaagtcattcaacacactaatccggttgctgaaaacaacccaaatcatcaaccaagttaacgcgcagcttgtgacctcgaaaaacggaggcttaaccattcttgcaccagatgatggtgccttttcagaactgaaaacagggtacttcaactccctgggagataagcaacaaaaagcattgatacagtatcatgttcttcctgtttatgtgtccagctccaagtttgatgctctgagcaaccctgtgttcacattggccagtgacagccccacagggtatcagttaaacgtgacagcatatggtaacagtgaaacatttcaactggggtgctgaatgccacactcacaggcattgtgtacactgataagacacttgccatatatcatgtggacaaggtgctcattcctttggatttctctaagccaaagcctatagctccagcatcagctgtggccaaggctcctaaagctgataaggacaactcttcagcagaagatgatgaccaggctcaggcaaccaaggacagctctgtatccgtcggtttgactagtactcatgagacaaccttggtgtcctttggagttgccaactctttcttttaaatccaaagaaatgtaagagtgaagattaattattgattgatacaaaaataataataggaaaagatcgatgagaagatgtgaactcattataagggttttttattttcctctctaaacgccgaccctttgtttgattgatgttgtctttctcttttatcatcatcattacctaataaaagcaaagttttcgatgataaattcagttattaaaaatattattttatcctttttcctaagtagggtaaaaaggaatcaaattgatcagtgtgtccaaaccaaaaccgctaaacaataacaatattatttaacagtctttagtctttattactattttatcgataacgtgacaaccatctattaaaatacaaacttgtatttcttaaatgataaagattaaaataaagatttttttttcatataaaaacaacgtactatcaaaagtcataaaaactaaaaaaataacattaaggattaaaattataaaataattaagattgcataaggattttttttagacagtacaaggactaaattagaaaaaaaaaattacaataactaaaagcataaaacggatgtattaatttataactacatttcaactttgtttaataaaggtagtttgacaaaaagaactttgttttagtttattttctcatttaattcttataattataaaaaatttcttttattgtccttatgcttaaaaacatcatcttgaattccttctaatcatctcagtaaaagtaaaaatacataggccggccagattatttgaaaggagtctactgtctaacctacctgagacatatgattgaacagaactttttaaaaaataaattagataaagacttttattaagaaaacagattcgcatacatatataagctagaatcgtacacttcacgtccaccagcataagtggttagttacgtgtatatttaatttttaatacatttcaatcaaccatagaatatatttaaaagaacatattagggcgttcctaccttttctcttccacttttaatccttgcctggcagtttcacgagtcaacaacacagtaatattttaacacttcctagcaatgttgcatagccagaggagcatttcccagaaacttggttcttttctttatttttgcttctataagctaggctttttctttgcatcttccactctcgtacttattaatccttcttttccactccactccgctccaaaccgaatagggagagaagcaagcacttcatatctataaaatcccggaactgatgaaatagcagcaagaaaaacataaggcatgtttgagtaaacattcatagaagaaactcactattttcttgtacgttaataatgcatgaaactgaacgcgaacaagcaaccatcacaagcatagcagtccgtcgccgtcgcggcaaagtgtaagaaacttttctttactgttctatttcactattagaaactaaatgggagctatatattgagagaaattaagtttcagaaacacccaattgcctgacagctatgactcatatttttcaggaaagtgaggatggatgatagtaatgaggtacaaatagcaataagggccaaattaggacgaataccctccaactgcgcgccctgcaattattttccaacttcggaggatccctatgaggaatcacttaacgcaggcgattgcaattctcctcgttgtgagtactcatttagtgcaggcaaatgcaatcagatttttccgtccgctaaatgcaccttaattgttgatgaaataataactgctctgaggcaaccaaatattaccatagttggactgtatggatcaagttatgcgagaaagcaccaagtggtgaagataatgaccaggagagttgagagggacgggctgtttgatgaggttgtgatggcaagcatgacgaaaaagccagacattaaaagaattcaaggagaatttgagaacaaactaggtctgtgcctccaagaaaaaactctcaagggaagagctacccgtttatgtgaaagtataaagacgaaggagaagatccttattgtcttggatgacctttggggcggaatcaactttggtgagataggaataccgtttggaaatgatcacaaaggttgtaaaattctgttagtagctgagaatcaacaagtgttgtccgacaaaatgaaaacccagaaagaatattctctggacgtgcccgtcaacgttggcctaataacgaggagtttaagttgaaactttctggatttattttatttagactttctcaccgaatttctctcataaggaaaaaaaaatggacactttggaatgtcattagacacctgatgatagaaaaaaatataaatattataagatttataatatgataaaaaaataaaaaaaaatattgataaagtgtttaatattgtagaatcctcatgtattactattattgtaaaaaagtttgtttttattaggattcagcgcagagtgcagttttctgcctgatatgtatttccgttgtgtgattaagtattgttagcttattttattaaatttatttcaacaaatttaataaattttaaatgtttttgcattaaatttttattaaataagttgttcatgtaggagaataccaaaaagagagggtggagcgttttagttcgaagccaaacatgtaatcatgaattttggtgagtcatgtaactcatttcctatttatacatgatgtctttgacaatatctttaacgtgttgaaatcttattagatacttttcgccacaccattgtggagcactggagcctatataagtctacgtagtatgtggtgcaagattgtgtgcgtctcacatgtcagtcaaaccctgtcaccacgtctttagggtattatttcgtattgtacctccaatcgcttcatcttctcggtcatggagtgagttaagcgtcattctgatgacccggtgtcattgaggcgagtcggttgttcgagagttcgttttgaatgatatcttgtggcatagatatacataaaaacaagtcatccctcctactagagtcagcatttctgggatattcatcctggatgatgatgtacataagtatttaatgaaaatatttaatcatatttgaacacaacaaaaatcatatttaatgaagatatttactcatcaataactttggaaaaaagaaaaagaaaactaaaacatcaataattttggttcaaaaagagcagaagagttatgcaaaaattagccaccacccgtgaggtatctaaaacatgggaaagggaatatctagtattccgaccaatgaacttgcccttcggtttcggttttcaaaatctggaatattaaattgcagaagcttacatgcaggtaatgtagtattaattttaaatccttgcctggcagtgacagcttcacgagttaacaactgaggcatctagatacttcctagcaatgctgtttaattagccaatgggtcatttcctggcaacttcttcactcttttgtttattggttttattgttttaagccttttttttatttgttcctctctagtgtcatcatatgtaaagcttcactcttttgtttattggttttattgttttaagcctttttttatttgttactctctagtgccataatatgtaaagctgtccatttggatatttaatgtaatgtaagaattgattttgaaatcattacttaaactaaaataatcttgtatcaattgatataggtgttcaataatttcatttttaattattcttcttagtatgattgactcgatcaatgtgttattatgatatagttaagttttatagcaatcataatatgttaaatataaaaagagaaatgttactaaaacattttttgacatactcttttgaacatattatcttttattgattgaaatttcttaaaaattacataagttagtgggtcttatatcatatttaataactctcttttatgattttgtaattttcaataaatttcaactaatgatagatgtatgtttaaaggaatgtgttaaaaagtatcttcctagccctcgtcttatataagaatgaacacaggagagaaaatgtgcccggtactcccatcatatacacacttcatatgtacagtagcgtgtgctctccaatttatatttgcatatattagagtgtgttagaatgttctatttcgccaacatttttcttttttaagtgcttcctaagcaatgaagccacctaacatttggcacttcctggcaagtcctcttacgcggatgtaacatacatagctcatgaagtttgtgaaaataattacccattatttttctctcaacctgcagcttcagcttgtataaaaatcattgggttatatctattggtttcagactttaattcttcaagcccttcgatctataaactaaacttaatttgtttcaatataacctccacttaacttatatgatagttggtgccggaggtaagggatttgatagaaaaagatttagtgttggatgtttgaagtcctataccaagagctatcaaatgtgagcataaagagaatcttagtaatataacaagttattggactccggtctatatagacccatataatcatgcatttaatttattagacttgtatgtgaatatattatttaaatatatattaaatatattcaaaagttggttcttcaaagcataccaaattagggaagcagatattaatattcaatgggggctgctcttgcaattgctaaaacttttaagaagcaaacatgtcctctcagtgacaagcacaacttggaatcccaattagaggaaccactcagcaatagcaaaatttggattgttttgtacctcttgcatgtttcttacctctaaagcaagcaataatttccaattgttatgatgtctccggattgataaactgggctctggaagacactatggaagctcttacaaatccaaaataacatggttggggtcatgggtttatggatcaaccagttcgtgcacaaacaatcgaattgaggtctagagtaatgagagataacttgcttgatcttactgtgatggcaattgttacagaaaagccagacctgaagcagatacagggagtgctagcttgggaacaagttaggtttaaatttggtgaggagattgtgaatggaagagctaaacttctgtgtgaaaggataaagaaacagaagacgatccttttcttcctagatgatctttcttctggaatttgatttggacagagtaggaatcccatttggaattgatcataagggtttcaaaatagttttgttctcggggtgtccaggggtattgttcaaccaaattaacactgcaatgaattatttcacgtgagtctttcttctaagcataactcaacttgtttgtatagagatcacaagacgagaaattagtaaaccaatttaagataacaaatagaaaacaatctctcttttaacatctctagatctttccctatgaatagcagcattttttgcatatgttctatttagttgaaacttgaaagcaaaataatctttttttcgcttgtatttatttcataagtacttgaagcttagaaaccacagtgttgtgttgatgaattgttaagaaggaagagagtatataaaccataatagaatattatgattaaggaacctggctttgatatggtttacttatctccctgactgctacaataaattgacttctgttatgattaattattcgacagagggaagtgaggcttttattagtttttccaacctggcttttttatgattaattaaacaaatgataaaaaaaaaaaataagggtttaacagttactacagcttgcttaactgtgattgatttgatttcacatctgcttacccgaatgataatagagggcgcttcctttttctgcactactgtgcatctttcatcagctcagcacaagcacaaccaattgagatctcttttctcattcaattttccctgcatttcaagcaaaaggacaaacaacacagcagccaaatccacttctcaatcaactttatctgcatcgatataccaccttaatattcctaacagatggagaaatggtatccccacaaaatacaaccatatgttattttacaactaaacctttgtacctaatcaccattcacttggcgactatataagcaccctcctccattccagcttccacacatcaaaacattctttgcaatagcaacttccaattcattttcaatttagcggcagccttcaattaccaacaagaatatgaagcaaactctcttcttctcactccttctactctccactattttctcaatcaccactttagctcagtcaccagctgcagcccctaaagccccagcaaaacctgcccctgccactctggctccagcgccggcaaaacctttagtgccttcattaccccagtctccatcttcaggagttgactcttctggaagccaagacattgtgaagatcctaaggaaggccaagtcattcaacactctaatccggttgctgaaaacaacccaaatcatcaaccaagtgaatgcacagcttgtgacctcgaaaaacggaggcttaaccatccttgcaccagatgatggagcattttcagaactgaaagcagggtacttcaactccctgggagaccggcaacaaaaggcactgattcagtatcatgttcttcccgtttatgtgtccagctccaactttgatgctctgagcaaccctgtgctcacattggccagtgacagcccgacagggtatcagttaaacgtgacagcatatggtaacagtgtaaacatttcaactggggtggtgaatgccacgctcacaggcattgtgtacactgataagacacttgccatatatcatgtggacaaggtgctcattcctttggacttctctaagcctaagcctatagctccagcaccagctgtggctaaagctcctaaagctgataaggacaacgcttcagcagaagatgatgaccaggctcaggcagccaaggacagttctggtgccatgagtttggttagtactcatgggacaaccttggtgtcctttggagttgcacttcttgcagcagcagctacaatgtcgtgttgaagaacatccatttctccagagtttctaatatgttttgaggacaagcacgcaactgttgtggagttctgtttttgttgttttcttcttgacctgtgtattgagtagcaaaagtggtgtttgtgagttatgtgaacctttgttctgttcttgttttgtcatcaagcgaaaaaatatgtgattgttttattgtcaaagataaaaggaatatctgcttgtttttgcttagttttgtgctgttcagttatatgcaccgctcggaatcatcttccactccctcgtctatgagttgcatagatcaatattcttacactaggaaatatgtataactatctaataataatcataaagatgtataagtacattttacaagacaaaatccgttgacactaaacgtaaaagctttaaaaacttgtgtctttactaagttttaataaatgtgatatataagaaccatcaaagaattatgccacaaaaactagtcgctagagtctgagagagtttaagtacttgtgaattttatgttagaattccacactttaaatacgagactaatatctttcagtacagcagaatatagtttactcaaaaaattattaaatgtgtaaatttgctaagtcttaaacgtggttaataaattatcacttacaatttagataaagttcatgagattatttatgttttgacaataataaaaattattttttaaaataaactaaaataaggtataaccgcaaacttaaagaaattaatacttaaaataattatcatgataactcaccaaagaaaaaccattagcaaacatttcaaaatgttttatcatttaatactattggatctttaaaaaaatttaaaatgttagttacgcatcacttttcttttacatttattaaagatgtctccattatctttatttatctattatgtgatttgtcattttaaggcttttcacttgatggctcagaaaaagttgacaataaaccttttcttatagtaagttggcaataaactaaacttcctgaatcgctttagttgtctataatgttggacgcgtagcattcattttttatataaaaataaactatgttaaataatcaatacaagtaatgtagcattaaatagtattaggaaaattgcttctcccaattaaaagcaccattgctatatatgtgaagaaggatagacccaaatttgttaagggaaaaaaattatctttataagtaattgaaggtgcacttatacagttatacacatcctcaaaaactttaattcattataagtctttagatcttaggtgcacttattcagttatacacatactcaaaaatatgtgataataaacttactatcctcggaaattattaataaaatttgttttatgaataatatattctccaaactaaccatttatattgttttgggatgatataatcaaatggagagatataggtagtatgacataattcaggtatatgattaggccctccatccttacctaaatctctctcagacaacgccacttaagatttctaccatattgggtttttgttccccctagcggctagctacttgatggaacttctaaacctattatacagactcatcgtcccctttccacctatattttatctcatgcatccaactgattgcaacaatgatgtgaaagcaaaattaatagttcccttgcacgtacactttaacataccatgggttcaaaaatatcccctccccctcaccagttataaatcacactatatatgatgcaccacctttccgtgacaagcaaaggagatttgttctttacaactaggtatacctttccaactaaaccattgcaccttccaatcattgatatcacattcaattcccttccaccctccaaaatatataaaaggcaactccttctcccacttctctcacaccccagcactccaaaataagcagtatagtagtcttaaaaaaaaacatcccacacactatcattcaccctagccaaaaccctagaaatgaggatcatgcaagaatctcaatctttcattattcccaccacaattctactactagcactatgctacaccacttcagcccaactttcaccaattcaaccccccacaacatcaccatcaccaccactatcccaaccctccccgccgtctccggcactccaatcccctccggcaaccgcgccggcgccagggatcaacactgttcctcttgtcccagtaaccccaagtggggcccccgcacccaccaccatcatccctaagggccccaccattgacatagtccaaatcctaagaaaagccaaaaggttctcagtcctcactcgccttctcaaaaccacacaactcataaaccaactcaactcacagctcgtaacttcaagctcaggagggttaaccctatttgcacccgaagacagtgccttctccaaactcaaagcagggttcctcaactctctcactgatagacagaaggtggagctcttacagttccacactctctcttccgtcatttccatctcaaactttgataccctcaccaacccggttcagacgcaggccggtgatgaccctcagaggctgcaacttaacgtcaccacttacggcggcagccaggtcagcatggccaccggcgccgtcaacgcctccgtcaccggaaccgtttactccgacaataagttggccatataccaggtggacaaggtgcttctccctcttgacctagtgcttcccagcaaggcgccggcaccggcaccggcgttggcgaaaaagggtttgccgaaggctgataaagggaattccacggcggcagacgatggcgttgttggcggcgacgatgacagcgacgggaaggccttgccggtgggtgtttctgcagggtgtacgatgaagtcggtgaataacgttgttgttgttggagtggtgggtttggtgggtggagttttgatataaggtgagtgggcatgaataaagggattccataatttttgttgtgattttgtgagtaatatatgtattgattccatcgtgcttaattggggttctggtttgtggtagagggtagggtgaaaatgtatgcatgcatgcatgacaagctgggtttcttttactatgtttcttcttcttttgttttgataagtggtgatttgtgttaatggatttctggctttgtaaccggatttataaaagaaaaagttctgtgtatatatacttttgcttttcaaaatgagtattaattaattgacgatgatttattaatttgctgctgaagagtaattaacgacatgttcgtagttatgattgtctgatatgatgtaataactaattggatgcatggtgcatgaatttcttctttagaggaggtcgaggatcacaaattttatacttctaccaattatataacagatatgattaatgatttacaaagtacataggatttcattgcagtttataattgactcagtgatcacatattatttaacactagctaaggttaactctaaaattaatagaatgaaataaaaagaaacatgatatgcaagaaatgaaagagttacattttcatagagtactgaatgattatttgttctgtttttttattcatcttctttttttagaaacaggttaatttgaatcttaactaattcaaaactaataaggttatttaaagaaatataaaaaatatatgataattaatagaatgaaataacaaagaaacattatatgcatgaatctaaaaagcaaaaaaaaaaaaaagaaggttaatttgaatcttaactaattcaaaacaaataaggttatttaaagaaatatagaaaatatgataaggagaaatacttaagatttgaagtaaattgaattccttatcacttaaattcacatttgttagttacatagcttacgagttaaacattagaataatttttgtaccagaaaaagttatagctagtatgatttatatgttaatcaatagtttacataaaagtataccctaccacaagaatatatatatatatatatatatatatatatatatataaacatgaactaatataagcatccatcattattctatttttaagttaacactcctactttatatatcaacctaacacgcaaatattaatggatatatataaaacgtgtaaaatttaaatttaaaatatttaataaaaataataaaaatattattgtttcattgataataaaaataaatttcaatagagaatacatggtatatatagtaagtttttggaatttttttatttttaagaaaagcttaataattaatttgattaataaatatgtttttagttgtcatttataaatttcttgttatattaatgttaatgaaagaaatttgagtgtcaattttaaaatagtaaaaactcacaaggttcataagacacgttacaaagaaagaaatatatgcatgtataactatataaactaaaattgaaaatacatacatggttttacgataattttaaaattaaaaacgaattctatgtggaaatcgatatttttaatttttttgaattatatatataaaatgataaaaacttgaaacggacaagcaaaatttatgaactttgggctttcggcctacgagctagtccaaaatatatcttgacttgatcaatttattgtttggtagctcaattacatttaatgttttattttgtccacaaaacacatgtcctcaacttcattacttgctaatacgattttttcctttacttattataacattattacagaggatttagcaattttgctggtgaataatatctataaaaaaactaactatttttagtgaaatatctcttctcttttttatttattacataattttacttggaaagaaaattaaaactgtagagtgtgcaatcatagggtactcataacaattgaagcgtaatatgtttaaaatatgtgtaaactaaaaattaatgttatctttatatattattataaattataattttttatcgtcttttatatacgcatttcaaaaatattataaaaaaactagttgtaatttttttcgattattttttttattgtgggagcagttttagtaaaaattaaagagtacctttgaagtaagtacttttgtcggggggagtaattaaagagtacttttttaaaaaatactactacataaattcatttttaaaaaaaatacttactgtgattgcacttagtcgctttcttacttacatataattactttattagtagtactgtagaagatcatgcagcaagctatatagatttaattatataaaagattttttagttgccacatttcaatttcttacatctacatatctgtcaaaaacacatttgaaatcttaaactcagccacaccacacaccactgttctgttaagagaacaaaaggctttggtccaaaagtcatctgcatttttcagtcacggaagaggcaattaatgcatgtgctacctagctttaaacaactccttccatcttaattcttagcggtcaaataatagaaacacattaatggagaggataggttactggttagagattattatttgaaaaaaaaaaaaacatgtaaaagtagtactactgtgttttaaaagcccgtttgaaaattaaagtgccttagccctgggtgcgtatttgaaagggtgactttatgtggctcttcatcaattcattctgaggagcaacaaatgttatattgttgactggccctacttaattaattactacgtaagaaacaaattaagcagaggaaaagtctaagagatcttccaacatttcccactaattggcaagcaaattaagatagaaatgcacatttcacatgcatgcccatctagtgtatgttcatataatcatgtatggttacggttctaagaaattatgataaaaatgcaaaaccaaagttgaagtgggtgtttgattctgccttgcatcttaatttcgtatgtacgttttaggtacgataccaaacatacacgaaatgagaacatgaatttaatattgtaaaacatttttaccatttaaacaatatcaatagatgatatatccatgtcatttgccgtaggacatagatgtatctatttttaaataacaataaagtcaaaggaggtgtattaatagttaaatacctcttttcctcatttaaggtttttatttttcttggcattatttttctgttcatgttagagagtttactctgatatattcataattttttaaagttactaatacttattgaaattaataaatttatcttttactaaattcattttctttaatataatattaaaataaaaataaatttaacaatgttttttttctttagaactggatgcgtatttaggttaaaagtttccttttaatagtgacttaatgcacattttatctaatttttaagagaaatatgttttcttataattttaaataataatttgagtgtgtgcttagttgatttttttaataaaaaaatcaatttgtaacatgatttttttatactaaaaattaaatatttctttaaagaaacgtgagacatgcactaaaaaaaattatacttaaaataattagcttaatcaaaattattctttttttaccaagtctttattattaattgttttgaaaaaggacatcacaccctcctttactttgcaaatgaaggtcaaaacccaaacaacctgcattaaacctaaccccttgggagatacccaattcacattataataacaataaaaatatataaacactcttttattttatacatcctctcaataactctcatctatatttttattatatcataattctaataaaagattttttctcattttcttctcttttgccatgtatatcatgggatgttaaacaaacatttttctttcatattatacccactaggccctatttcacaacaaactctgaccactcctcagtctcagggccatgtcttatcaagaaccccaaaactatactgcagaatctaattttcaatttccaaccaaaccctgcttatttttcagactaaaagtaaaaaaaaaaaaaaaaaaccccgaacccttcaggcttcatcctggtgtccctatgatcgtcatcttccttcttcttttacaagttacagcaaagttaaacaattaaaagaaacaaataattaaatgggccataataatctgaatacaaaatatactccataatcatccgtcaaactaataaggaaggtcattttctggacggctgcattgaatggaatttcctagatagagaaaatgagggaaaaaaatttaattatttatcacccgaaaacaaaagtctttggaaattcagtccctctgttcccacttcccaccttttctcattcgtacgcggttcggccgaaattattagcataacttaatccaatcctaacttcatctcttcttgttttcttcacttgctaattttatacccttcaaattttccacagccaaactgtttcatagtatgccaccaccgtttccacacccatatctctcggccttcgaaatttctctcctttccttcggggaactgctcagttcctgaaaccatcatctgggtaacacaagttttttgaaaacaaaaaagaataatctcagatggcttcggcggctatattctcgtcgctgcggcggcgccggtcgccgtcgctggaggcgtttctggtgccggtcgacttctccgacgtggcgctgctggagactcttatctccatcgccggcgacgtagcgtcctgcttctccggccaccggttccccttccagcgccggaactcgcgtgccctcatcggaaaagttgagattttccggtcaatgttggagtgtctgaaagactccgccggccccggagctcttcccccgacggcggtgctgtgcttaaaggagttctatctgcttctataccgctcaaagattcttcttgattactgtgcccaatcgagcaagttgtggctgctgcttcagaaccattgtgtttctggtcacttccatgatttgagccaagaattttcgacccttttggatgtttttccttttggggaagttggcatcagtgatgatgttagggaacagattgacttgttgcagagacagtccaaaagggctaagttgttcatagataagaaagatgatgttcttaggataaggttcttttggtttcttgaagagtttgagagtgggagggttcccgattctaaggacttgaggtgtttctttgtggataaactgaggattcttgatgctaagagttgtagggtggagattgaagccttggaggagcagattgtgaaccatgagggtgatgttgagcctacggttcctgtgcttaatgggatggtggctatcacaaggtattgcaggtttttgttgtttgggtttgaggaagagttggaagttgagattcaaaagaaggggaggaagaggttgattgctcaggaaattgctgaaacgtttttgactgttcctaaggacttttgttgtccgatatcattggatttgatgtgtgatcctgtgataatttccactggtcaaacttatgataggtggtctatacggaggtggatggaggaagggcattgtacttgtccaaaaacggggcaattgctttcgcataataggcttgttcctaatcgcgctcttaggaatttgattatgcagtggtgcagtgcacatggagtaccctatgatccacctgagggggttgatgcatctgttgagatgtttgtatcagcttgtccctccaaagcttccctcgaagctaaccgagggacgaccacgcttctcattcagcagcttgcggatgggtcacaagctgcacagactgtggctgctagggagataagattgttggccaaaactggaaaggaaaaccgtgccttcattgcgcaagccggggcaattcctcatcttaggaacttgctttcctcacctaatgctgttgcacaggagaattctgtgacggcactgctcaacctatccatttttgaaagaaataaaagcatgatcatggaggaggaagggtgtttaggatcaatagttgaggtgttgcgatttgggcatacaactgaggcaagggagaatgctgctgcaacattgttcagcctctctgctgtccatgattataagaaaagaattgcggataatgtgggagctgttgaagcactggcttggttgttgcaagaggggactcaaagaggaaagaaggatgctgtcacagcattgtttaatctctccactcacactgagaattgtttgagaatgatagaggcaggggcggtgaaagctatggttgtggctttgaggaatgaaggagttgctgaggaagcagctggtgccttggccttgattgttcggcagcctgttggcgccatggcggtggtgagggaggaagcagcagtagccggattgataggaatgatgcgttgtggaacgcctagaggtaaagagaatgcagttgcagcattgttggagctctgcaggagtggaggtgcagctgcaactgaaagagtggttagggcaccggctttggccggattgcttcaaaccttgctctttacaggtacaaagagggcaagaagaaaggcagcttcacttgctagagtgtttcagagatgcgaaaatgcatctctacattatggtggattaggtgtaggttatgtatttgctagcgattcagcttcaaccaggaatactacaacctttgtgagtgatgtttcacttccaatgtccatttctgttcctgttttatagttgtttgttgtgttcccgatttttgttgtaactctatcgattctttcattgaaatttaaagtcatcaagtataggaataccagatatgtattctaaggacttagagaatgatgcgttgttgaacagttagcttcaacccatttgtaatcagttattgcgagaaagaatataaagtgttctaaattggaattattagaccacctcaggcgttttatttcttctgtgctttactcctcccgttggcaatttattggatttttaagagtaatgctacttttttatatgtatgattcatgctccatttaactcatacaatttaaacttgttttgttaaatttacatggagtcaaaatgtgtgctattgtgctcaatttgttccttgaataaacagcatttttcttttctattttattagagtaacgatacattttggatataaaaacttgcattttcccaatgagggctactggttggttttttttaatttttaggtcattgatatgtcaactttcttgttaataaagttttttatttgagcatggaaaaggtgtcacaaaatttaaactgatttaaaccgcgggaaagtgtttaaacgttaagatagtttagtttgttataactttatttatctagttgtgaggtgtaatctttgcataaagcggggtagaataaattctctttgttctcatgttttcagtcatcaaatttgtagttttcacttcagataccgtttgttgtgtctaagatttcaatgtgagttagcctcaagcgtgttgcatgcacgattattccgtgttaacattttcagctaattaattctggcccgtgaagtatatgaatgttctattctattatttggacgctatgatgtcactaacttttctgcctaacgtgttagaacgaatgtggatcacacaatagatgctctttcatcttgactcttcctttctttgttccattcctatgtgctaggaaaaaaaacagacatcaatatgtctcgtcataatgggtaggtatcttaaaatattcttaagcatatgatatgaagatagtgagaaaaaagctaaggcaattcaaagatgagtgctatttttggagattaaagtaattgcttgcttccattgagcggtggaggatgatgggcctaacatattattctttggcatagtggcacgtatgaaatgacatgaggggtcgccaaaggaggcgcaatttgatttgttttgattagattattagattattgtcattggttgatggcagcataataatagcaatctaatgtttctttattatatatatgacaataaaaagaatatgaagataaattgaaatattgaatgttccattgaaaaaagaaaatagatggaggttgaaagttttacaagggtgtaaattacccggggattcaataacaatctaaaatgtatgaaaaaaattattaatttttaaaataattttttaaaaataatttaaatagtaatttgtgattagatgataatataatataattttatattattagtgtattaatgttaaactcttaaagtccatcaagtatgataaatttaataattattttaaaataatttaaacgacaattcataattagatgagataacacaattttatactttcttatactttctatatatttagattaaactcttaaaagataaattaagtaacaagatgttatttagtatggaatatagaaacatgaaattcacaagaatcaaaaatataatgcccgaggatagtctcaccattggagggaatagttgggaaaaaaaatctaatatcaatagaacatgtgtttgtacacttttgcatacataaatttcatccgttacatcattagtctcatcatgtgtagtatttaatattaaattttatccgttacttcattattctcatcatgtgtagtatttaatatttagtccaatttattttaggcttttcttaaaaaaagaagaaattgggttaaacaagatataaaagcttttctagaaattagctttatgagttttttacttctattcaaatttcaagatttaatgataatataatatactaaagaaattttatgttaaaaaattatggagtaattaaataattataatttttatctttaatttaaatttaaaataagttttaatctctaaaaaggttagaccaaacaatatttggtttcttttagttttactttctattcccacaccttcgaattccttctaagttcacttaattttgacaacaaaagaagggaaaaaaaaacaattttgtgatttttgataattatacgtttctttcttcagttgaagggatccaatcctcgaattatgtttcaaaatggtccaaaaagcccaaaaaataatgattgttatgataagttgtttctatcattcttaatgcaatgatcaaagccactcttgaccgcactattccaagctgttttcattaacctctcttgagaaaggaaaattgcaagtactacacgcacattcatgcttcgttgcttgggtcaattccattacatgaatattcttcatagtggaggcacacagagtgcacacatttaaaaaaataattaattggaggttttgtgagacacttttgttttgagacatggtggtagtcgagcttatcttgtttgatatgatgcgattgaattgttaacgatgacaataacactatatgattctcaattgcttcgttccaatccatccaccatatattttcagcccaagaagtggcacaagttattgtcttgggttctcattgttttctccatttgattgttgtgtaagatttttttatttttacagtgaattgtcactaatattgccccttattgacttgatgtattaagcttaagacctaatggacagagtgttgtgtcgttaggtttctagttaatagaccgtgacaagagagtttgttaagacttagaactaggtgtctatataagctacggttttatttattcattgaaaaacgcaccacaactagaggaacataggacaagacttaataaaagatttgtctggtcattagaaacgttttttcccctcatgtaataatgataaaagtgtcgtgttattttattgtaactcctattttcataaactaattttatgggtaaaaaattgaacctttatgcctaatttgatacactgatccatttgtatctttaattttttcaattttcctatacattaaaccctttcgcatttttaaaactaaaataatttatcggtccttgaaatttctacaataaaattaatttccatacattaacagtcccgttcaattcaaaaaacaagagagaaataaaattcccaaccaatcaataatttcaaacaatcaattgaacaagttaacaagattgagagaagaaaaaaaaaatacttttgagtgaacaacaaggacgaatgtcaatgcctaagtagaccagatccaacgatcccctccctcaacctcaagaagcttcggtgattccacctaactcaagttgggccaatgggtgtccagcacaaacctaggaaaacgaaaaaaaaaatctgacccataggcctacaggatgagaagtcagcccattaggaaaacacaaaggaaattatttctcacaccttccatttgcttcctgcacttattccggaatgtaatttttacactcctaaaagatctttctcgaatgtaattttacaatcgagattaggagttccaaaatcttaaaataggtgcaggaagaaacattggaggtataggaagcagccaaaacaaaacctgagcaaagattggtgttcaattactattgatcttgttttcaattagttagatgctcaagagaataaaaatttcaaatggaagcataactgtaatatgtcccctacatgcatattgattgggtttcggtaattcgaattacaatgtataatatcacaactacaaatgtgaaattaaggtgaaactaagtttgagtgtttttttgtttttataaaaaaaatagaaaataagagtgaaaatatatttgtttaaaatttaggaaacattttctctgaaaatattttcaaaaataaacttaaaattgaaaacaataaatcaatattttcaatcttttttgaaaaagttaaaatgcagtggcatcttagagtattttttttctctatacatgttttctaaatcttgaaaatttgaaaatgaagatgaaaaataaaaacagaaaataaacacacaaaccaagcatcacataaactgacttgactagcaaagacgtagcttaaaatagcaatggttttaaaaaaaatattgctaaatcaagaggaatatattcacatggaagtgacaataaatagatcctttgctaggagatataagatagattgaatagttaaaaaagagaagaaaagaaaaaagatcatgaattatatcccttttacttaataatttacaactaatatttaccgataaaaaaatagacccctttactatgtttaatcatataattgggaaggggtgcaaagagaggcttcccttcttaagcaacaaaaccggtagaggtaattggacttataagtcttcctattcaaatgattagttgaaacataattattgagaaattcagttaaacaaagaaaaaggagttgcaattttcttcctttataatattgtaataatacccctttttctcttgcagtatcaaatgcatacatggcatttcatgcaataatatggaaatgatgaaaggattctttctcaattcaagttaataaaaaatgcctagatcacgtcagaatgaaaaagaagaatggaatttattgtcgagttgaaggatttattgtgtaagcgtgaaaacgaaataacttgaaaaaaaattgtgtccaaaattattttatgtacgtagttcgtggtttgggccatctatcaaaatcggcaaccgaagaatcaatttgatgacctcttttgttgacaaaatagaacacaaccaatttagaatttcataactaaccgattatttatctaccctatggcttttttggtcttataccttgcttggaaatgaaggttcccctgttgaccctaagaaccttatttcttgtgttggaccttaatagctcatacatcataatttggaggagacaatcagaatcacatgatataataactgctatgacaagggaccattttctaaaatggtagatattgtgtcaagtttcttttgcataatcacatcaatttttcttctaaaatacttcatatgtaatgctggcacagaagctcacagaggatcaacattatccttgataattgttgaagagggagcccacgccctttgaattgtcattgtttatctacttttgatatgcgtgatttgagtagaacaatatgatcaaaactgtgtatttttcattagaaaattagaagtaaataaagtaaagataaaaagtgtaaatttaaatacaagtaaaaaaaaagtcgctacaaggcatatttttgtgcaactcaatcaataacacttagttacattatgactttttttaatacaaagaatgataaaatacgaagacactcaattactagcagaagttcactcaaaatattattgcagaaagataaatagcaagaagttttacccaatgtttatgatcaatgttatataaatcaaactaaaagttaaaaagaaaattgctttttagtacggcattttcataagaatgctcacggatgacttcataaagtactgcagagtctgcaaattgccttttattttctctctcatgtatggttaacgcattcaaatgattggcaaatttttagaaatattaaaataaggaagtgtgtatttttcttcaaaatataaaattttgatacaggtatatatgactttagtaaaatgagaggatgcatttatccaccttcaattacatagatttataggtctatgttcctattaatattgtaattgtgtaacttatttctttataggtcagtcaaatagattgtactttcatggatgataacatggaatttgacatgagcataataggtttgttgacatgatttaatattacttttgattcatgcatcatgagtgtgataccaaagagattaaaagtgtaattaactcacgtcatgtgttaagtaatatatcatcgatcagggtcggttctgggcccattcaaggggctcaaccgcacaggactccaaaaaataaggggtttcaaatattaattattgtaatatatgttcaatactgaaaactagaggaaatagtaatgtccctgtcatcgatacaatattatctaaagtcatgtcaaaataatttattaaatatttaaccataaattaacaagaaagccaaaataccattataatagctagaagatctaatttgcacgattaagatttaggggattaaaatcacaatgagacccgactaataatatgaaggaggtgattgaggaacaagtatcgaaaacacaatatttatgattgagtaaggtgcaaaatttgacaaaaatatcacattttggtcgcctatgaaaggatcattttacacgcctacacagacaggactaaatttggagcaccccaaccgtcaaacattctgcttaatcgtagtagtagtagtgtatgctactaacatgtgtgccagtatgtcacaatagtaatgtccaatgagtctttgaccgagaagaaaaagtggagaaaactgcaaataaataaagccaggaaagaaaaagatgagaaaaggattttgctagccagaatcataagaggaaacactcccagtccatcacaatccaaaaagaaactgttttattctttagtcttccaccttttactaatagtgaaaaacaaagttaatattcaaatgaactgcaacatttacattcagctaagtaggaagtaactgctgtacaaaatgacatttactggtctataattctagttcttattgttacaataaagttacagacaacatcttgtataatgttaagtgtccttcaaataaaagctcatacaatgacaatgtacccggttcataataacatataagcaacctaatttctggttaactgcttctattacggtgtatgtgtgggcctaaaaaggtggtccaccccttggcgcaaatcttttttttgtgtacaaaccaaaaagcatgaaaagtggcaaaagtggtcacaggaattggggcgggtatctcttttgaaaacatagcagaaaaaaaccagtaagaaacccacgttcctatttaacagcctaaccgtcccactaactgctagaactctctcaactctcactatgcacttcacttctgctctttatcttctctgaagattaataaacccttcaccaccaaatcaagagagtttcaaacaccaaaacaacaagagcagattatgaagtggggtggaaaaaagccttctccttcttcttcttcttctaggccttcttctttcatatctcatgtatctcctttttcatggctttccaagttcaagcagatgagaatcaactcagagccaaaacctggcacactgaagcagaattctactccatctgattatacttcaacccattatgctaatataaatagaggcaggttttatggaggggatgatgatgaagctttctggagactctcatttggagaagagggtggtaacgagcataggaaaagtgaagatattctgaaaccagtaaagtacaatttggatgctgaacatgccattccatcctcaagtttccccactggaataaataatgctaaaaggcaaggtagtagaaaagaaggcactcagaagatgaagcagaaggacactactggactgagagaagaaacaaaattgttgaatgaagcatcaaagagtataaaggaagttgaatccttaaggagaagatatgagaggaaagcacaaagagttttgcaagagcagctcttgaaattggaaaaggcagaagatgaagctgagtttgcatcaagtccattcttaggaaatgatctgctgcaatttgagtcaccaagaacaattcgcacaccaagaaagcatttttttgtagattcaaagagttctggccttggaagtctcggagaatctcgtgtgtgtagtcctcaattgggttctgagtggcaaagtttgaaacaaactgaggggttgaaattgaaaccaaagggtaaccaacaaaggcaatctcttcatgtgagcagagaaaaccagaggaggaaaccaaagcacaactccaaggttagagtatattctccaaggatgggttccaaggtcgaagtccgcaaaataaaggccatggaagagaagaagaaagcaaaacagaagatgaagaaagaagaggaaattgtggaggaaacagaagaagggttagatagctttgctgtggtgaaatgttctttggatccacagaaagatttcagagattcaatgattgagatgatcacagagaaacagatcagcgagccagaagaaatggaagatctgttagcgtgctatctgactttgaattctaaggagtaccatgatctcatcatccaagtgttcaagcaagtatggttgtgtatgagccaagccagttcgggtattcaatcagacaagcaatgttgctgttgtgattaacaacataaatgtttggcttgtaggaaaacattggcagaaattgtaaatagttaatcttgttctagttgtgctttattagctttgcttgaatttctttattctcttcacatcttttgtataaaattcaagagaagttgcatcaagatcccaacgaaattcatactttataataataataattataactactagtaagagttctttgtgcatgtatacctatataataccaagttgtttacactcaaaacatgattatcttgttggggttaggattcttgtaagcttgtagcattatgttcattctttagcaatatttttaatataggctctagggaaagaagtctgaagcactgatgagaggtgaaacttgttgaggaaataaggaatctaaaattccaaatggtaaaaatttccaaaaatagagaatgcacctataatacacataagacattgctgctttgcatatcagcatggtcctagacattcacatcagtataatacccataagacattgcccatgccggtggaagaaccggggttaaatgaatgaaagggaaaggaaactattcttcaatccttgtgatcagtatttgacaccaacagatacctttagcatgcatcttattctggcaatacaaataaaataccctaagaatgtgacaaatactaatattctcttatgctcagtgatttgtctgcatccttaaaaatacatggctttaagattagttaggcttaaatttataacttaaaaattaaattctgatatggtaatagattaaaatgttgtgctttttagttaatgagttgaatatgttaaaaggtaaatctggggttctttaacaaatgaacttgaacttttgattcatttagtttttatttattatttattcataaactaaacaagtttgatgagcaggtttcactcattgtaagccctacacaacaaacggcctacttaaataaattagcgtgcctccctttgaagacacccgacacacttcattgaagcctctatgacatttcaaaaaacatatcttagtgactgacccattcttcataaagttgataagctcttgtagcattgatgaaaatgtcatctaagagaaaaatgttagttttactaataaagcttcttataaattctccaactttcataagtgtcagcaggcatgttgggaggcacattaggtgaggccatcaaatggagtcatcgagtgagtgaaaaaatttaagagtttgtgagatatatttatcacaaaggtaccctttctgatcatctatgttagggataaataaattatacaacctagctacaatgcaaatactatatatttctattattataatctacatctacagtatggggaaattattaggagaccgaagtgtatatcccaacaccttaatttgatgactattctttctattgtgtaaagacccattacctaattactttcaagtggggcatttatgccacatctacacaataccaaattagttaataacatcacaataagtcccaagtttgtatataagatcaaagcaattcttaaagtcaactcggtggttacttgggatacctataaaaaagcacaagcaataaagttaacctacctgctaggggctcataaattggtcattcgactttaatcatgctgctgcaggtaggctttacatgatcaaattaattttttcatttattatttcggcatcgatcattctatatatgcatgtccatattaataactgaacataaataaaactatctagatgtagaattcaatagattttaaactaatcaactaataaagcattaaagttttatcttctaacatctatttcatgaatattggtcactcagagcgttgactagccatccgaaaacacggaaatttttctttgaataaaggcataaaactcatctagaactatagttagactgcggaaaaaggatggaatcaaatcgtactaagttcaattatttggattgttaaaaaagaagataaaatacatccttcctccaattcagatatcgatgatactggaatcatctatttcaatatagaatattcaaataataaaatagtgaagttattttatttcatattattgcactgcatttttcttctataccctattccattctattttaaatttatcattgtatacccaaacttataaactatatttttattgtccatcgtgttttgaagagagtaaaggaagttgtgtctatacttaaattttagtaggctagccttaaacgattacagtcttatcaatcaattcatttaaaaataaattaaatagccctaaagtgaatttgtttttaaagcaagcaaataaaggtttatttattctaaatttttaatatgttgaaatcacaatttattttaattaaatcagttatacatacatttttattaattgactttacagataaaagttttccaaaaaaaatcccttctctagctaggggaatatatatgttcgacacacaattgacatgcttttccacacaacatctgcatacaaacaaatcattaaccagcagttataagtcagagaaaactagtttcaaagtatagtattatatttccaaacattacattcttagaaatattatgtatataaaatattgaaaaaatagaagtagaagaatgaaatgaagacatgtggttactgtattagttgttagttttttaatactcacaacttctctctttcctcttcttaattgtgtataaaataactttcattctcataaaaatacaatatacatatctttttaccataaaaataagaagacaaatatgaatatttatatttttgataatcaacaatacctaaacatattatttttcaaaacttgtaccatgagaatataataattccaagtcccctcattggaaatatttcttttgcaccactccttttccctttcattcaaacttctttctccctctttctttcatatctctcgattagaaaaatgaaagttttatacattatggaaattaaattacttagctaaacaagaaatttgatacacgagattatgagaatatagaattgcttttttaaaatgaaatattttgaaaataaaataaattgaattgaactaattaaaatgtaatgtcatatatcttaaattcattaaaatttcaaaaatcctttgttctaagactactttaaatatttaggtgaaatataacaaatatgatattattaaaatataacgtctttcaacttgaaaaataaaattattttgagacaaattaaaatatttaaaagaatatatgatataactgaactggttgcttctttgtaaatgtcccacgtagcaaacaaaataattatcgtttagagtcaggtgaagtgttttaaatgtacttgttttattttattttattttattgagacaatgtcattcacaatagaccggctagaccaagtgggtcgcatgctacaatccacaagcattccctatagtctccatataagatcagtgtgctttcattttagtggttcaccatgtacatatggaagaaagagtaactgataattacatgaaattgtgaggaacaaataaatcattattaacattatgtacaaaaagaatatttaaactgtaccaaaaaaaagatcatgattaacatttagaaaaaaaaattatcttagacatttacattacagcacactgtatacaaacgcaagtatacaagagaagaagtgaagtgatcttggttttttaaaattctatccaaaatagctaaggttgttttccttctcatgataagaaaatcttttctgcgccgccatttgcccactgctcacaggatgaataatttttaatttaacctttgatgatatgaacctaagaaaacaaaaaggaaagaaagaaatcaccattgcaaacagctctcctgagtcatttgaatgattttcattatgacataaatgacaaaaatatatttcattttctatttttatttttaattacaaaaatatcactttatctcttgttttttaaatatttatataagaaacaataaaaaaaaaagtaaattataatagcatcccctcaagtttacttgaaattaaacataatatccctccttttttatgcttacactaaatttaatttgttttaaacattatattaacacctcttacgcattacattaatttttttaattatttgaaaaatactgcaccttatacttctataatgggttgttataatggtaaaaaaggggtgtgtgtaatttaaaaaaactccaagatgtaatttcaagaaatctcagtaagtcttgctataatttactctaaatataataaaaaattattttcattgttttttatatgaatttcaaaaaatggaaaacaaagtaacattttataactaagaataaaataaaaaaaatattttcttccaaagtcataggttcttatatactttttcttatggccgctaccgctagctattgctacttgtagccgctaaaaggtacttgcagaataacaagtggcagaaagaaatttattaacaagtagacaaaaattaaatgcaaattttaaagagatataaattgtgattgcaaagaaaatgtttaaaaaatcttaaatgttttcaaaagaaaaataaaacttactgcatagaaaaacatttgtaagttaccaacttagatcatgttttagaagatattttaggtagtttttgatttttcttttattaactaaaaaatttgtttgattatttgataaataagttattttagtagtttttatcattttttgaaacactactttaaataatatttttaaaacgctaacttttgatatttttttcatttttattctcaacacatttattcaattttttattatcttttttaaataaatcatgattttattatttttatgttattttatatcagctatttcaacaattaattttattaaacaattataatttaataagttaattttcagctattagctcccagcaagtttttcaactaattttatcgaatataaccttaatttcttttatcattgatacaagtccaaattatatttatgtatttcctttcaaaagtaattacatgcaatggaatcccttaacaataaggtttttggaattggaaagaatcattctccatgagattcttagttacattatttataacttttttgttcatagacaaaattaattcaaaattattttccattccaaaacataacttatttccaaacacttcatatttaactagaattcgctcccaaaaatataacccttccccttcatgaaatcccacaagcctcttatccattctcaatcattattcaatcataacatacatacaaataaaactttttagattagatttaaggatgatcagactacaacttataacttccaccacgtcatgttcattcataatttaaaagggaccaccccctaatttgaaagggcaaataaaagatagttccatggcatgtaataggcaaaaacatatcaaatcagtccgtggcatttcatgtgcctcttgctcgttaattatatgttgaacatgaagcagtccaatcaaatgaagagttacatagtatattaaacagcaatacaaattatggatttaatttgaatgagccatcaaagtaatataataaattttgtcacaacatttaattagtttgacctatcatgtatgcatttaattcatgaggtgacaacacaacatcaaataaattataaaactttattaaacaaagagtacaccaaaatttaaaaacacaaaccaaataaaattattgtaatatacaatttttaaaacaattgtttttatttatgtagttattttcttaaaattacaaaaaattataattattactcaaatatttttcttcaaaaaaaattgaataacaattattttagtttttatatttaactaataatatacattaaatttacatgacaaaattatcacaagacaatgtgttgaatacaaattttatatgttagtacagatgttatatttatcatatatgtatattgttattatatatatatatatatattatgatattcaacatatattataataatacaaagagacaaaagaaaaactatcttaccatattttctaactcagctcactctcaagataaaaacaaatactagacacaacaaataactaattgcaacaagggaaatacgaaatataacgttggttgggttgtaaaaggagaacgaaggaaaggagggagaaccaacagatccttaacaaatgtttaatttaaactccttacctgaaagtaccaatgcaaaccataattttgatattaaacgaaggatgaataactaaatccagcagccagtggtaaaattaaaggtatttaacagttcatccgcattacaccagagaatcaaagccccgtggcttacaagttacaaaataccatttcaccagatattgcatggacaaattaaagtcaaaaagcacctttatcttagctggtttctgctaggatttccacttgattagtaagtcaaacttggtggttctccccctccccccgagaaaagcaagaaaagctttgccaagttaggatcaattagaaaatttgctttctaacaaatggcatagcaagttagcaaccaaatataatgtggtatgcatcgactttctattctttgcttcagcattagatattatatataatgtggcctaattgcatcgacaagacgcatctcataatgttcgctactcagtaacaacagaaagatgaaatccataaactctaacgcaatcaatatttatcgaaaaggactatttgtgtaacttttccactcaactgaaaacatcaaactgaaccctgatagactgtcactgataggcaccttgtcctcaataaattgcttaccattcaagaatatatgccatatacgagtgacaacttatgatcctgctggtttgatcaaatatttagttttcatttcttatttttataaacaattacaaaaatactactttgttttcacttcatttcctactatcaaagatttgtataagaaatggtgaaaacaattgttttcaacaccatttttgtcaaatctatgaaaacaagaaacaaaatgacaaggcataatttttataattttttttaaacaaataaaaacaacaaataaaaggttttctcaatccaaacaaatcctaaataaaagctaatttctaactcataatcttagttagccaaatcaaactcaaaatgaccacaagtaactggactggcataattgtttgttgggacttgggagtggttttattaattatactagaactcagcttaaacttaacataatagttgattgtagtatatctgccagagaaacccccctttttgacattaaaagtatgataggttgacaaaaatgaacagctctggccaaacaggaaaggatatatttttcaatatcacaatacatcctcccaccaccctacccagctccctaccttttagccttcgaacacgagttcaacacccaagtatatactagaagttcattttccatcataggttctgttcaatccaaggtattttcccttcatcagtttgatgattgtacactagtttaacattacccttctagaatttcttcccatgaaccttgtagtcctctgcttaggctcacacactttgtgcagtttctggctactacaatactatagttgaattgacaagatgtaaatccctacaaaaaattattcagtgaacaaaattgaagtagaagtactatattgcatttcccaaatgggaaatcctagtttccacttcaaatgctatgtatcaataaattcaagaaaacaacagtctattccattccaggtcagtaagacatactattggtgttcttagtttcaaattatggacgacattattgtggttgcggtaatgtccacaacagcaacagaaccaccctgcaactacaggacaatttccatacaaaaaatggaggcaaaccaacaaccaaaagatggaaacagagggtatcagttggcagcttctgccatatggtacaagtaacatccagaagggatcaaaggaaaacagaacaaatgtcgactggagataaccataccaaggttctaaattgaggttatgatcacagtcacggttgcggttgtagtgcagtacagaagctgcatgatatggtccataatttaaaagcttgaaccaaacgacagttctgtacaaggcataatagaactctagaagagacaaaagagcggcatacttaactaatgaatcaatgagggatgcaacattcattccacccaaaatatggaatatgtatctattgtagagaaaaatcagaaaactgtgcatacatatatttattacatgtgattgtagaacagtacaagcaagaagaataatcaattgctactatgttttctctgcttgaccaacatgccccatctgttctgaaagattatttgcattccgtttgttccaccaaaatttgttaaggtcgctgggttttccttcattctttctgccatcatattcctttctttctgactgcacttcctgtgtttctgatgcaccaggatcctctgtcaagaactgctcccagaatacatcattaacaccagttactgcaacagtggttcccgcaggttgttcttttgatgcaacaggctcagaaacagcagctgtagttggctcagaattcatgtcaattccaggtgacttatgctgaacttcaacatctaattgcgcacaagatatagatggactatcagcataacttgtagattcatcaaaatccatgtttgactgaatttggacgaaggtgccaccaatatcatgtacaatagcctcccaaaacgccatggatgattcaagctgatccagtcgctccacgtttaatgtcaagacagtgatattgtctgcattttctcttggtaacatttgggaagtttccatagcatcttcaacactagcttcatcataaaagtggccacttctcggcaaccttcgttttctatccatggtttctgtcagaggcaagatatttacagaaatcacaggtttctgcaatacatgagaaacagaagaaaccatcctttgttgattctgttccaacttttccaactgatcttttgagcaatgtatttgtatctcatatgcctgccactcatgctgatatttctgtaattccacgaggagttgctctttatcgtgtttaagtttctctatttcatcagtaaaactctgcctttctgcctcccctagtgggccttgtgcttggagattctgcaaagaatggctatgaaccggcttccgtctatggatgttcttcataagatgaggttgccctctaacaaaatcatcattggcaaattcccattgttctgggtcaacttttctaaatccctgctcaagtaaagatgctaccactaagtttaagaaactaaaagcagaatggggcaacacataaacaacacaaaacaagtagtattcacatcaacaagaccaagatcaaatttgcttacatatgtgttcagctgcctgatgaaacttgagaagttgttgtgcttaaagaatctaggcagcaaatccctggcaaattcagggggattccatacaatgaaactcttgctagagacactccacgaaacaaccgaatccgtggaaggatcatccaccatctcataagtctttgcaaggaaagggggcagggaacttgaactaccctgtgtatcatccatcactcgaaccaaacctcaatcaaacctactccaaaatctcaacctccccaattcaaaactcaaacaccaatcaatttccaaactttcaaaagaagtcaacccttaattcccaccacgatattcggcagaacatcccacaaaaaaagaaactttttttctttccaaatctgacctagacaaaaccccaaaacaaaaatttcccacttacagcaaaattaataatagaacaatcatttcaaaaccccatttgcctaaggagagcaaccctaaacccatgaaatcaacaaaatcacaaggcagaaaaagttttcagctttctctcctctcttacctcaaatacctaaacaagcaacgtttacgctgaaacaaatctcacagaatcatgggttgaatttccccaaaaatgttaacgtaggattcttctttccctggacgggaaaaattggagaagcttgcacgtaaagcaacaataattattaattaaaaataaaaatggcagttacgttattgaagctttgcacctgaaaaaggaaagcgaagagtgaaagctgagaaatcgcagagagggaaaaagagtttttttcttcagtttctgggtgattccatatttccaattgttggaatcctttcttcaattttccagttttgttattggggtcaacgcgtggttgatttggaaaggaggggggtggtaccataggaataggattttggaatgaaaataaaagtaaagaattgctattggtggtgtatataaaaattaaaagcaaatttaatactatgagaattagaatgaacgacgatataaaaaaaaaaaagaattagaatgaatgatcttaacattttacattattatgaggtattgagctttaaataagtgagatattaactaaatggaaaaagaaacttaaagatacttttaatattattatttaattaaaataaaagttttagttcaataactaatattgatgattctcttttatttactatatattattgaagtaaaaatttaattctaacaatgaagtgcatcaaaagatgtttttatctaaattttattctattaaactttataattattatatgtagggataaatataaaattttcaaacatgagaatggtcattccttaggggaccttgaaaatgatctacaattaaaattgacatttattctaacaacaataatatttggatgccttttaaataagaattaagaattgtcgaaatttaataaagacttaatttttataacatgcaattaaaatttaataatatagaaattaaaattttattatatacaaaaaataatcattggacaaacgtttactgataaaaaaaaaaaaaaaacctctcataaaaacttgagtgtgtgttacaggacttttgtaacctcccaaaaaaagcagggctttaattatctataacaatttataaataatcactaaaagcaataaaaaaagaaacataatcaattacaaacaacagcttccatgaatgcttttagtaactcaatggtctctgcctatctggttcaccaaatgctgctcccttccattgtgccattaatccattaatccattatgatatcgttcacataaatgagcaaacgaagctttatggaaaggttcgcttcaatcgatacaatccaagtgcgagtctcaggaagcaaaatattgatacagcacatgtgaatatagtttttttgtcttttttgggtagcatgttaatatagtatgaaaacgtgtagataccaacaaaatacaaaataaaggggaattttccttccctctagtccctagatggaagaagatatatataatcatattttagttttgaatataataagataaaaagaagcattctgaaccattcaaaagaaaatataggttatctggaccacaaaaaggaaataaagaaaatggtgtgtgaaatgggcttgcttaaaaactacactccagataagaacattgattattagcaaacagtttcccatacccgtctctatcttgtcgttaattggttattttatttattaatcgattgttactttgcttgagatggttatttcgggagatgatgatgtaagaattaactagatctatagtctatattaacctaatggaggggtccattctaacaaaacagtagcacggactgaagccacatccatgaagcaatcgatcaccaatatataagtgagataacgtattcaagcacgcaaaaggtggaagagttatggttaactgttcattttagacttttggtgatagttgattgtaactaactgaccaaataatgtttgtttgttattgaggataaaaacgttcagtctagaaaaacttccactgaagagctaaaactatatgctcaaagagtaggacttgatatacaagcataaatgaaatcttcactttacttatcagatcgtgtggaggttcacaataatgattaatgacatgttgatctcagtcataccaccaacaccaagaacttgacttctatcttaaatcataaatgattccctttgagccaagtcgccattccagttctttctagtcaaacccattggctaaatgacccttgcaatagaatcctcaacaaagtaactagatccttttagacgttttgcttggtcacatacatagacatatggattgttatatgtggcacaggtatgcaggacaaaacttttcctaatatgtggtaaacttagtcggttcattatttgggatcaaaatttgcttaggaatcgatttctatgcatagactccaataattgaagaggctcattttagaaaactagtcatggcctataattatgtttaagtatattttctgatgctagagtatcccgtatggccaactttttccttctccaagacattgattacatcccatatcactcattcaccctcaggaaaatagccaccgtttgagtgaaaaccttttgcccacactgcactatcgccttccaacataggtacaagtgtagaactgaaactggtatcatccatacttcagtatcttcatacagtggagaatcattatggaaatactttccaagctttccaagagaacttaaatgttccatctcatctttagttactctagatttagtaacatgatccctttctatcaccacccacgccatcaatcagtcaatggcatcaaagcaccacatatcagtaaatgaaaattcaagatgtttgaagtcacaaaaacaccatccactaaaaacacatcatcaaaatcgtgagagaaaaaaatccagtttaccaaacacaaacaaatgtatgtatatctaccaaaggagggttcgaacggagatatataatgttggtgggtggtagctgttgagtcatttacaaacataccaagtcattaagtagtatttaataaataagagttatcgtttctacgaagacttgcacaatacttagtaaatatcaaaagtttttactatttaaactaacaaataaactatgatgatttgaacataatatttaacaataaagataaaacagaacaaaactacaaattatgatatttttgggattttcgacaaacacatattaaaacgatatgaatttcagatcacaaaggttatcagggttagatatcatcgaaccaaactctctttacgctaaaacatgatattcaacttgtaatccaacgttaatatcgaccacaatttaaaaacagtattctaatccctaatttcttaggtgaaaaaacttaagtttctctcttaaatgtcaatcatttgaacaattaacaaaagaacttgctttaagctcaatgacttaaagataaccattatccctcatcatattcctagctttgaggtttaatggccattttatcacagttcaaaataaagaaagtattttctaatagtaatctcatccaagaatcaagctatgagtgaccaaaaacaagaaaaaatggaggaacaatggaagaaaagagttggggaagaataaatttttaaatgaagtgtttttacaaaatgatgaagcgtgccctaaaataaacgagataatctatttatacatttccaaaaaatctacacttaaatgagtgtttaaacaattaatgtagttatacaattctacacatctgtctaaatttagcttaaaccaaaagttatttttatgaagttaatttttttttaactttcttttttatcttctacaaaaaagaattttgatttatctcctcgaatccaaacttaagcacatttgagctaaaattttcactttcagctttcattaaatcttgctccaaaaaattgtaatttgatccaattcaaaatcctacaaaatgatctattaataaagcatgtgaaatctaacaaaataacaaattaaaaagaacaaactataacttaacaatttatatataaaaaacataaataaagtcctaaaaataagaaagagatgaaataattatctaaatttatatgtctcaagttaaatatttttggcaattattatagtcataagagaaactagaaaaccctttaggataaattttctgctacttggacgtgttccttaaaatctgaattgttaccatccattaaaacaaacaagcaccaaattttaccatttaaattttaagctgtatccaagtgtctctctgtacacagtatcaacataaagatcagccaaaacagtcagaaaaatcacctttgcaaatagctaactaactttctgataaaattcaaattaatgtcagaagaacaaaactttcataatcaaaacggaaagggtctctatttaggtgccttcatgtcaagcagcgaatcttcaactttccaccctggccacatattatccggtttctgtactatataattattgttatatagtcatcataccttgataagacgggtaaactaatgtttggagtagacttacaaaccaaatattatgcaaaattaaattataaaattttacaaattaaatttctgaagaatcttactataatggagtatatttcaaaataactttttctgctattaaaatattaagtgaattttagaaattagtaatctgcactaaattttataaatataataaattaaagcaatccaaacgtgaccaaactccatgtaattttaatattctaagatccccacatgacctgacccagtcacgttgcagccacccccgagtttcaatcattcaaacaaatattgtctttccaacatccttttcctacatctgaaggtccactttccaatatcagctttggttctgttgtaagtaagaaactgaggtggtttagcattaacaaccactttgaaagctgcaatcttttttgaggtttgcatcatccaaaaatggtgttgaagtgcaaggcagagttccttgtcctcttggtccttgttgtgtgccaaccctcttgtgggttgggggaggattggtctactaggagactcagtaggcataataataagatgatttctccaagctgtggagagttggtgttgaagtcacagtgctcagagaactcaaaatgcaggtggtgcaccagtgaggaccttgatgacatgtgcttctctaaatctgaggcattgagattgcctcaccaggttttctcttgtgccttcatcccctgagatctattctctcttggatctcaggatctgtgttgcctaccctacactaaccaattttcaaggactacttttattttttgttgtgtttatgtcttgttttttgtgtttttaggtatgacttgatagagggtggcgttgttgttgtatattcagtttatgatttacttcaaatttgagacatggttagggtatatagttgaagatagagaggaaatcgccacattctatccttttgcttcattatctgttgcgaaagcctcattcaaatagctgaatagttcatctcagttcatttacatgccttttgggggcagctcagctaacaatgtaaaagcttcaataaaaacagccaaaaaaattatcatatgtttcatttttcatcttaaattggatgataacatgaacactttagtcccctcccccattgctttgtttttctagctactagaagattacttagccgattttcattattataagaaatacttggtgccattagaaaacctgtttacaaaacaaactccctgataatgttgttctttttggccagaaaagaatttttttttaatgctaatttaacgttttggcttggcttatcaatattgaaggaaactgctgtctcctctgttaataatgctgatggtgcttggtagaattgaaaataggagttctggttttaatgctattttaactcttagatatctaataagataacatcaagatataatgcacaaatgacaagcgcaggaaattccaggtttctggtttcataatagtttaatttgactttgattatcttaacttttatccaggttcatggtgataaacaaagttaagatctcttaaaatgttaatttgttcaaagtcaaacaaagagatcttaattgtcttcctggtagcacaaggaagaaaattaacatctcttaaaatgttaagtcttccctgctacattgaaatttttgcttataaaaaaaaaaaaaaaaaaagtcttccctgctatatttgctctcttacctctgtatgtgatttaaatgtttaaattcattagtcaataagtaagtttagctttgatagctgttaacttatttaattatttgaagccattcatgaaaattcccatgttatttgaaactgcaaactttatcaaatgtttgagctgaaacaattactgacatgtttacactaaacttgtttaatgttcaattcaactcatttgttttaataaatattcaaatttaactttgactttgatctttataatctaaatgagtcacgccgcccaatttatagccttgaaattaaaagtctataaataactcgcatgtgcatatatagaatgttacaaaaaaattgtaatttcatatagatatgtttagttaattgtagttttatcttaaatttttatcattttttaatctttatgtctaaatatttttctattctctttctccttttatctttatgaaaatgtttattaaatacttatttaagaaagggattttttatgtacatatatagacgggaaaattgaaactaaaatcttatataaactacctaaatctttctaccgctaatctgaacctggtgataaagggattgttaattgtgtgtttatgaatccccaatagaaaatctaattaataaacttaacaaaaaaaacactctaagaagtaagaatatagttaatatataaaaatagtcatattctaaaaggattgagtaaattaaacgtaaactttgtatattcttaacaaataaattttatattttaaatttcactcgttttaaatgtataaatcaaacttaattatcattttttttcaatcaaactaactagtgtcagctttttttagttgtcttcttataaaaaaactaagaaaagatatccatatcaataagaaacgggccaaaaaagggcccagagaacaatttaaggagtggcccagcagcatacaatcgcttagcgatattttcttcctccagccagcatatttctcttactgtgggtgtatgaagaaatatgatgaatgcagaaagaaaatccctccttagaataggatcataagcactttaatcatttgggccttagattcttataagagcttatagcctcaacagatcatacgcactacatcccaatttacgcaaacacgtaaactttagaaaaaccttaagaaaaagtgaaataagaagactttctagcagaggaaacaaataccatgataagcaacacaaattacactagaagttaattattattttcaaatcagtgtaacttacttttgtgggctccacaaagataatttaaggacgttaatcgaaaaccttgacctgaaatgaatggagttacacttattgaaaccaccccaaacaatcatttaatcaaaagtgacatataagagcaactttaatgcaagatcttgagtaaagatcttgagtttaagatctggtcttcattagatctcccaataaaggaggtagagagatctccaacatggagaatgggttcttgtagaagaacccgtaagatctgcatattgttcaaaaaagaataaatttttttcctctttctctctccctaagatctcaaaataagatctaccattaaagaacaaaataggagggatcttgagaggtccccaatcctacatggtactatagggtctaccaaaaagtggtctaagatctcaatttgagatctaccactaaagatgctctgagaagctattggaattgaattaatagtgaaaattttaaacagtttatactaaatcaaacttcattgtcgttattaaaaaagcatgacgtgtataagtcattgtctgccacccaaatattaaatttattaaaagttatccacatgtttcaagtttcaacttataaaagatcatctctttacgaatccattgagaaactctttccaaaatgatactgttcagattagtgacgcgttattcctgtcatgttgtaaaggaattggtggggtcaacccttttttttcagtcaatttaattttaactttaaatttagtgcatttagtgtaaaaacaattatattacggcgtatcatctaacgatatgtataacattaattaatacattacagttggcatattattaaatttattgagtaatgtaaaaatgtactattaaagcagtaaaaaaatgttctattaaaagtgtaatttttgtaattcattaaaattaaacactttaacttgttgttcttgcaaacattttttttttcatttcatgatagaaccatagaagaagacttcaacatgaccataatgagatccccgatggtagttacgtgtaaaaactctcacactctagttagtgagagaacgagggaatgtaaaaaatgagattagattcatatttgatgggttagaaacccttatagaacaattgtttaagtagaaagttagtgaatcaacttgataaggttaacgccaataaattaatctaatttctaaaatatcataaatgagtttcttaatatatatatatatatatataatttcataaaagcataaaaaacttaaagatgaaaataaaattaactcgatacaaatgtgtacttcaatcactttttcagaagtcttattgatgataaaatttttgagagttcttgtataaaaatggttctctaggctactagacatttcatttctcttcaacggggagaactaaacaaaaataaattcttgtttataagaactcgataaaaactttgtttttggagatggactcaatagccaatgacatcaaacattttaggcatttttgtcatttgcttacattttttttcaggttgtgttcttttttttattattattaaatttagctagatgtttaattaatagtgtcaagatggtagatcttgggctttagcttcacgtgttaaccaaaaagaatttaattgaaaaaagaataattaacaagtgtatttaacatactagttaaaaaaatgtcaataaaaacatctaatatttattttaagtgattaaaatattaaatttaatttaataattagatgtttgttaatcacttgataagacccatgttttaaaagcaatggagtatttaacatgaacagtttggcaaataagggaaatggtgaaaacaaaatcaatatatataacataaaatcggacaaggtcaaaatatgcttggtgttgaccatgtgctcagtagtgggaggttggaaattttttgcatgcgcattcaattaattccttttgcgtcaatgcttggactcgttgctaatttgctattgatgaactggttagaaaagaaaagaagcaggatttaatttttactatagcattcttgtatacttattaaatggaaaagtattgaatatttttttatatacttaagacattaatgcgcatttatttaatttctatcaaattctttgtttagaaaatattgagggaattgataaaaatatatagcagtattaatttttcatctcatacttctgcttcttttttttttttttactgaattacatacttctgctatttatttttatataactaaagtataaatattaatgaactgcataatgatggcttgacaaagtacttaaatattctccagcttagggatcttttttttcatttttgtctttttgagaagatcaatatgcaaattctcgcgaatattattatatatatcatcatttatgcaagaggacgtatatatatatatttacatatgttttttcaattattaaaatgttcagttttggaaaaccttgctactatgatctcttttcttttctcatagccttggacagttggactactatcatccacctcgggtaaactaactggttgacatttgaatttctagtttgcctcgtttggtaaaaatattggttctcatttttgttattcaataatttcgtaaaatataatgccttactcatttgcgtggtgtgataatatctaccaaacttataaacttatttttaactattttttttatttaaatgagagaataaaaaaaattcacaattataattttaataaattatattatatataaagacataatatttggttattttgttgtaccttctttaagagtttggtgatatattgttttcgaaagcaacagattttggggtaattatatagtttttttgtgtgtgatatttttacttcttaaaaataatatattataatttaattaaataaacatatatttttaaaatttgaaattatttacttttcatttttaattaatttttaaataacattgttttgaaaaaataattaatcattttataattttaaacatttaactgaaaaatattagaatttcattataaaattaaaaataaaaagtaaataataataatagtaaaggaagaattctaatgaaataatgacgattaaatgagaaaaaaaaataagttaggaatagacatattttatattatactttctataaattttattattgatattgtacacacacaaaatttatctattccagaccatagaagacggtttttcataaattatttgatttaattcacaaaaaaatatgagtaattttttattatatcaatttaaagttaaaaaataaattcagataacattattaaaaattaaaagtaaaggtaaatcataacaaaaacatagaaagtacaatcaacctagtaatcttttatagcagatatcgatcctcatagtggataaatcgaattacaaatagccaagtacgttgctatgacagaaatgtgagatcagcctaatgctaattcctaggggtaatgtgaacggagtttatttttttgggtgcatgatgtgaactgaatcctttgacaaacctaagcgtcttcgttggtttttaaaatataagttttatcaagaatttattttcctgaaacaatgtgtaaagcttttgataaatttgtttctcaaaaaatttaaattttagtttccaaataaaaaaagtataataaattcatctatcaattaacttttattcgctattgttaataaaagaatttaagtaacacactcattaacaaatttttcagctctatatatatttagagacaaaaatgattatttaatcaaaatataatttaatttttctcacattttaatcattataaacataaaattataataaatacttaaaaaacaaaaaaataaatataaatttaaacaatatgataataaatataatattaattaataaatataatctatttattctccttcaatttctaatttcacattactcttagtaagtgttatctaaagttgaatgtctataaattatttttcttgtgctatttatcattctctagttttgtgttggaatatttgtctcgaatagtccctgctcacaaaagtacaaaattgatggttacatatataatactactataatagtataattaataggtgctcacaatttccagtagttcctgcttgagtatcaaactttgtaatgatacctggatagcaaaatgatgtctgaatttaatcgccaattaaatacaattaaaaaggtgtccctagattttatcaatattaagatgccctatattaattaatcaaccaagcagatttaagacgacgaagaaattttacgtacccagatctttctgctgctccgtcagaactgaatatatctgctaagaggatcacagtccaaatcctacttactaaaataccgcatctgtttaaagaattgtctgagaagttaacattaaaaaaagaaaaaaaatattgtgcgacatttattttattcgagttaattcttattttgatcctcaaattttgagatatcgtcataaactcataatagttcttgaaattaaaaatggtaaataattttttaaaaattggatcatggagtgtgaaaactaaaggattacaagaggaattataaatgcacatggagtgtgaaaactaaaaatgatatggagataaaaaaaaaaaaaacgtcattttatgtattgaattttttggttcaaaatgttttcaattttttataagattttttcagcaataaataactacatatatgattaacacaaaattaaattattttcctgattgaacttgtttctcgttgatcatgattttaaagcattaaatagtgaacatttaataatatgatgaaatatatgttgagataattagtatcgttatgatggtactcaagacaaaccttccatattttggtcttaaataaataaataaataattactctttaaaaaaaaaaaattataagttcggtcaaatatttattgtatgtttaaaaataattcaattataaaacatcgttttataaaattctctataaaatatataatcaaatttttagataaattaattccaaaatatatttaatgtgtatttggttgttgttatttaaaaataattattttttatacaatatgaaacattactacagaatattgtcatttattaataagaaaaaatagataaattattatgagtaactccgttaatatatttgttatcaagcaaattaaactgttagcataaacattttaattttatactaaaattgtcattcaacctaaagttttttctaaactttatcatgatcaactttcataaagcaaaagacccattttgctaaagtttctatattagagttcaccaacacctataattctattcatggaacaaaagcagtccatactatttatttcaacttcttttttttttggaaaattttattttattttataaaaaaattaatgtaatttttttttgttggaaaagcaagttaatgtaaattgtatctcattgtgttagctcatgttattaggcaatacttttttgttaccatattattgttacataatattaataaatttggtgtaattataaatagaaatagagaaaatattagaaaagctcaaaataagtagacagcctttccgttttatcaaagttgttgtaaccgcgtggcacccaaaactcaaaagaaaaggaaacgatcgatactatctgaagacctattctgctattcacgattctattgtataatcgagtgggtagttggttcagccttcaatgcatttttagaggcatattaactaaccacttcatatgctcaataagccattttgaacattgattaatatcaacagccataaggctgatccaaatgataatcgatcactccccttacttggtatttgtattgtcaactactcgtgaacttaacaagaaattaaaaaaattaacattaaaagtatcatcaagatctaaatataattgatagatagttgtaatttctttaaacactttaaaaagtattcgattctttgattgtgtgtataaaaaaaatatattaagagaagtaaaattcactttcactatctttatattttgaatatcttatttccagaaaaaagtaaaactaaccttaagttggtatgattggaactaaatttatattatttaaataaaatctaatgtttgaattttgtcaacatgaaaaaaatagttggaaaaatatgggagtacttttattagtatatatcagtaactaatattaattaaaatatcatcttataagagatgaaaatataaaaggaaattaatgtcttatatatatataaataacaattttataaataaagtaattttgtatttttctcttataacatcataaaaaccaatagcataccataagatacaaaaccaattaataatcctaatatcttcaaaactacacaagccccaaagaggttcatttgtcttctatcctgatataagtccaaggtctgtgccttttttcacctctatattctttcccttttatttggaatatctgcatatagtatattcctctttggctaatgtcataactacttaaactatcttctgaaccatcgaccaaatattttaaaaagataattaaaataaataaatgcatttagcttaaaatatttaaagagattagtttttattcatcattattgtaaaaaaaatgataccatcaaatactcaaaaccctcttatatataacttttaaataatcattataaaaattaacaaatttattgtacataataatatgtaattagattagtttaaactgtgaaatgtattctaattaaatttgtattcagaacataagaatttaatttgcataaaattttagtgtaattttttttataatatcaacatcaaattatgttaaatattacttttaaaatagttattataaaaactaaggaaattataatacacggcgatcatatagtataaaaaacattgtatcgagctttaaaaaaacattgtattctaatttggatttaattcaaaatacaaaaatatctaataattaattaagagtgcaattagaaagattggttataagaatataaaactattccgcctccttgtgaacaactttttggttgtctataaattggagttgtttgccaagtgtttcatttgtagttgagtagacggagcagagtgtccagggcagtttacaaagccaaattttgttccttagttgtttccttgttctctgtcactgatggctgattattcagcagaaactgaatatcgcgaggtagttgtaaatgtaaccaaggacacctccaaaaccacggaatactcagactcctttgtctctgttcctttcttgcagaaggtgtctcctaatcttccttttgtaccccaaaaaccattaaaagtgctcttattacaatttaatagatataatggattgctatctctgctagaatctgctttccttttttgtgtgtgtatatttagtttctttctgaattaatctatttattatattaataagggtggttgagcaggaaatatgatatttcctttagtgttatgtagagttcaagtagcaggtggggtgtctactttgttgggattccgtatgctattttgagactcctgcatgccacctcttttgattacaaaaaatgtgattcaacagaatgcgtgaattgttgtatatatacttgtcttcgattttcttacagataaaaaaagaattattgaactagaagaattgagagtggaaatgacaatatcatggttttgtttgttgatggatacagttggtagctgaggtggtgggaacatatttcttgatatttgcagggtgtggttcagtggtggtgaataagaacaacgacaacgtggtaacacttcctgggatagcaattgcttgggggctggttgtaacagtgttggtttacactgttggtcacatctctggtgcccatttcaatcctgctgtcaccattgcttttgcttccaccagaaggttccccttgatgcaggtaattgacccttataacctttttcttaacttggttgatctataaataggtaaatgtgcccatttggaatattgtcattttccttcttaaattgttatctccagcaaccccacaaggaagatggatgtctttaaagcccaattatgttagaactgaaattatgagatgccataccatataccaaaaatctaaattatgaaagtaactcctaacttcatgatcgttgccaaaacaaagttgcctctttgcacatgcatataaagctagctaagatatttcatattcacaggaaaaaaaattctactatgaagttgttttaaaattatgtgttcgggcatgtgatttaaattgcaattaattactgttgttaattatgtaggtaccagcttatgtagcagctcaactcataggaagcacacttgcaagtggaactctgaaactattatttatggggaagcatgaccagttttcaggaacactcccaaatgggactaacctgcaagcttttgtgtttgaattcataatcacctttctccttatgtttgtcatatccggggttgccaccgataacagagcggtaacgtctctcacattactccctctgcttaaatttgtacatagtagtactttcttatgagatttgggcaccttattgataaagtttgttaaaccagagacaatactaattcatactttatttattaactaaattacactcaatctggttggactcaatgaaaaattttacatgtacgccctttttttctaaacactcatttgacacattcactcaaaggggttagatcatctgttatcaagctgataaataaggtggagagtgtgcacaggggtattcttgagtgagaggtttctgacttgaatcctggtgaaaaaacaaactttggaaatgggatgaataattgatacaagcccttacatgattacctctaagaaagaaaacctgtggacaacatctaaataaaattcatttaacacattttatctctttatttttcttattattacatcacatctctttttacattaattatttctctattttttttatctccctataatgggcatatgggttgcaccaaatattaccctaatcaaataatttttttaatccagagacaatatattaatccatagcttacttataatattggaaattataattaaaaaaagtaaataaacgaatttaaacatgatataatatttaatgttgtttagttcatacaataaatatctttttttacggaaaacaaatatcctaaactaatggcctgtagtgttttttttttctttctaaaggtttcaaaccaatttgactggtttttttgacggtgctttgaaccgttgttttgagtcatgtaaattgaatacttaattggatcgttcatttttttagtgacacgaagaaatggagagaggcatggcaacactgaggttaatggttgacctttcatgatgatattttcgaacataaaaaacttacactcttcttatactaattttaatagtaaaataatgtaaattttttaaaattgttcttacgtaacttcttttctacataatgattcgacaaaaaatgcacaatctaagtcggctaaacgtatatttaggtctaaaatgaaatttaagatgattttttttaaattactttaaatacatttttaaaattagtattatacccatttttatttataagactacctaaattaaaaatgatatttgttcttttttggtttattgcataccctttttttaaaatttttgcctaattttatctcaacaaattaatctgacatattttatcctaactttttagaaacttgagaattttatcttccatcattttattcctaacataactacactttttacttccttttttttgacaaattttacacctaatttttttatttttgacaaattttattccaaatttgggcaaattttacttccaacttttggtttataattcgataaatgatgaaagataaaattcataagtttcttaaaatttgaaaataaaatacatcaaattaattttttggataaaattcataagttaaaatgttgggactaaaagaatacaattaagccaatttttttataagatccaatccataattacctgtattaattatttttaggctaaaatatccctaattaaaaaagagagaaattgtatagataaacattcagaatggagatattaatgaaaatgatattttttgaaaaaaagaatctaaatataagcaaatttaactaacttatatgaaaattaagaaagttgattattttcatttaatttttctaatgacatttaaagaataatctttattttttaaagtgtctttcattagaacttgatattataatcacaattagttgaagaatttttatggaatgctatcattaaatagagtcaaagtagttaaattttacgtatatttaagtctagaaatattgttccttatatttaggtatatagatagtataatttaagataaatttatttttattaactaaattaatcagtttcttttaatgataattgggtcttcaaataggtagtatgatttttttcttcataatttaagatagaaatgtttattaaaataattatagaaacttatatattaacaattagtaatatttttaagaacttatatatttttaaaataattataaaatcacgagacttatgaaatactgcgacttaaagtaagggctattggtgtttgatcctagaataatgccctgtacacaatgtttaggtaccatttttttattttaatatttaattacaggagacggctactttgtgagactagattatggtaggggaaaggcttctcttgtttttcatttctacaatgattacgcattaattacatgcctttatgtactttttttttaatatttcacatagctgcctataatattttgttgcaaaatatatattccaaattaaagttcacacatctgtctattttcatttgaaagtatcatccgcccaatgcattgttgccaagttagaacttgtaattttctaaattacttccaatgtttagcaaattaggctttacatattaaaaaaaaaaaaagaagagaaattggtactacctaatttgtatcgttttgaatcgcttgcaagaatcctagaagtttacgttacgaggcatatctcatgagaatcaataatccatccacgaaatattcttcttagactcctttatttattaacttgagtttaaaattgtgcaggttggtgagttggctgggattgcaattgggtctacaatactgcttaatgtgatgattggagggtaatactaattattaaccaatccaaatcttaattagatgcaaaatcagcattgttggagttgtaggacataatattcttgtgaatggttatcatatttggcaggccagtcacaggagcatcaatgaacccagttagaagcctaggacctgctattgtacacggcgaatacagaggaatatggatatatttggtggcaccggttgtggggccatagctggagcattggtatacaacaccattaggtacacggacaagccattgcgagaaatcaccaagagtgtctctttcgtcaaaggccatgatagctccaaataatttaagcaaatgcaaatggactaatgttagggaaaaagttacatcaacaccttaacatccattgaatacctagaggaagaaaaacaatataagcataatagggtctataatctcgaatatgtttagataaatttctttaaaaatacttttaaaagaagaaaataagaagaaaaaaatgaaataaatttttcataaacaaaaataagttctcaattagctaatttttagaagttcatcactataacttctctaaaagatgagatgacatctacaaatgagctaataaaaaacttattttagcttatggagaaactcattttattttttcttcttctagaaatacttataaagaaacttatatccaagtagacccccgtaataggaaatataaaaaatgaaaaatattggtgaagtgtttaaaattataggatgtttatatataataactcttaacgttatcctcagctgtggtgtggagagtcaataacttcttccttgtaattgtctttgttacaaataataattagaagaaaaaaaattatgcatgaagttactcaaagaaactacgctatgatttttcatgtccttgttatattaaaggtcatgcacttgaatatcatcaccctctttttcctctttatttcgataaataaaagttgatttttgatatatattgttggtggatcttgaagctttgtggaccaagctagttttatttcttgtatgtgagttatgaggagttgaaggcacaagtttatgggctttgttgattcgggtttgagtttaattttgtactatagtgaaccctttgtaaagggatatgcaattggttaatttggtcaatttttcaaaattttaatttttcataacttttccccacttcatcagcccattgaattatgtgatatatatccactgttgtaaggatttggagcattcgtattcaccttagaaaataaggtgcatgtcatgttaggcagaatccataaagacgtggcattaaataattgactttttgaggtctgtagacggtggatagactcggatactgcgataataatatattaatcacataattacatatttttttaaaatcaaacaaaaaaagttaaggttcggtctgttaagagttttgataagtaaaaataagtacatggtaatccatttatatgtctactatacttgtctagtgattagttacatttataagtcgtttaacagatatgatcaaaattagtagattgttttacactttctcataatttacatattaaatgatttttccttttaatttcttaataaatatcctaataacactaattaaaaaaccctatttttgaaagctaaaagcacagtcattttggaatggtggaaatattattattattattagtggctaaactatgcttccccacgtgtatagtcgtcatcgctccaaccgcgtcatcatataaaattataaatagttcacattcaactttagtttatttacttcttcactgtcggaaacagttttcctcgttcatttatcagctgttctcttcgtttttctgccgacaatggatgagaattcagcaacaaatggaacccatgaggtggttttagatgtaaacaaggatgtctctagaacaactcatgcttcacgctcttgtgtcaatgtttctttcttgcagaaggtgtgtccttatcttttatttttttttttgtgtgcccaatcatatgagatttgattagatgaaatgtattggtatctctgctagaatcttatattttttattgttgtgaaacgctacagtgcatatagtctctttctgaattaatctattgaccatattgaacttgaaaaaatgagattagaaaagacaatatcatggttttgtatgttggtggatacagttggtagctgaggtggtaggcacgtatttcttgatatttgcagggtgtgcttcagtggtggtgaacaagaacaacaacaacgttgtaacacttcctgggatatcaattgtttggggactggttgtgatggtgctggtttactctgttggtcacatctctggtgcccatttcaatccttctgtcaccattgcttttgcctccaccaaaaggtttcccttgaagcaggtgaaccaaccacaaattttttttttccttcaacattgatttttggttcaagtaggtaggaaaattagaggtcaaattagtttatcatgattgaaagagaaattttgtttatattgtattttcacacaacttaattttaacaaataaataaaagagagataagaagaaaaaacaaagaaatgtgaaataagatggatgatgtaagggagagaattattgagaaaagaatgtgttgtatacttatattgcatgtataaatataatatctcaaattaaaatacttatttgccttgacctttttacactagtttataattggtaaacaaaacgcgtgttgaacataggtagcaagaaaaataatggaattagagaaagccttagtcctctttcactacatccaattgtctcattttatcttgaaattattggcatattcacggtgatataactatcaaccatttagcattgtaggttccagtttatgtggtggctcaggttgttggatccacacttgcaagtgggactctcagactattatttagtggcaaggatgcccagttttctggaacacttccatctgggtccaacctgcaagcttttgtgattgaattcttaataacctttttccttatgtttgtcgtatccggggttgccactgataacagagcggtaaagtttcttattccatcattaaattttgtttttttgtttgtttggttacaattagcttttattttctataaaaaaatttattaacacgtgtctagccaaattggctatggctaatcacctcctaaattctgacataaaaaatggagtacataaattgactagttgtctacatatattcgtagcgttttggatcacttggaagaatgctacaagtttatatcacacgagacatcttatacgaaacaaaaatccatataacatatttgaatatttgtctttcttggacctcaattccatggatttcatttatttattttatttggaaatcttgcagatcggtgagttggccgggattgccgttgggtccactgtgctgttgaatgtgatgtttgcagggtattattatcttacccaaagataattaaatacaagtgtaggcacacacattatgacatttaaaacattacattatttattcaaagatgttacaccttttggaagcaaaatagaggtcaaagtatgatctcatttgcgtgattgaatattattggtgtgtataattgttgaactaaattgacaatacttactacattatgttagttattatgtaactatatcttgttaaacataagatatgcgaattgttgtaaatctatttgtttcttttacgtacgaataaaagaatatattatgtaactaatgacatggtttcatatacgacaggccaatcacaggagcatcaatgaacccagcaagaagcatagggccagcgattgtacacaacgaataccgaggaatatggatatatttagtgtctccaactcttggggctgtggctggcgcatgggtctacaatagtattcgttacacggacaagccactgcgtgagatcaccaagagtgcctctttccttaaaggagtagggcgtagtggaagctctacgtgatttaaccaaattatgctagaaattaaggtgtatttatgtctcatttacagaggagtaacttcatttggaaagtagttgtctccaaaatttattactactttatcatgtatcagggtcaaagtagaaggaagaaatcaaaatttctagtatatttgtaacttcattagtatattgttgcaaacacatccacagaaatcaaaatttcatctctttgtttttcactttattaagtttatattcatataatcactgggttttaggccccataccttgcacagttttttttttttttatattgcattttaagaaatacaataaaatatgtatatataaattgtgtaaaactattttttaaactatcataaaataaaccagtattttaatataattttttatacgtgtttaatatgtataagaaaacatatgcttatttatgtatacctatataaatactacattaataaaattaaatattataataatacttattttcaagtttaatattatattcgtttctttttatataggaaataaattataatgtattttacaaaatgtaacttgtttctataggaacaaaggtaataatataatagagaaaaaatatatactatattaacatatattacaaaaattctattataaaatatatttatttagtttttaatacctataataaaatataactataaacacccaatttcattcggacaatgaaaaataaaaatgtaaattataagaaaatttaaaacaaaaataaaaacagaaaaagaaacgagtataataataataataataataataattaatcaataaataaaaataaacgaaaatcatcatttttcttgatctaataatatccattataaaaatgttgaatttaaaaattttaaattatataataaaattttagaaaatcattctatgaacatgaataaataaactattaatttcagttttggttaaacacattgtctgattttcttttgaaataaaattaaggatcgttgacaagtaaaaaaagataataacaaagacaagtaaattaatgatatggacatagatttggccaatttacattacaattagaaatgtacatactaatttggaaaggaaatttaataaataatattgggaactgggaaggaaaaaagaattgaagttaggatgcctcactaaacaagatatacatgtcagaaagtgctaggttatattattagacggaaaaaaatctcccattattgtcacgatgccttgggaaagaaactagtctccttaatttggggcctgaagattattttgggtaccggtaacacgagcagcaccactgctttgcctggttcttggaataattataggcaaacaacacactagaacgagtagtgactccattatgaaagccatcattgtgatccatacaaatatgcaaatcttccaatgccatataatcctcttgaataagggaagttctgattcaataaccactgatgaatcataaatttgaggaatgccggcaccaggtgaatattctgctcgctgctcaagtgttacttttaagcatgaagtaggtacatccccttcaacaaaacctctcatcttgacattcagtgtctgggtttctgatatatagccagtgacaagtggtacaatcttgaggaatgtcgtgattaggcggataggctcacttgtgaattttaacatgcaaggttgatttgaactccaaattgttttgccatcagaagacaagaagtctaccctgatctatagagctcaaaacaaagcaacaggaaactatgaactttaattatcatcatactaatagttcagattctttaagcagaatgatacaagtacaagaaaatggcaattttaacagagtgcaaatcatgagaggaaacataatcatggaaattttaacaaaagaagtataattgatctccttctttgcctaataaatctaactatcctcttaaagcactcacaccacaatgataggaaacatagtacatagacaaataaaagaaccattctagttaaaagttttagcttttatgtaaaggccagctaagtgtcttagtcgtgacacttggcgtatattgcataagagggttgtgctgataactctaccctgttgtcatccattaaaatttaacaattagataaaggaaccaggaattaaactctcttagccagttcaattccttccaaatgagtttaatggctgacaaatcgttccaataactgcttgagctacaattgcacggcgacagtaaaagctattgaacccctaattcatgatattctagaatcatgttttcatcatttcttctaaccaaactccaacaatactcaaataaagcaaatataaagatattgagagttaaaactagcaccaacttgccactcaaaccctttaaagtcgtacgctagtgagtagtgaccacaaatagcccatccaccatcaaaggtccttatgctaacatagtaacattacatatttacacattaatattagaactagtaaaacatcatgcaagcagttcatgtcattttctggattaaaatgactgagataagtcttaagtacctgaaagatgccaagatttgtgttgtattctgactccggcacaaccaatgaaacagtgacgtgtaccttttggttagcaggtataacccttctacccatccactctctaacagcaatgcccttctcagaatcatgcgcacccccaacaccatcacaagacatcacaggcacaaatgcaacaggactctgcttggtgtaatcaaagttcaaaacctgcctcatctgaaacggctcctccaccaaacacctcaccaaaaacccactcaccacaagtgaagaaaccaaaagaccaaacaaaatgcaacaaatatacattgaccacaagaatccccacccacacctaaatgcaacattccacaaagatttgtgctctttgaaccacccttgagctgaagaaccaatgcacccaaaaacaaaacaccaaactttacccaaaatcaccaccaaaagacctttcccctttctaattgttccaaaagggtccacgaaaaacaaaaaagcgtgtaacataaaccacactgggaatttcattaagacaacgaaaatattgatttgaaacacaattgacctaatcaccaaccccgttacataatcgagcaaattcaaaggggagttactgaattccaccgccgagtcaacggaatcggtgacgccgtcttcgttctcggcggtggttaacgtcgattcctcgttcccctcttcggtggcaacgcttggagatggaatgggaataactttctctcgatttgaatcgcatttctcggggaaattctcgtttccgtttgaagttccgagatttggatcgctccgatggttcgtgacgtttccggtggtcgaatagtcgttggaaccggtattcgtggtctccctaaccggtgagttacggggggttgaacggcggcggattgtgatcgccggaggtggggagggtgggttggggtcggagagaattgaagaagaggcggaagattccagcgatttatcggcggcgccggagcaatggtggaaggggcagtgaggaagcgcgtcgaggaaaacgtcgtcgttttggtcgtttgggcctgaaaacgatgagtccattgaagatgacgtgattggatattgaacttccgaggctggttcattttgaagccacaaaattgagaattttttgctttctcaaaaaggaaagtatattttcgaagaaaaaaaattatattccaaaacaatacacacaagtttgtggtataaaataattacatggtttttcgtcacaaaagttaatttacaacattaaattttcttaaaagaaagaagcatatattcattcatcactttgaaaataaaaaccaataagatatgttattttcatcaccattagcatttttgtaattttttttaggatattttttgtcattctttaaatgataacactttatatttcttttttttgttaggtgaagaatgaacatttagcttgaatatttttctctccttttatgatgattcattgttttagattttgtagtgttattatgatagacgcaaatttttagtgttaattttcatagattgttatcatattttggtctttagaataatattaagacattcaagtattatgagatgtatggtgaataagattttttgcattctcctaaaaaaagttttttgcattaaagagtaaagtttcacatgaaaaaatgatttaaaatactttttatattcgaatttggggatgttgcatgctggaaacattaatcacaccatggttatgtttatagaaatttatgttctcatgcacatgatttacattttgattatcgtaaatcttatgcccctacaaatattttttttttgtctttcccatattattattcaatctttaaatcttagtttaattaatgctcctaaaaatgatcaagcctggtgcacttttagcctctaagctctttgcaatttctttttctttatagccactgtctgcatctctgcacagaatcctttgcattattcttgcataattaatgaagcatcattcaataactcctcgtggattctccttaaaagaactttcatggtcattgttgttctcctccgatccttcacattggttgtttcctccaaccattattagtatatgtttcacctctatatataaagggaacttcagctaacatatgacatccattgtcctcatcatattttgcaataacaataaagtgaactttgataccatattataatttgaaaaaatgatacaaatgatatcattttcgcgtgtccacttatcataaagattaaagcaggggagagaaattttataaatatgaaaatgtgattaatataaaaaatatttgagtttcatatttatttgttcacattatctttctatttattatttttcattacaaaagtttgtcaaattaataacatgagagttcatataatattattacacgttaaaaatatggatatatggtgctataatactaaagagtcctatttaacaaattcagaattgaactaaataaagttgcatgtaatagataacaagtatagtatagatttctgaaacgtacaattttctttttatacattttttacaagtaattccaaaatctgagttgttttttcccctctaaatattgataattcctgttggaatatgagcctaatcaactagagtcaatttaatggtccagagtttggagatatattattatatatatcaatataggaggatcggaatatttctccaacattatgtgatataatatatatatatatatatattcctttctgatttcatttaaggagttttgagaaacattttcctactaaataaaagctgatgataactaatgacttttaatttcaatttttctgccccaatttcatcgtacatgtagccctcgaagtattatgacaagaaggtacgtagttgtaaaccaggttaccgctaacacctacttatcaattacaaaggataagcataccaagtgttaattccctagctaattaacacaatgtatcatttcactttcgaattcagcattccttcgatgtaggaatttcagcctaaattaaccaagctagcctccctcgtaaagcctcattcctgcaaaataaacgatgcctaggatggttaattaattcttaattggtttcatctatagatatcattcaatcattttgtttactccccagcaatataatcctattaaagacatcacatgtacaaattcacttttattaattataaattactgttgtcctttggaggaatattgaaatatatataagagataaaagtaatctgttccccatctcatcgaaaataacaaaaggtgaacactaaagccatgcagatcgaaatatatatatatatatatatatatatatatatatatacatctcaagacgggtaatataatcatttgcaattcattcatgactattaattaataatattattaaccatatggatgatgtaacaccctaactaattttatttaattaattaattatttgcttattttaaattttattattttattcttttgagggaaaatataaattgagataagaacaagaaaaactaaaattttacaagaaacgtgtattagtacaaaaattcttcgttataaaatttacaaaatatgaagattgatacattagtccatgtctctgatataaacatacaagtacaaatctcttttccaaaatccagcctagtacaatgcttcttcaatatatcgatactactccagccttaagaaatctgatcatcatttccatctaaaaacataaaataaatctagtgagaaataaatttctcagtaggcaaatttaaaccaccaaacatgttagaaggttagtaaataaagcaaatttgattcaacatacactttagcagattagtaaataactcaatatatctgaatgaatgcatgaatgtatgaatgcatggaaatgaatgcaatggccacaggtgcacatggtatctacatatcgtactgtatgtagctacatctcgtactgaatgtagacgctgtgatcgtcttacacaaacatgcatgaatttccatgtattagcacctgatctcttgaagtagcataggcccggttgtcacactcgggtcattcttaaaatcataacataggcccggtgttcacaactcgggtcaatctcataaaatcataggtccgatctttgaaaaccagatcaatctcaataattcataatataagaaatgtattattttccttccataaagtatgttagttaaccttcagtaaaagcataccaactagaatttatttgaaatttttacaaactatgtccggattctgagtttatggtatccgtgttcaggatgtccgggttccggatatatggtgtccgggttccgggtacaaggtgtccgagttccgggtacaaggtgtccaggttccgggtacaaggtgtccaggttccgggtaaaaggtgtccgggttctgggtacaaggtgtccgggtttcgggtacaaggtgtccgggttccgggtacagggtgtccgggttccgggtacaaggtgtccgagttccgggtacaaggtgtccgggttctgagtatatggtgtccgggttctgggtacatggtgtccgggttccgtgtacatggtgtccgggtacaagatgtccgggtacaaggtgtccgggtacatggtgtcagggttccgggtacatggtgtctgggtacaagatgtccgggtacatggcgtcagggttccgggtacatggtgtccgggttccgggtataaggtgttagggttccgggtacatggtgtccgggtataaggtgtccgggtacatggtgtccgggtatatggtgtcagggttccgggtacaaggtgtccgggtacaagatgtccgggtacagggttccgagtacatggtgtccgggtacatggtgtccgggtacaaggtgttcgggtacatggtgtccgggtacaaggtgtccgggtacatggtgtccgggttctgggtacatggtgtcagggttccgggtacaaggtgtccgggtacaagaattaaaattattaaattcctaaattagagattaaagcctagcctacctgtgaaaattgtaatggattgcttagagaactaccgggattattttaagagaaaaggattttacgtaaaagaaagtgtttgagaaagtttaggaagagagtgaaagctgaaagtgtttgtatgtagattttcggtgcagagagtttgaatcttccaggctatttatagtgcttgatttagttaggattaaaagggatttggttggaaagaaacttagttactagaaaatatctagattttcttatgtaagtcatcattactaatattctcttcataaatggtagatgcaacgtggaaaactactgaagcttgttcctgcttatttattttgcctaatgccatctggaaaggtcataagaaaaatgtgcacaaatatttggatagattaggaaaaaaaattgctacgtggctggaggctttatttcagtttaaaaattttcctttattcttttttaaagcctatcaatcagaaacaaaaatatatttttgtgaatgttacaatatggatatccaagaggatttttctagtgattttggacttagctgaaattttcacgtggtcaaagactcaatttttggatgctaaaatttgtccttaaaaattatattttattattataatttagatcatgaatatttatataattatttgaggattttacatttcatccctcctaaaaaaaattttgccctcaaaatttagtaaatacctgtaaataaatccggatacttcttcctcatctctgactctaattcccaggtaggttcttccaaacgtccttgtccccatgctacttttaccaatgatacagacttatttcttagttgttttatttttctatccaaaattcttgtcgggggtaagctcatagttaaattttcttttaactgtattgattcagattctagaacatgacttgggtcggaaatatatttacgaagttgtgagacatgaaaaacattgtgaaggttggaaagatttggtggtaaggctatttggtaggctattgtacctattcttttcagaatttggaaaggaccaataaaacgaggactcaactttttgaccttcattgctcgtcctattccggtaactggagtaactttgagaaaaacatgttctccttcttgaaattctaaaggttttcttcttttatcagcataatgtttttgcctattctgagctgtcactaatttttctctaatcttcttgatttgctccgtggtttgagttaccaagtctggacccaaaagacttacttccccggattcataccaacataaaggagattgacatttcctaccatacagagcttcaaatggagccattcctatactagtatgataactattattataaacaaactctactaatggcaaatatttctcccaagaaccttgttggtctatcgcacaagctcttaacatgtcttctaaggtttgtattgttctttcagtttgtccatctgtttggggatgataagcagtacttaagcatagcttggtcccaaatactttttgtaatgcttcccaaaatcgagaagtaaagcgggggtctctatcagaaatcagggtggaaggtacaccatgtaatctaactatttcttgtatgtacaagtgagctaatctttccaatgaataagaaatcctaatgggtataaaatgagctgacttagtgagtctatctacaatgacccagattgagtcatgtccggaaacagttctaggtaatcctaccacaaaatccatctatatacttttccatttccattgaggaatttctaaaggttgtaaggtgccaaaaggtttttgatgttctatttttactttttgacatactaggcatctttctacaaattttgctatatcctttttcatgctaggccaccaaaacattcttcttaaatcttggctcatcttagtaactccaggatgtattgtaaaattacttttgtgagcttcactcaaaattttctctcttaatccatcactttgggtacacatatcctcttttgataagtccacaatccatcattatttacctcaaaatcttgcaattttccttcttggacttgtgttaaaatttgttgaaaatctaaatctctctgctgttctagcctaatgtgttctttgaaatcactagtaatttgtatttgactcaaaatgatacttttagaattaacagaaaatcctaaattaagatttttaaaattttctatcaattccatttccttgatcatcattctagatacatgcagagatttcctacttaatgcatcagctactacatttgcctttcctggatggtattttaactcaaaatcataatccttaagaaattcaacccatcttctctgcctcatattcaactctttttggtcaaaaaggtacttgagactcttatgatctgaaaagacttcaaatcttactccatacaaataatgtctccagatttttagggcaaaaactactgctgctaattctaaatcatgggttggatagttagcttcatggggtcttaactgcctagatgcatatgctaccacatttccattttgcattaacacacagcctaaacctttcttggaagcatcacaatatacttcaaatgtaccatgagggtctggtaatactaatactggagtactagtcaaccttttccttaattctagaaaacttttctcacattctggtgaccatacaaaaggcacgtttttcctagttaagctagtaagaggtaaagctatttgtgaaaatcctttaataaatctcctatagtaaccagctagtcctagaaaactcctaatctcagttactgtggttggtctttcccaattcatgactgtttcaattttactgggatccactgcaattccttctttagaaacaacatgacccaaaaattttacttctttgacccaaaattcacacttagataacttagcatacaatttcctttctctaagggtttgtagtactattctaagatgttcctcatgttctttttctgactttgaataaaccaatatatcatctataaagattattacaaacttatctaaataaggcctaaatattctattcatgaaatccataaaaactgctggagcattagttaatccaaaagacatcactacatactcataatgctcgtatctagttctaaatgcagttttaggaatatcctcattcttaactctaatctgatggtatcctgatctaagatctatttttgaaaataccactgctcctctcaattgatccataagatcatcaatcctaggcaatggatacttattttttatggttatcttattaagctgcctataatctacacaaagtctcattcctccatctttctttttcactaacaaaactggagctccccagggtgaaacactgggtctgatgaatttcttttccaataattcctctaattgctttttcaattcttccaattctaaagggacatcctataaggtgccatggatattggtccagatccaggaattaagtcaatagagaattctatttccctttctggaggtattcctggtatttcatccggaaacacatctgggtattctcttaccacaggtattttagagagttcatcagttgactcagttacattagctgataaaagaacatacccttgaatttcattgttactagaacaggagataatggagttcacatacagacactgggtttgactgttttctgagatttctgaaggtaaaacaatggttttattcgaacagtctaacaacacatggttagctgcaagccaatccatacccaaaatcacactaaacccagtcaaaggaagacaaatcaaatttacagaaaaagatttatgatcaatttgaaaatcacaattaaaacaaatttgactagtagtaataggtttagttgtaggggtagaaactaagagatcataaggtaattgagacaagggtaattctaattgtacagcagtgtcataagaaataaaagagtgagtagcacctgaatcatataatacagttaaaattttgtctttaattatgcacttaccttcgatgagattttcagattgagaagcctccgctgcattcattgtaaaaacctttccagtatgctgaggacgtgtggtgccttgggaattttcagctctataattattagcataatgtcccatctttccacatctaaaacattgaacattgttgcgattgcgacaatcctttgccaaatgtcctatctttccacatcgggaacaagtaatctgagctatagggcatgacctgtttccatggttcttgtgacatttttcacactccctgcttgaactttgccctgtctgaaatttctgctgctgaaacttattcttaaatttaaatgactggggtcccaatttcttcctaaaattattacttaattctcttttctcagcagacctccttttatactcttctattattctacacttatttattaaggtaccaaactccctaatttctaggggtccaactacctctaacaggtcttctcttaatccgccttcaaactttatacattttcagtgctcatcagggttctgttgatagatagttgagaatttaattaactcttcaaacttagcaatatattcagtcacactacttcttccctgttcaagcctaagaaattcaagttccttagaattcctcactgacacaggaaagtacttatcaaagaatgttgttttaaatacctcccaggtaatttctatttcattacttattagaatttgcttgtggctattccaccaatactcggcattagattgtaacatgtacgtagcataggttactttttgttggtcaaaacaatctaacacagtaaatattttttctatttctttaatctattcttcagccacatatggattaaaggctcccttaaaaactggggggttagattttctaaattcaacaaacttatgatattctgtatcagtctcctacctcccatggtttatttgactagaactattatgattgttgttattttggcttaattgcatcatcatttgggtagctgcggctgcttgttgacttgctgtggttgcctgctcttgcataactgctagcatagcatgaagaatatttgtttcttcttcattgccactagttggtgttgtttcacttggacttcgcgaagccatgaattcctattcacttcacaaaaatattgaggtgatcaggctcaatatagagtaaagtgcgttagaattcaataatcacaaatattaacacacaaacaattagaatcaaacagacaatcaaagcacacagaaaaacatagtcagtccatttccctcaagacctaacaagatgaactgctctgataccaaactgtaacatcctaactaattttatttaattaattaattatttgcttattttaaattttattattttatccttttgagggaaaatataaattgagataagaacaaggaaaactaaaattttacaagaaacgtgtattagtacataaattcttcgttataaaatttacaaaatatgaaggactgatacattagtccatgtctctgatataaacatacaagtacaaatctcttttccaaaattcagcctagtacaatgcttcttcaatatatcgatactactccagccttaagaaatctgaccatcatttccatctaaaaacataaaataaatctagtgagaaataaatttctcagtaggcaaatctaaaccaccaaacacgttagaaggttagtaaataaagcaaatttgattcaacatacactttagcatattagtaaataactcaatatatctgaatgaatgcatgaatgtatgaatgcatggaaatgaatgcaatggccacaggtgcacatggtatctacatatcgtactatatgtagctacatctcgtactggatgtagacgctgtgatcgtcttacgcaaacatgcatgaatttccatgtattagcacctgatctcttgaagtagcataggcccggttgtcacactcgggtcattcttaaaatcataacataggcccggtgttcacaactcgggtcaatctcataaaatcgtaggtctgatctttgaaaaccagatcaatctcaataattcataatataagaaatgtattattttccttccataaagtatggtagttaaccttcagtaaaagcataccaactagaatttatttgaaatttttacaaactatgtccggattctgagtttatggtatccgtgttcaggatgtccgggttccggatatatggtgtccgagttccgggtacaaggtgtccgggttccgggtacagggtgtccgggttccgggtacaaggtgtccgggttctgggtacaaggtgtccgggttccgggtacaaggtgttcaggttcccggtacagggtgtccgggttccggatacaaggtgtccgagttccgggtacaaggtgtccgggttctgagtatatggtgtgcgggttccgggtacatggtgtccgggtacatggtgtcagggttccgggtacatggtgtacgggtacaaggtgtccgggtacatggtgtcagggttccgggtacatggtgttcgggtacatggtgtcagggttccgggtacatggtgtccaggtataaggtgtcagggttctgggtacatggtgtccgggtataaggtgtctgggtacatggtgtccgggtacatggtgtcagggttccgggtacaaggtgtccgggtacatggtgtccgggtacatggtgtccgggtacaaggtgtccgggtacatggtgtccgggtacaaggtgtccgggtacacggtgtccgggttccgggtacatggtgtcagggttccgggtacaaggtgtccgggtacaagaattaaaattattaaattcctaaattagagattaaagcctagcctacctgtgaaaattgtaatagattgcttagagaactgccaggattattttaagagaaaaggattttacgtaaaagaaagtgtttgagaaaatttaggaagagagtgaaagctgaaagtgtctgtatgtagattttcggtgcagagagtttgaatcttccaggctatttatagtgcttgatttagttaggatgaaaagggatttggttggaaagaaacttagttactagaaaatatctagattttcttatgtaaatcatcattactaatattctcttcataaatggtagatgcaacgtggaaaattactgaagcttgttcctgcttatttattttgcctaatgccatctggaaaggtcataagaaaaatgtgcacaaatatttggatagattaggaaaaaaaaattgctacgtggctggaggctttatttcagtttaaaaattttcctttattcttttttaaagcctatcaatcagaaacaaaaatatatttttgtgaatgttacaatatggatatccaagaggatttttctagtgattttggacttagctgaaactttcacgtggttaaagactcagtttttggatgctaaaatttgtccttaaaaattatattttattattataatttagatcatgaatatttatataattatttgaggattttacagatgaaacaagctcaatgctgttaactgtaagccattaaccagaaattcacccatcaaactattttcaactaaaacagcatacagttttgatgtaattcaagttgcaaaataacgagtcccagaatgaatacataaataggactgtatgttaagagaaaacagtgggtgcttggttattcaagtattgccaagtcataaaaaaaaaaaaaaaactacttaccccattgtcggaacgttatgcgtaggtaaaggagagtgaaattgtacgcagccttacccttacatatgcaaataagttttttccggattcgaatccatgactaacaagttatcaagtcaccaagatacaattacgtgccaagtcataaataagaaaatcttttaaatgctaacgatcaaaatgcgtgcgataaagataataattcatgctattaatttcatcaaactaatgattaatacttaccaaccaaccaatttggatgctttgttgattactccccttgaaacgctagtcttgcaaatacatagacacttgctttgtgatcaaagtgtttcaccttctcaatatatgtttttcaatctccaaaagcaattagcatagaagcatcaaactctttaaagctcgatcgacatcacatgcatcatcaaatagcataaattgggcttacttctaaatcagtttctcacccggagtttgatccactcgtgaacaagttcttctcttttctcctagctctttgataacgtttactcttgagcacatagtacgcatagtaccaagaacaccaagcattataactcccccaacaacagtaacaaacattgcagcccactcgtgatgcctaccaacaactatatgagacgctgatgtgaatgcaacggtggtgcatatagacgccaaccacatcatcttattgatcaccttcactaccctcatctcagactttgttctccctctcacaagtgtgatttgaaccaccacaacagccagcgaagagaaatgcgcaacagcgttgaagatgaagaagatatctaagggtattgtgcctaccatcactgccaccccactatcatagtctccaccgggaatgctgaaaatggccgcaaacgcaagcgtggcaaagagaaccacaaccacctttatctgttggaatgaaattttagaagtgaagaaaatatttgagaatgagagattagaaatgttttggaggaagagggtacttgtggcttgttccattgtttctggtgagttgtatgatgattcagcttgtgtattttaattttaatgtgggatgactttttgttagatattggattataagatagcatctcaactgcaggtcattttacatatttcagttcccctaagggatattttagtgtatgtaatataaaaacaggctactaggttagttatgacaggacatctttccttagtttttcttgtataactctattagtacttgtaaaaaattccaatttgaaaattcttagctcctcactaacaatgattagcatgggctgagtactttgagtttgagccaaacttaggtggaggtagtccaaccacagccactcttctatactggtttgtgttctcaacttatctgggactaattactgttttatatttgtatgctcaaatgttcaataaaatgacccctttacctgcaacattagcaattgtatcaactcattatctagtctcattagcttgtgctaactttcagagtcatttagatgttgcaaacacggagctttgtaaaatttgttaatgatttcttgggccctttattttcaacaattgtagatagtaaccttcaacttcacgatggtgctatattttacatggtaatctttattgtttaaacgagtttatatatgcataatgaaaaggaattgcagtaggacagctctcttattctccacaaccatcctttattcatatagacgaataatgagcttgtttgtttaatttttccatttcactggtatgagaaataagcataactgtcctgcccttggaatatggaagaatttatgggatattttttacatgaataatattcaaagggaacgaaatggagttgtgctatcttaaattgttggaactctagaatttttcttacacgctacaatttgttacattgtattattgtatgggacttggaaagtaaacatgcttccctatccattgggcaagtcaattatgaataatggcatggctaagctgagtttctttacctttattctgcattaacactaagcttcttaacatttgaaagttgtagttctaatttaaatattttggcaccgttttcttttatgagataattagatctcatgaatttttttcttttccagattctaaaccttgtacagaccaaaaaaatgtaaggcataagataatcgttggagttggatttggagttacagctctattccttgtcattatcatagttggaatcttttggtggaagggctacttcgaaggaataattaggaaaatcaaaggtaaatatatactatcatgttcttaccattctgaaattagtttacttcatttgcttcttaaagatttccaagttcaacttcccaaaaagtcaatcacttgacttagcgtctaggaactgtgaagttagctaggtgctacaagacgtggtcaggtaagattgaattaatatagtacccattatgatagacctccttagggattaactatgaccaaagtgggtaagaaggttaagataataggtcaaaagcaaagaacttgccttgattttttactatggcctccaaggcatccaagaatatgcatttagaaaagtattcattcttggatccaatagcctttgaggattggagataacgatttatctcttctgtgggtggtgttttatgcgtatgaattatttgcatccacttattgccttttatggtgacaagcatttctatgtatattgacacataacaagcatttgtactttcctcaaatactcttaaacaatgcagatacgtttaacttactacgtaaaatgaaactggatgttcctctggaacacttattttacggctgacatattgaacaggtactgaaagacaagattgtttaacggggacatttacgttaaaacaaattagagatgccacagaggatttcaatcctgataacaagattggagaagatggttttggtcctgtctacaaggtattagagtgaacggccttttttcttccaagcataaaaattgatgttcctccctagcatttaaaattctaaacaactgttggattgcagggtcaattatctgatggtaaattggtagcagtcgagtaacactcatcaaagtcgcggcagggaaaccataattttttgaatgagataggcaagatatcttgtttgcaacaccctaatcttgtgaaacttcatggattttgcatcgaaggggatcaattgatattggtgtatgagtacatggaaaataatatcctggctagtgctttattcagtgagtttctacccaggagtgcaaactattatgtttgtcttttgccttgtcatttattatatgttttgtaagataaggtgccaagtgttaattacttaattatgataaatcacttggagatctgattaatctgaagaagtttgtttcccgcccttttccatttttctggatacaaaataaggaatgaatgagtgctatagctagttgtttttccttccccttttgtctagacaaattaataccgtggttagatttttatactgttaaacttttcctttttcccatttctatcactttagcagctaggcaatagaattttgaaaccgtgattcatattaattcaaccacaacttctttctgcatcttttataggctcaaaagatcaacttaaacttgattgggcaacaaggcttaggatctgtattggcatagcaaaagttcttgcatttctacacaaagaatcaagactcaagattgttcatcgagatatcaaagctactaaggtgttactggatgggaatttaaaccctaaaattaacagattagtatccaaagctactaatctgttaattttgttttacagagggtatatggcaccagaatatgcattatggggttacttgtcttacaaggctaatgtttacagttgtggggttgaggtcttggaatttgttagtgggaagaactataagaattttataccaagtgataattgtgtttgccttttagacaaggtattctactatgcttcaatccctgatacatttttggcgttatgaatcccttttgttttggtagttatccaatgcaaatatccatattttcaccattctaaagaaaggtaacaaaattcccattgcaggcatttcatctgcagcgtgcagaaaatttaatagagctggttgatgaaaggttgcgaacagaggtaaacccaaccgaagcaatagctttgatgaaagtagctctcctatgcaccgctgtaacaccttcacgtaggcctacaatgtctgaggttgtgaacatgcttgaagaaagaatcagcattccaaatgctatccaacaaccaagtgattttagtgaagatttaaggtttaaagccatgagggacattcatcaactaagggaaaatcagtttgagtacaagccgaacaaacaatacaacagaagtccttacacttagctctccctaaacatttggcaatgacctggtgttagttcatgatttcattgttgctgaccatattgcaacatgagatatccttagagcatagctgagatttaatcttttgggataaccaactgtaatgatcaccatttttaggatataacatttttcactccgtctttcagagaatatatttacttctagatccgtgtaaatttctaattgctcttgaagggtacttttttttaacctgggcatttcattttgagaaattattgtatggttcggtgtagtcccagttaatcttcatatatgacacaatcacaagttttcaatttatgaaaacaaaattggcgtgtcatgtggagattgcttgaactaaaatgatctcggaccatataatttctcatttaagaggtgcatatgaactccttttcactggatatacacagtatttggagaaagaatgtacatacgcacccttgaacttgggtgttatagcaaataacaacttggcgaaagaatgtacatacgcgtcttaataatctttgggagactaaaaacccgtttgttatatctttctcaacttaagaacggcaaattgtgtttctcctttttatcaggtgtgtggtgtgtgggttcactgggttggggagttagtgagaatttcaagttcagtgctatgctcagtatgacaatttttagggtaaaaagtaatagtgggtgaagtaatacacctacgtagtgaagaagtgtctgtaaggaataagaaatcaagtttcaacgctgccagccatcacaattatgagaaaagaaaacttcgagcttgttcggattaatttgtaaactaagccaccttccccctctttgaaaatgatttagttaagactgatgtgtataaaaaacactaaattttaaacctctttattttgaatattctactttggaaaaaaaatgattattaaaaatttttattctcacattaactccaaatttgattctaatccattataaaggtgctgcaaactcgagtataatcaggtattaaaggatcaggaagagacgcaacacaagcaaaaatgaaaataaccatcataagttgatacaaagaaaccaaacatactttaagaaaatataactaaaaagacaacttaaactactaatggttgcattccataatgatcagcttgggacgtaggacgggataatatagagaataggtaacattcatgaacactttcaataatcactgtaggttccaattcggtcaattatgttagatgttagcaacagtttccttgctctcccttaggactttgacactcctctgcagcttttcacgcttcccagaaattgaaggtgactcctccaataacctctcaatcccaccaccactatattggaaatcgacaatcacacacaaatcgaaaaacagaaaagagaataggaaagagaaatatgacacagtattttaccctggttcacccaatgtaggctacgtccagcttgtctgtactataatctcctcaccgccactcgttacaagtcactcggtttacaagggaaatataaataggattaaaagaaaccctaacagtagctattcatgggccctagcccaaactactaataaaaataaaatattacaaagaatcagaggcccacaacagtacctagcctctacgggcctaggggcgctgccccccggacccccgccggggcgacttccctggaccccgcccgctcacctgggagcgggaccccagttggttttctgctgaccccgccaacaagaagggttgtcatctgactgcgaaagatgagccatatccaacacactaggggataacagatcatgaacaatctccttttccaaatccttgttaacaagattgttaatactcagcataagatgtaaggcaatggtgtcaatcaatcttttctgcactatcttccagtacgaaatcatcctcaccttcaaatcaaatgcttgagtaagcacagatgggtattgcctcaaatgaccaacttcaattttgcccacaccttcaagattcacatgcgatggattattcgaatttttcaaaacttcattcagaaaagcatcttgctgagatattaacttgttgtattcctgcacaaactcaggattacaagcgtaatcagtatgcatctccatttcaatggcctctattacatgcttggtggaacttttcttcttcttagaaataagaacctggcttgcacgcctggtagacatcaaaagctgatagtagttttcagaatgacgcgtgataactgaaatcagcacatcttcaaggtagttccacacattttcaacaaaacctataggcttgttggcaattccattcaccttcccttgcaatatagaaagaaaagcagtgcgaggcaagaaatttggaagaccaatccacttagcctcctccagcacctttatctcttgcataagaaaattcttgcttgtatcactttcagcacaagtgtaaagatcatttgagtaggaatcaagcatatccaccaaccgggcagtacaatgcatgtttttgtcttcggggtactcatcaaattctcctctaagaagaatttttctgagagattcttttgtcaatccaataatatgcataaaagctgtcatggcatcggctactgaagccaagtttgttggcaacttttccaactcagacaaattgttagctagcttctcattgatcttttttactatttctggcaaagttttagatatgctcatagcctgaacctgaaccagtttctgtgctagaactggaacacccacgatagactcgtctattttggaaagaagtggatggaactcaaacagtttctgttcttccactctagcatcctcataagactcatcaccaatgcggtttctcacacaaacataaccaagaccaatgttcacatcatcggcagtaactttttctaacaagccctcaggagacttgtctgcctttgtgaccacagccagtgtcctgaggccagttttgtcaacactctgagacattctaatagactcacaagtagtgaaatcaacactagccgaaagaacattcaggataatactttcttctggcttaatgtactccatgatcatgtctttaatctggtcataaatgttctcaggttgaccatgaaccggaacccgagttataccaggaagatcaaccattgtgagatcaggaacaccattcttcttcaccagcaaagtcaaagggttgttggaaatccctttaccatggcctgcaagctcttctgtggcagcatttatggcatgagaaacatttgcttcatcagtggaaacgattttgccattgaactccaagataagctctggggtttgaagagggtggttttggagcctcatgaccaagggcaccctagtgcaaatgccttggccacgtggcaagctgataccagcaagagattcaagaacacttgatttgccagatgattgatcaccaacaacaacaatggaaggaagctgaattccctcctttgtaatgttaaggcgcctgagattttccatagcatcaagaactggacgtatcctctcattgtaagaggacacaattggtgcaacaatagcaagaggctgaggctgttctgcagatgggtcagtttcacattgagaaacagatggtgcaacaatagccttagtgataggtctccttcctccagccattttcaatcacaatcacaatggtaaaaaatatagagagggagtgagagagggatagtttggtatgcttatgcttatgatgagtgagtgagtaaaatgccagagcttaaatgcatatttatagattaaaaaaaaaaaaacttagaggaaaatgaaaggaaaggacagtttggtttggtatcttgaaagttgaaaacaagcgtgaattgagcttttcatgggaaccgcagttacagagccgttggggtcttccatgtttaggtaattgaaaggtttctcgttaaatgcatgcatggtagtaattgaattgccataaatattagtaatgaaaatttcttacattaattaattcaactcaagtagttttagttaaaccaaaccagaaggggaatatgtactaaaaaaaaactgaagggaatgtagttaaggaaaagggacaattcattttataattcatctaaggaagctataaagttttatttatgagtagttattactattgataacatgcttcggcagtatgtcctctctagtctctcacatactatggcatatgtatggtcgtgacctgtgacctgtgacctgcatgtgacttgtgagaaaatctttgggtattgcttttgttgtcttaaaataaaataaaaattaatggtgctatttaattagtatggaaaatggtgaatatatactttgtttttttatgtattttttgtgtgagggatttttgtttattttttgatgtatgacaggaaaaggaagggataaagagagaaaatactaatagatgataaaagatgcgatggaaaataaataagttttcatcattgataaaacaaaaatactattacaatttaataataatataaagttctcttagtatttggaattttagacttaagatagaaaaaataatttgtttcattttgttatttttaaagaatttaaaatatttaatataaactctaacgaaataaattataaaggtttagagtaattctattctctataagtatgaaattatgagccagctatttttaggagaagaatttttatttttatgacttttagttttcgattaaatcctagtaaaactaaaattttatagtcctgcattagtttttcttctaaaatagtaatttcgtttacaaacaaaagggtgaaaaaaataaaaatgacgaaaatacaattccatacaataaaatcgtatttttttatatttttattttatcattgggtgttactattacgtaaatggaagtaaaaaaataaaacacaatgttattatgtaagtgtgcatgacaatcatatttttgttgtgtttttttcttttttttatccgatttacataattgaaacacatttttgtttgttgtgtttccattcaagagttggaaatacagctaaaaggcccccacttcgctagtgccaataggcaatactctgtagaatatgcaaaggcccatgattttcattcttctactgggccaacacaaagaacctcgggaccacaattttatatgttcgagttaaacccctttttatggcccatgattttaactttttcaaaaagatatttttaatttacatgtagtataatttaattttagtttaccagataaaatattttattttatttctttcttctataaaattttacaaaaaagtttattcaaaaggaccttaattaaaataaattaactttaactcattttttaactttcaaaataatattcggtaaaacaaaactatcaaaatagtaaagaaaaggaaaaattgtatgagaaattcaaaacaccaattaatcatgactcgtggcatttgaaaaatcacaggattaataagtaagttgccataacgaaataaacctcgttttaaaataaaaaattagtatttgcaaattacaaaaattatgaatacaatatttatgttttatttctcttaaattttcaataaaaaattcaggatttaatcccacaaacatgataagtcttacatttataattaattatacgcatatatatttttaattactccctccataaaagatatgtgtataataataaattaataatggagggagtataatatcaacaatttttttcataagagatactccgtcaatcctaaaagaagagttatcttagattatttacatatatcaataaaaattaataaatagatgaaagacaatagtaattttacaaaaataactttactattaatatttattacattgaaaaactataataacattttaatggtaaaaaataattaatattatattaaaattaaaatactaacacttattttaaaatacttttttccaggaactttagaagatatattctctccaaggttgtattattctatatggatcaaacatagatcctccccacaaacacaacttatattgttaactgaattacatctattccattggattgttgaagttttatctattcctatgttacaacatttataagtttaaggtttcattcttaaataaaactataagactgattttaagagttattccattcttcatctaatcatgtatgtatggtttcttttctatagactattgagcatcttattttacttttttttatataattttttattcttttcaaatactatcactcatttttagtttttattttatttaaattttaaattctaagttcttttatagatatagttaaattttagggttattataatcttaattaatgcaaataaatttattttgaattttagcattatattatatataccaataatgaggatttgtttaaaatgattatgattcatttccataatttcttctccaatttggaaaagtcttatacctataatttattcctatttaatataacaaaatatgttattaattattaaagtactgatattctccttaattttttttcattaataaatttatgaaaaatcatagagtgtaaaaaaattagaaatatttcatccataattgaacaaaatataaaaaaaaaatatactgtcatttaattataaactactacatgtaagataaaattgttactgtttataataattatttttataaattataaataaaatcaagttgattattaactttacattgataacataaatgaaaactacacttaaaaataaaattacaggtatagtaagctagcaaattatatccattgcctgtgtgagtaaacgaacatgacgaatcgatgatacaatattttaaagtgaactgaatcaactcatcttcgcagtcatactattatttagccggctatagcttgctaattgaatttgtaatagattgaaacatcatccaatgggtccaagtgtcaagtgggattctgttctgctaccctacctgaatcgaaaagataatcaataaagcaaattattataattttcaccatcatccaaatttatatattgtatgatgtgatgtgaacgccatgatgtctataatatctgttggtactctttaaattttatgtaaagtgtatgaacaaaattattttctttgtgacattcataacagactggagtttataagttaattaatttattgcccagtcagtattaattacgtactagaccatttttctcagcaaattgtttatttttaataaacaattaatctccaaataagaagttttagtatgccatattttatttttagccgtgagtgattgccaacgattcaaagggtgctctggcgttgattaaatagaaacacttaagtgttgggaagctcttgtcttggatgatcccctagtctttttcttgctggagagttgctttggttacatgcataaccttcaaagaagatttcaaatgcctaatattttatggaacttcttccatgactaaaaataaagtaattaatcttaattttttataagaaaattaacggataattttttttaatatatatgtatgatttgtatatgtgtatacacacgaatatatatcaactttatgttgattttgtcattagcaatgaaaattagttgttttattttctaaaataatcatgtagtttaaattggactacactactgaaaacaagtacgtgatgaatctttttaataaaatatgttttttttatctttataaatatccttaaatttaatttattatgtcctttatttttattttttaaaaataaataaaagacatgataaattatacaagattaaatttaacttatatggaaaaaatagttaaacaatgagatatagattgatcttctctggaaagatggtgatccggttcatatgattcattttttagtcatttttcatcttcatctctcccttcttttattattcttttcgtttatcttttttttaacctcctcatatttattattgggttcatcgatcactaatctcaattaacttgagttaaaaatgttataaatgttaatgttatatatatatatatatatatatatatattaggacactaaattatgtgatttggtaagaatttaatgttttcttttttattcgtgtgagaatcaaattcagatatcatcaaatttatattgaggcagaatgcacgtatgtagattagattatggtagttgtttctaattttagtgcttgagaattgagtttcactttgttataatcataatttgagatcccccaatctattttggtaggatatagccattttgtactcgtcattatgcttcttgctgacgctgatggaaaactaccttcgaatcttcctgttctagagtcggcgaatttccatgtaaatcaattttatcaaccaagcactacattctccttctaattccgcagaactggtcataagccaataaatgatagtgaccttattaattaattatgaggcatttggtgtgtgcataattatcttttacacatgcattaattgcctaattggatggatgtatgtatatatagggaagagaatgctattcccttgttgtatttgactacttccatttcttttgaattggctattacaagaagttttctacagagtcatggaatttcattatttttgcttcatttgtttatattattgcatgcttgttccttactgttttcaagtttcttgcatgccacttactgcttcatttgcacgcaggaaaatcgtgttgttgacgggaatgtggagaagatgcagcgggaggagagagcagatgagctggttgttcatggaaaagttgattggaaaggaagaaaagctttgaaacacgtacaaacatggggggatgaaagtttcgtacttggtaaactaggattgacatatataatatgagttcataaacagtaattaacatgaaaatgcatgtatatacatatactaattaaggtgtggattaattatactacctcgtagtactaattaaaccctgaagtgatggcaagtccttaatttaatgaccacttaccatgtgtatataaaacaatgcaagtttggtgtggattaattatactacctcggagtactaattaaaccctaatgtgatggcaagtccttaatttaatgaccactaaccatgtgtatataaaacaatataagtttcattacatattgttgtgtctttaatgtttaaagcaattaattaattaagacaagtggataaccagttacacttagtacattggtaaagaaattaaaaaatatatttttattgaaatacataaaattatattatttataatttttttacattcttttataatttttacactatataaatatattttttaaaattttttaaccaatattctaaggagactggtcgacacaagactcataaattaattgtgcacagtgcatatacactactcgttcattaattgatgcagtacgcaagtgttaatttgggtttgcatgggtgcatgcagcggcatttggtatagagaacttagcaactctgtctctagcagtgaacttggtgtcatacttcactggtattatatatgcattatgaactagcagatgcagctaacatggtcaccgatgacatgggtgctaattacatgctctccattgtggtggccgttcttgctgatacttggattggtagatacaaatccgttgttatttctggaatcgtcgagtctttggtaagatccaaacttaccttaattccttattgcataataacataagttactaatcgttattggtaaacccaagactatatatattgtttatgtgagtttgaccaaatatagcaacgtaaactattttttaaacccacctttatacctattctcttttttttttttcgattacctcatttattatttttattactttctttcttttatctctcaaagtatgtatataagaaataataaacctagattcaaaaaaaaaaaaaaaaccgttgactctcaagtatatagtgggaagaggtatacatataaagaaaagagggggggaaataaatgtgaaagattatatgattggaaaacatcaataaaaacgtaaaatatatggtgctgatttttctctatcatactcttgaccaatatatttacatgaatcataatcaagtattataatttatttcttataaaatgtgatatttttaaatatgtgttacatataaaaagtgattgggatgcatgaataggtggttgtctagaatcatctcataatttttctttagtaaatagatatgatttttcttgttcaccaataattttcactaattatgaaataaaataaaagatatttattggaaaaaatatgaaagtattgaagataaaaatgttttttaatagctttaattacttattttgatttttggaaaatatttttaaaactaaaaaggttaccctaaacataatataacagcccagtaacatcaagagctggaacatgaatgagcatttgataattaaacaaataaatgaaaaacagtacagtaaacggagatgttaaactttattaaatgatacctttagttattttttttactctaaatcaattaattttattattaaatttaattaaattctcttaaagttatatatagttaaataattagtttatacttgattattttattttaatgtatgatatattttatatatctgccaatatttaaattaatcatctaaaatttaacaaatatatataattactgaaataataccttatttctctgtcactcggataacagattctagctagggtgattattagacattatataattgcatgtactcatctactgattaataatgatatcaattatttaatttaattaaataaaacgaattagataagaagtattttaaagctattatttaacaacttatattaaagtaaaaagtttaatatctttaatagaagatttcattttaagatcttaattattattttgactaatcctataatgttatattactttaaaattttattcatattttattttaataatatatcttattttaagatcttagaacattttttatatatcctacctacactaataaaatgcaagtcaattttgtgaaaagagtaaaagattattatttttaaatggatactctaatagtcatgcactaacattatacattgtccaataaataaatcagttatatatatatatataaccaataaacttatcacatataatatacaaatgttttacatattatcttttttctcttaaataaaaccaattgaaagtaagcccaatttatatatgcaactaatttactttaaataattttctaaagcttattgaatgtgttgtatggactggcattgcttacgatacaggcacgcgtgggtagcctgacaccacccatttgcaacctgtactatgtgagagatgcacattgtgaaaagcttagtgggaagcaagaagcatttctcttcattggcctctacttgttggcctttggcagcgcaggtttgaaggcttccctgccatcacatggcgctgatcaatttgatgaaagagaccccaaagaagcaatgcaaatgtcaagcttcttcaaacggtatctttttagcactttgcgttggtggtgcagtcagcttaacatttaatgtgtatatacaagacaataatggatgggtctggggctttgggatctccaccgttgctattgttttgggcaccattatctttgcctctggattgccactataccgaattcatgctgcacatacaacaaacggaatattggagatcattcaggtatacactcttttgcaaaccttgttctgcatgtgctgtatatatttcaatttgaaaatcatatttttttatacttatgatattagtgtgaaatatttattgattttattgataatcgattaatctccatcggaaaacctagttgatcgctttaagtttaagtagctctttcctctccaccatatttttttcatccataaaatttaaattcaagagtattacccagaataaaatttgttggttgaaaaagtatatttttgagttcattaggcatgcattatgaaagtaaattttttttatacaaattgttaaccaattaaaattgattcttagtatgacttttaaatagtatattataaaaagacaaattaataaacttttatgaaaaccctttacattgttggtagatatattacttaattctatttttatttacttatagtctgattctgatacaatacaatagttgaagtttttaatttagctcgatattgcaatgatcaagcgcattagttttgaattcttcgcgtctattttccaggtctatgttgctgcaattcgcaacagaaaccttccccttcctgccaatcctatccaactatatgagattcaacaggacaaagaagccgcagtggaaatagagtatcaacctcatagagatattttcaggttcaatccgacaatgtctaatatgactgaaatactatatgttaattgttgatagcttaagtattaaagagtaatgataaatgtatataccatggagattctccacaatgtctacctgtcacacatggctaaccatgtgtgcaaataaatatgattaattgtatacaattatccatttgaatttatattgcttgtatttaattaactatatctgcaagtggttaatagtatcacgaagttatgaggttattgaaatgtttaacgttggttaactttacctaacaagtcagaaatgattaataggaaatgaacttgtatatataattatcattatgtactattgacacaaataattaaatatgtctcacaagtgattaattttcttttgcacagtttcttggacaaagcagctatcaaaagtagatctaatgagcaacctgagaatcaagagactccaaacccgtggaaactatgcagagttacccaagtagaaaatgccaaaatcattctaagcatgctcccaatattctgctgctcaatcataatgaacctttgcttagcacaactccaaaccttctctattcaacaaggctcaaccatgaacaccaggaacgccaagcattttaacatcccacctgcatctataccaatcatcccagttgccttcttaattgttttcgtccctttctatgatcgcgtttgtgttccttttctaagtaaattcaccggtattcccaccggcattacacacttgcaacgcataggagtaggcctaatactctcttccatctccatggcagttgcagcaatcatagaggtcaaaagaaaatgagctaggagacaacaacatgcttgattccttgctgtaatgtcttggatttaagcatgtgattaagcctatgattaggatcataaccaggccttagagtctcaaaaaggaaagcaataggttgttctgaccatgtggcgcgacccgcgtggggtctggcccaatccgcgccagatgtttagatcaggccaattcttacggccttctgacactattagcgtggacatggtgctactctcgtggattgttcgagcctgtggcgcggtcagcgcgagatccggcgcaatccgcgtggaagacttgaatcaggccaatactggcggccatcttacgttatccgcgtggctttggcgctaacagcgtgagttgctcgagcctttggcgcgatctgggcggaatgtggcgcgatccgcgcgggacccacgggcaggcttaaatacaactcattctgggctgagagaaaaagagaaaaagagggtgaaaatgaccattgatgaccctgtaagcttcatatcttttttatttctcatttaaacacctctgacccaactgagaaagtgttcagagcctcgagataagctagagacccagctttattctcgacacgaggcagtaaacggcgagatcgagtttatctgggagaacccttgagagctcgaaacccaaggttgaaggaagctgtgtatggttgatttgtcttgggaaaagtgattccctggtcttccttgactgcatagaggtaagaaactcgagctctagccgttggttctgtgtattggattttgggggattttgagtaccttgagaggtgtttttggaggtgttagagccgttattaggcttggacactgtagagttttgtattcagagggttactctgatgaagttagagccttgagtcatcattattgataaagtttgattttaactctgagtatgtatgagcagaggtaaaaggctgattatttgactagtatgaaccttagagtagttgacaaagttgttcatgggataatatagatgttgtgtgtgagctggaattggtgataatgagaagcttgaaattgatctggataaagcagggatatgttttatattagcctgatcagagtcttagaagaggttctggagccttgtgtaggctgagtaggatccttatgagggtctgagaatcacttgtgaagtgattgttcttgtgttatgtagaaaggattataagtttcctttcgttataaacagcttaaaatcatatttgatgagtatgtgttgttcttatgtaggacgtgagcttgatagtcctagtggtggtgaccacgaggccgggagagccggtattttgcctagagcaggtaagctcttggttcttgcatgtgcgtcctttactgtgttctaccatgatcctgatagggtgatggttctgttgtgattacatacatgtatatgaaaattgtatgttgttatgattacctgttgaatggtgttctgtaccctgtgagagggcaattgatgtgaattgatatgagatgcttgacctgtgagctgcaccctgagatgggtggttgatgtgtatgaccataaattgtctagcgtatgacttgcatggttgattgttgaatcctatggtagtaggatagatgacatgagattgagtaagacctgatgtgagatgttcctgtgatatagacgtaacctcccgaatggagatgttcctatatctacagatatagcctcctcaggtaattgtattgagataggttatgagatgttcctgcaatatagatgtagcctcctgggtggatggagatgttcctatatctgcagatgtagcctcattacaaagagatgttcccgttatatagatgtagcctcctgagtggagatgttcatatatatacagatgtagcctctgatagatgtattgagatcctgccatgagatgttcctagtatatagatgtagcctccctgggtggagatgttcctatatacatagatgtagcctctgcaggatagtgatgtatgtgatgaatgactgtatgccatgagtatagcctgattgttgtcaggtgaacgtgcattgatggtgcatgatgattgattgagtgatttactgatgttcatattgcttgtttggatatactattttcatgtatatgtatgaaagtgaatcgggggaaggaaatacctccaagggccctgagtttcctgggattttatatttcaccccttttgtgggacttatgttttcaggtgaaccctcaggaggagcagatagatcccaaggcaagaagcctatgcagggatagctgtattttgaaacattaggcatagatgacatgagcatgtggctctgatgttttatattttgcctttggtttggttttgttgtaccctaaggggatatatttgtacagttttgtacttaaaatagagatattatgaggtacagtatttatgttagtgacctttgatgaagtcactcttagtttatgcttccaaactgcttaaactctgatgattatatgtgtgattgttgattaatgtttgataatgaccctgatgattgaatgggacgttacacttgccagtattacagccattgccaattagtatattctggatttcttttcagtattttgtatttggcatagctgacatgttaacctacgtggggcttcttgagtttttctattcagaggcaccaaaaagccttaaatccacagcaacatgctttctctggtgtgctatggcccttggctattttctaagttccataatggtgaaaattgtgaatagtgcaaccaagaatattactgcaagtggaggttggttagaagggaacaatatcaacagaaaccatctgaacttgttctacttactcctttccatattgagcttgatcaacttctttgtctatttgttcgtttcaaagaggtacaagtacaggcctcaacaccctgcagttactggtggcaattcagaggagtgaatattgggagataaaggtttagcttaatatgattaatatggagcagtgaagatttagtgggttgtactgttcttcgtttgtcaaaaatctatgtgagtaaatagatagaggactgcacctttaattattttccttgtaatgtcttgaattagagctatagtttccaagaaatccatgtgaagtttttattttacctttgcctttggttacatttgatttctattttcacttttgctagaaatttttaaaattcatgaaaagttgtattttaaaaccaataataattgtacaattaaatttaaaatagttattttgaaaatcaatacattagaatttaataagattaacttatcctaaatagaaaaggacttatatatctaattaatgtcttaagatttttttggattaatatgtagtgtaaagttcatttgtatgggttgtgtgtgatttattaatgaagatctccctaatgttttatccattgttttcctaaaatcttttttttttgacaaatcctaacatctatttcatcataattttgatccatgattaattgattaaagcttattaacctatttttaaggtttaaatatatttattagttcctcaaatttttgaaaagttactttttattcaatagattcatggtttcacaatttataataatttttaatcaccaaaatttatttttaaattttttaaaaaataatttttcacaattttaaaccgacaaaatatttaactctatgacttgatggccattgtttacatattgtgtttgttttgaagaaaaatatagttgtaaaattgtcataatttttaacaaattaagaatgttttaaactatcataaatcattttaacaaattatgacagtgacaaattgtgaggtattaaaatagaacttcagttttgcaatattagagtattacaattatgacagcgacaagttccggagggagaacggaaagagactttttggaatgaccgaagcaaaaacagaagcggctatatatatatacagaatcccttcatcgtgcaagcaaaagatattgcttcgtctgagccaagtaaaccagtaatgttacacaagaaatgatagttgaaagtactgaaaaacctaaatgtgtatcgataatatgatgccaaaataaaaacataatctagataccaaggatcaaacaaaagggcaaataacatgttgcaccccaatgatcagctttgttcataataataaataaataagtgaaaacttttcaagtcagtaggtagaacatctaatttaaaagctaaaacacgaaaaaaaattctataggcgttagggttcacaactgtacagaaaatcatacaaagtgtcgtgagagcagcaaaggaaccaaaagcttagaagatttcatttctgtgttttttgaccgaattgaccttagaagtagagacggaatatttttgcagtcgctgatgaacaaatatttgtcaaatgcaatttgagtagttctttcattaaatagttctaacagattttattttatttaaaattttgtttgattttgaggtattaaaatagaacttcagttttgcaatattagagtattataattctgcatatgaatatgttttggccataacatatttatttttcattattgtatcccctgtatcattcttacttgcaattagcacatttaaaggttcaactcttattataactcaccaattttgagtgttcaacataatttgtccgactaattaaaaaaagatatatttatccgtacattacacggaaaatcgtattaatttatcttaaatttatattttttcaaattatcatgataattaatgttccttttttaattgcttgacaacacattctctcttattttaattagcaatattctattataaaaataattaatataagaaatattataaattaaatcttataaaaaaaaccattgttttaaatttagatcttctaaataaaaataaagtatttaaagatagtgtataaataaagtatacaagttgttatttgattatccttaattgatggtcaagaggactctattacagtcttataaaacccggtttagcccggtcgattgtaccgtgaaccgtagatgtatctgggccaagttgggtattgaaccggccatgcatatggcccgatttggtccggtgaaatccgactgattttgttcaaacctgggaactcggccagttattgaaactcggaccggattgtgcttgaaaaaaaataagctgaaaacggtgtcgtcatcgttgccgcgccattgtccagcctccttcatgccaacgccatcacaccttgcagtaggaaggaacgaaggtgcagcgtagcagcaagcatgaggctgtcatatatgttgctggtcccttatctttccgtcccttgaatgctcacagactcaccactaatgtctcaagcaattacctttgaccatgcattgagattcatttgaaggaggaaggtgtgtgtagcatccggcaataggaagaaggaggaagcgcagcagcaacttaaaaagaagaaggaagagctggataagatatacatatagtgggaattgattaggttttccttatttgggcggggattgggccatatccaaacgtttactttctgtaccccacttattgctttatgcagtttctttttttgctattttgatttcgataattgttatttacactcgtttttagtattaatatattttatttgtattatcaactttaatacttcaattactattttggatttttcagtatagaattatgaatgaatttttcttaatcaaataatgttagttgtatacgtatatataatataattttgaattttttaatataaaccggatcaaaccggaccaattactgacccactagttggaccacggatccaatgactcactacctcgaccagatcaatgatcagaccgattttcacaactctactgtgtttggttaaaaaagacacaacacttattatattgtaaactctctcccattattgtcagttctgatgaataaaaaaaaaatctttaattgatcatgttatattgacttcttaagtgaggagtgggagagaagagagtatatacctggaatatgcgttatgccacatcacatggttccatccaagcataactaaccaacacagtcgattccaaatcctagtcctaatcaatctggttccagtttgagttgcgattatggcaagccaggcggtgtattccgtgtgggcgattccaccggaagacgtgggcgccagatgcgccaacctcatgaccgccctccgatccgagttcggtgggccccacttccacccccatatcaccgtcgtcggagccatcaaactcacccctgaagacgccgtgactaagctccgatcggcgtgccaagccctgaggcccttccacgtcaccgtggaccgcgtggccgccggcagcttcttctaccagtgcgtgtatctcctcctccgccccgaccctcacctcctcgaaaccagcgcacactgctgcacccacttcggttacaccaattccactcgttagtgcctttctctttctctaattaattattcttcgttttcgaaagaaactttagttcgcgaatgttgatgattgattcctttgcagcttacatgccacacttgagtcttctatacggagatttgagcgatgaagagaagcggaaggcgcaagagagggctaatgctatcgatgacacgctcgctggcttgacctttcagattacgcgccttgccttatacaaaacggacactgaggacaaaacgctcaaatcttgggagaaaattgctgaatgcactctcactccaaattagtagcttcttaacttcaatattagcaaaatccacaactctgatgaagtttttggttttctacactctctagctgtcttcttagtctttctgagtgctactgctatgtgcttactgcttaccaatttccaaactcttatacataatgatgtcaaataataaggcactagtacttcttgttgtttctactttttttaggcccataattatgaaggcattattaatctgcataagttttgctgtgggtaaaagattgttagacacccttggaatgtagacatcaacatagcgattggaagagagaagagatgagtaattgttataattagtgatgtgatttgataagaagtattaaagggtagtgccaatcagtggcgaacccagaaaaaattatttatgttcgcatagttagtgacgagagatagtggcgagagttcatggtgtcccggaattttttttttaaataaaatttaattaggtccagaatgggtagtaaatgatccgcattatggtaaaacacaaaacgaaaagaacaaatggaatgctagctattgtttccaggatccatgaattttgcaatttcattaacaaggttacggaaaagattcaaaggaatgtggtcacggcctcagaggaccaaggtcatggttcatgcattttggaatttaaaaaagtacccaatatgtataaaaatctcataatagaatttgcaaattttcagcgtccaaatgactattttcttgtaacaacattattgacaattagaattatggcagttacatacatacagtaagttttgctgcggcaagagaaatgcttgcaacaaaatctcttgtactctagtttcaacctagtattttctaatggctcaaattcatgtaagtctcattaaatatatacatctcatttctcatttggtaggtctcatcctcaagctaatcagacttgagtgaactttaactaacaagagaaagtatgctactagtatacacactaagttataacaatatacatgcatactgcagctccgtacagttgtgtaatcaaatattgttatactagtttgattatatatatgccaagagccttaatacaagtagcaacactaggtctctttaggtattgcttcatgcaccaaagccgcttttgcttcactagagctttctttatccttaaaataccccaaggagggcagggctaatagaagagtaaaaggtttccatgagatatatttgtttgaaaaaaaaaaaaaaaaaaaactattagacctgtattataccagaagtctccgttgtggaaggtggtagtatggattagataaagatgttgtcacagcggaacaacagagcagttgcaatgatgttggatggggcaaagctccatgtggttcaatcaggtttatggttcctaaaataacctcaccagtccattaaaaccaggatgccatgaataagaactgtacactgtttcttatgcacgagccgaagcaaaaaagaaaaaaaaaaaaaaaaaagctgttaatctcaaaagaacagaatatatattctttttaagtacttaatcaacacttaccatgttttttcatttcttttctcttatcacatcatataacctataatacttatatatatttttttttctctctctctcactaggtgtcatatattgaatgtttatagattattttccaatctcagaatatcccattaggcatatggcgactattcttgtttctgttttgtttatatatctgtcgagttctaaatataaccaatcttctataaagtttaaactaatttgacataaaacattttttagatatttcttcctttttttctttttatgaacaaaataattctcttatgaccaattaatttaaatatcaacagaatcttcaaaattcaattcgtcaatcacgtggggtgtagcagtgtggcacgttacttgaactgtcattgttgtgatgattaacacaatcgataatttcgttatccccacatctttcgtatacaaaaaaaaaatgacaacatgatggttaataactgcggctaccgtaatttaaactctttatttgttaactgctaaaccaagcccaaatgcccaatcactgaaatcaacactgatgacttatgtagacctaaaacagcttagttagcaaacggacagtaagaagggaataaatggttaaacagatcaaacttatattagtagtacaattttccatatcaccaaaagacaaagtagtaaaattttccaattaaaatcaatattacatctggtttcacgcttccatttttggttactagatgaaattagcaattactaagatgagaaccactataataatacttaatgggtactattactacatttaaaatttgtactaattaatcaattttaccgtatgaactataattgcggagtgttggtggttctttctcggcttttttacacaaatgagtaaatttaaaattaaaaaaacactgtagattttgaaaatattacgggtatgagcaagtcgtgttttaaaacactacttcatctagagaaagatcaaagacgtattttaaaataaggctttaaaaactcactttttgtttaaaataaaaaaaataatgaaatcacgttaacaactttagtattttttttcttttttaaatattgaagttgtttattaaatcacaaatttaatctttttttcttttttctttttttaaaaaaaatattgaagtcgattgttaaatcatgactttagtttttttcttttttttttaatttgaaatatgtaagtggtgtttattttttatgccataggtattggtgttgtgtatgaaatatattatgcgtataattgtatattatttttattattttataagtgtgataattatttaatgagtatatttaatttgttaaaatattaattattttttaaaatagtagtaatataaaaatagaaaattagtcatagaaatgtaataaaaattaacatgaaatatattataaatacatggaaaataaaataaccattgggagggtgtcccatatgttagtcttttcatcaattattgttgacttaatatttcaaatataaaaaaaaataaaaagaaagactaaagtcatgataacaaataatttcaatattataaacttttttttactaaagtcatgatttaacaaacgactttaatattttttaaaaagaaagactaaattcatgattataatcacgaattttatattttttttaaaataaaataatacttgaaatcatcttttaaaatacgattttagtattttttttaattcaattttctaagattgtattttaaaacatgactttctttatataaaatcatattttaaaatacgaacttataatattttcaaaatttatcattgttgtaattttttaaaataaattacccatttatgtaaaaaagcctgctttctcagtataagtaacatgtgcttgattagggatagaaataggccaggtcgcctatcagggcctttgacctggtctgtttaaggcctggtctggcctaacttgtttataataaaggtcagacttagactttttaaaaagtctatttaaataaaaaggtcgggctcaagctttataaaaagtctgttaggcctaccaggctagcctatatatatatatatatatatatatatatatatatatatattaaaattaaaaagatataaatcaatctttttaaaaaagaaataaaataagataagataaaatctaaataatctatcttacttaaaagataaaatataaaataggaaatttgaaatctttgtagtaggtttgtaaaaaagcacatatatatatatatattaaaacaaaaaatataaatcaatctttttttttaaataattaaaataagataagttacataatctacttgaaagataaaaaataaaaaataaaatgtgtaggtttgtaaattgtataaataggcttttcaatagactcgtaggccaagccagacttttaaatagactaaatcaagcctaaaaaaaaagcctataacaggtaaataggttaggccaaacttgatgtttttaaataagatcaaggtcagacctaactaagcctgacctgccctgacctatttccatccctatgcttgatatataactgcctttcaatgctatgtttaacatgttttgtgccacaatgagtgatgaggtacgatccatgaatagaccaaactgtacccactaggcaatttcacttgctatgtccaatcaagtgaaatatgtgggagttgcatgcctagttggggcgtggatggatggtaaactcaggttgggataagctacaatctgtaactatgcacaaaaaaggaattaaatcaaatagccaagatcaaatcaactattgttagaaatgactccatttgtcgtatcactcgattctagcacacaaaattattcttccattgaataaaattagaatgaaacaatccatcctaatcaacgttcaggaattaacgctgtgttcgatttgcaagagagaaataagagacaaacaaaggtaatggggactgagtttggttggcatgattttggagagagagtaaagttataatttgtggggtttatagcttaaaatttccgtctttggaataggggtagcactaagtgggagtttaaaattttcggtaaaaagataatagtaaccttaaaaaatcaattgtttatgcaaaaaaaaaaataaatagattttcttttttggctatcatactcataaatgacaaaatggattatccaatccaagatcgatccaatgtgggatatggattataatgaattagataaaaaaattaatttaatttaaatttaaataataaaacttaagttctgtcagaggctgacttttgtggacttaacctgtattgaaccatgattgatttgtcataaagtttgcatttaatttgaactaaaaattttaaacacaaattctaggttttatcatatggatttgggttgattgggctagcccaatctatttttgtcacctttactcatggctactcccataaacataataatatttttgtctctatttaattctttcttttccatatatatcaaactcctttacaatattatttttactctatttctcacatatttttcttaaaccagactaccaaacatatatcttcatttctctttttttaaattatctattttctattttcatctattatatttctctcttctaaaccgaatacaacctaagagatgaaattgtattgtaaaccattacagtactgtttcgcacatagataatcaaattgaaattatctactaacatttatgtctaacataaaaaacattcatatttgtttatatgagacgaatatacattcttgaaatttgaaaataaggtttgatttattttagattttaacaacaaacgatgttgttgctcataaagaagaagaaaattgttaattttacgagactttttaaaaattctttgagattttaaatatggataataattgtcattctgcatacgcttatcaaggtatgttaaaatacaaaactaaaattggagcatgcatataaaataaagtatgaaacaaaaaaatgaaagtgaaaatttaaattttaattaaataaattgaaagtgtaatatctaatcataaattatgctataattaagaatttttaattttataataactactacaaaagtcttatttaaaaatgagtttttattagttaacggtgtattatgactaaattatttaaaattttaaatatgtataataattgtcgttgtgtaaaaacttgtcaaaatatgtttattttatacaataacaagaatatgaggattaaatcctcatctatttaaccctcgtcactaacccagtggattactttacttatcaaagtatgttaaggataaaaaaaaatgattttacatagatcatgcaaataatatcagtataatgaataagggtgacctacattacttgtcagcaaacaagaagcagcagaagaaggaggtgagtggatgaattaaatcaggttgtcacattcacatggcggttgccttcaacttttgggccaccgcatagaggtacaatgtgctgtcaatgacaatgatagggatggcaaagtgggccagcccacccaaaaacgggccgggctggcccaacccactaaaaaagtgggccgggtcgggctggcccacttttgcaaagtgggctgaaaatactagcccgccccactttaaagtgggttagtgggccagcgggccagcccacttaaaaaataaaaaaatatatttttttaaaaaggtaaaataaattattaaaaaaattcaaatataattgtttatactaaaaattaataatgtactaacttaatcctataacaatgatttttaatatataatacatgcctaatagaagtaaaagtaagcacgaaatacatatttaacaatggttttcaattagctcctaagtcttaacaaattcttagaaatttggttcacaatgatgcagacaatcaaaacataattgtacatgtagtatagctcattattaggttctaaataaaaatgtattagggttaaggattccaaatcattaatttctttttagtcactctccctctaagtcactcatttaattacctattaaatattttattattttttattggtaggctgctggcccggtgggctggtccacccctggcccacatttggcccacatttttgtgggccgggttggcccgccccgtttaatgaatgtgggctcaaagtctcaacccagcccacactttttcgtgggttaaacggaccggcccgccgggccaggcccattttgccatccctagacaatgacgacgaaagatgtccaacagtataactaatacaaattccaagattaaacatacatatttaaatacaggtttaatatggtagtcattgtaaatattagtagaagatagaaccttcaaaaaggactaaaaagaatgaaaccgcgttgttcatgattgtcagtttgttagaaaagttaatacgatacttggaattaagaatgagagttgtttgaagtccttgtatgtagaatacccaaaatggaaaatttggaacatgatgcattaaatatgtgtagaagttaaaggaaatttatacttggaagaacacgcctattttcattttctatcttttttttcccactctaatttgtaattataaaaaacgccttatttttcttttgttccctatttttaaaaccttgtataattgtttctcataatttattttaaaaacaaaaattaatatttttgtaactaattacattaatggtataaatcgcaactatgtatccagaattcaaactctagagttttgattatgttgaataatttcaggttaattaataattgttcaaaaggtttatttcacaattgtaaataatgttaaataaaacaaaagtaaaaaaagtttagagaataataattgtgtatattttttcaataggaatagtttatttataggtataaaatataattaaaaaagttacaaaagataaatatatataaagaaattaaaaaaattataaaataatgaaatatatggacaatcacaaataaattattcataacactaatcaatataaatataacaataaatatcataaataattatctttgtttcctattttaaaattattaattaatatgtatataattatttagattgcatatacccaaaaatcatttgtaatattctaataatatttaacaaatggaattacgtgaatcagaacatatattaacaaataaaatattaacaataagatattacattatcttaccagaattagatacacatacaaaataatataggcaagaataatgatgttaggatatcacataaaaattgagattttaataaacagtaaaatgtcacattcttcaagaatgaaaatttcctttttttcttgcactatttttccatttctagtgagaaagaatgatcttttctattctcattcttcaagaatgaattttttccttttttactttttgtgttgtttttccacttctagtggagagaaaaaaaatcttcaatttttattttattttataaggtcttcaagaccttttacaaaaatatttttagaatttctttatttgatagtgctttcaaaacacattatatctgaataaatttcatatttatgtaaataatataactatacacattataattatgaataatatgagttgggagatgagaatagtgttatcttgaaatgtgaactaaaaagaatatgacattctttagaataagatcaaattataataaaattcataggcctcaaccattgcaaccttatttttctcacttggagtgagatcattattttttattttcacttttacattattttctcatttcggatgagaatagtatcctaaaaaattccttcttgatagtatctttaagactctcaaatgatcaaattcacaattacttaaatagaacccaaatattataccaaactcatagtatgaatgacaaaattagagagagaaaaaatctagccttgaaatatgagtctaaaagaacaattttctccaatttttacatgattttttcttataagttacaataccaattgtcgataacccatggaagaaagacaatcatgtaaataaggtgttaaataaaatataattcaaataagagaaaaataaagaagaagcgaacacaagagtttaaagataatgataaatatatatatatatatatatatatatatattctttctaatagtagtaacatatttttaagtacaaaaaataattgaaaagttacataagataaatataaataaggaaagattataaaatacaatgaaagatatgaagaatcacaaatagattattcataacaaataattttttaaacttttttctataaaaaaaatcatttgacattgtgaaaaaaaaaacttttatacttacatagtaaattaagacactagatatcaattaacaacatattatattattctttactttagattttttttaaattaaactgaattttaagaggaaaaacaatgtttatacaacatactcgttagttatggacaaggttaaattttttaaaaaactgtttgtctgcaacaacaattacaatggcaacatcaaaaattgagtcatatttgttcacaattttcacaatatcaagaaataatggccagaaaaccaccaccacaatttaaaacctcacacaagatacacgagagaaaagaggttccactgactgaatcatttcatggaatatctcttgttctaagtttccaacttcgctccacgtgtctttcaccccattaataattgcttccagatctctctctcatgccctacttccctcactagctagtgcatgaatttcttaaaagtaaaaaaaaatgttaacaaaattaaattaatttgattcacctcaggtgattcaataaataaaaacaaaagaaacaaagaaaagggaataaaatatacacagatgcagatgagtgtgtgtatccatacacaatttgtttcatatatgcataaaccattatggaagaaagacgtttttcactttataaatacccatttttggccactttgcttgcattttctgatatctcctgcctgatctgctaagtggacaaaagtgagaaaaatatatacacactattcttctaagggctggaacttgctctcctgtcctgaatataacttctccattttgtttgctcaccaggtttgtggagcaaaatactgaaacatcatctaaaatgccttctcaatggttcacctctttttggggtaaatttttcccttgaatccaagattttgcaacacatgaactagattgcaatttgcaaactagccattacaagcaaatgaaactttttgaagctaaatatatataaatagctaatgatttaaatgttgaactaagttcttgaggggtgaagaggttgttccaagctttcattttcttctacatttcttttcagattcttccccaacctgacaaaaatagctgaaagatcaaaatttacttatgtgttttgtcaagaaatacttttttttttttgtgtgtgtgtgtgtgtgtttatacgaggacaataaaatgataagatcttctacttgattcagcttgattaagtcttgagggatattccaagcttccatttcctcttctttccttttcagattcttcacctgacaaaaatagctgaaagatcaaaatttacttatgtgttttgtcaagatatactttgtgtgtgtgtttatatgaggacaataaaatgatgtgatctttttacttgattcagcttgaaaacatggctcttccaaaccaatccatgtcatcagagtctccccagagaaagatgggaaggggtaagattgagatcaagaggattgagaacaccaccagtcgacaagttaccttctgcaagcgcagaaatggcttgctcaagaaggcatatgagttatctgtgctttgtgatgcagaggttgctctaattgtcttttcaaatcgtggccgcctctatgaatatgctaataacaggtacctgcttttcttcaatctcttcataaatattttgggaacattgaatttatataattttgctcatgcaaaaaaaatcttctgaaggagttaagcacaaagagcctaatcactgttgtgatgcagttagaatatggagttaatttttcctctttgttttctgtaatcaacggttcccttgtctttttttttttttttgtctttaacactcatcaagaattgtttcttctattttggcccttttccttctatgagcttttaacctcattctcctcttttttcttcttctgtttatgacaattattttcttagttcttgatttggtgggcacatagatctggtgtaccatatagacatagaagcactatggttgttaactagtagcaagaggaaaggatttggggatgttatgaaggtctgtgagatcagccaatccctagaactcataaactttctgtttcctttttcctctttcccttctctctctttctttactcatctaaaaactaaagctgtcatctttccattagcccaatttccttagtaacaaagccagttgattagacaaaaaagaaaaagaatcacagtacacttccaacaaattgtcaatgactgaatgagttaaattggaataaagaaacgagtaaaaaaaataaaaatggatatttgtaacccatcacaacaagatcttctcagaaacattgacatttaaaaaaaaatcaaagtacactttcaacaaattgtcaatgactcaatgtgttaaactggcataaagaaacgagttaaaaaaaaaatggctttttgtaacctatcacaataaaatcttctcagaaacattgacatttgacacccacttgcaagatctcgtactgggttaaaaataaccctagaaattagggttttattagggactaatacatgagctgagcatagctaattagcaaagggagaagaaaaaagaaagaaaccgttttctcttctcagcatgaccagaaaatagtcaaagttaatctcttaatatttattgctcgttgattttccccattttaggaaatggagtttggcaactatggttagggctttaaggaaaataaagggtggctctagactaggattttcttttttgtcttggttggaagaatctttgaacacgtcacacgtgatttttcagttcttgacttttgaaaaaagagtttaaccaagtaatagttggaagatggaattggtatctctttaactcttgcatctgaaccctaaagttggatcttctacaacacccctcctatgggaaactctctcttcagcatagagtaaaaaattcttttacatagtttggaaaacagcaaaagacaatgaaagaaagtcatgaaacaatgagggtccaaaacgctgcatcatcataatttcactggtagcttttggagcctctgcatttgctcaagatcttgaactttacatatttgtgaaagttgtagtctgagaaagaaaaagaagggttttaagctgaatgagagagagagagagagagagagagagaggtaaatggggggcggggcagagagccaatgagagagttctgagcattttggcttcttccatgcagtgtacaactactgcttttgcttgctgaaaatttgcggtagctgaaatgaacggctgtgatgtacacacactttcacacagaaaagactattttttttaaacaatatatggtatcagattcagtaaatgtgacttaaaaatcttgcacgaaatttagatggctagaaatcgaggtgagcaatgaggagtggttgagagcattatccactgtgagatgcgtttccttgaagtggcagagaaaaaacataggtctagaaatggttgaaccaatcatattgtgggaacctgtgccgccgtggcagcagcagccaatcagtggctcgaggatattaaggtatcagttcattgcaatactgaaaaggttttcttcttttcttttcctttttcatccctaattttctattattattatggaaactaaatcattttgttattttaagattttatttttatcacatctaatcagactttgactccagtcgaggtttctgaataatgagatcatgtgatgtttattacttttgtgaatttagttgcgtttgaggttcggttaactgaactagttggatgatttgacattaatttcaaccttggacaagctctatggttaacctcaaattaatatcgaacacagttgttcctttttaatttcttttatttttgtttcttttaatttacgcacaaagtaagaaaccgagttaaattggaagattcggatgaagacgttctagagactgaaatgtatcccttagagttagtgataaaatgataatactgttttaaaattagttgtttgcatttatagaatttaaagttattaatcagttgtgaatttctagaatttactaactacatttttattactagttatttacactttattattctattgcactataaagtataaactgcagaagatatgaatctattaataaagctgacagcttcacgaaagagataaaataaacgaataaaggaatataaattcaaaagatgtgatatatataataattcattaataaagtttagtttatattataactttcattaataatgttatcctagtaatttatacactcaaaccaagagataaatgtagtttatgtgacaatattcctctttctcttcaaccatgcaaggaaaattttcagatttccaattactaattaccctcaacagggttaaggatacaagataaaaaaaaaaaaaaaactggattgggtttatgcactttagaaggtaaagtgcacaaatcctaatcattcatattaataaatgatttagataaacacaccttcattaaaattgccacatcaaatttttctttaacgaaataaaacttattaaattaaaatagaaaataaaaaaattattttggcttgcttcacctaatcatcttcattggttacacagaagaaaagcccccaatacagttgttacaaattattcttcttaatctgcagctttatcttaaaatttcttactactcttaattggaattttttcttccaaccacttatccagcaatgtagaagccaataacggaagaaggaaaaaaaatcatttgcctaattaagagccaagtagcaaccagaaattagtagcatcaagaaaagaattagtacgagcctaaatagtggcccctctgtccagaagatgttgtctccagcatgacctcattggtcgatgcaactagtttttttttttttttttcattttgtgataagcacatacggaatcaattgagagagagaaatcacgttgaagacatggaggaaaaaaaattcagataaagcaagatttagaataacaatgccgcaacaattgtttttagggtttttgttcttttgtatattatgaagatgatcaagtgaagcacacgagaatattttctatttttatttaatgataaaaaatctatacggcaattttaattgaggtgtatcaatctaaatcatttattaatatgaatggttaggatttgtgcattttatcctctaaagtgcatgttgcactttagaggagtccaaccggggctagtcataacgaaagctagtgcactgtttgatttagctaagattctcaaaaaatccttttataatcaattaagttgcagggtttaataataatcacaaggaacctaaagcctttaacataactatcctagttagatgattacaaattttgtaagactaaggcatcctacaagttattaagattaaatatttgtttatctttcagaacttttttattttccaaaaaaatttgttactggagaaggagattgaatgctataccggaaatttggtcgtcaatcatgttctttgacttttgggttatgcttatataatcttgtaacaggacaacttgtgaatctatataaggtttttttataacaagggtcatactcttgcagattattagataaaaaaaataagtaattttctgtgcttatataatgttctttcacaatgatcagaaaaagtcctttatcacttagatgatgccactgtcatatcacttagcacaatgatcaatataatttataaataatcctactgttattatagcgtcaaagcttcaattgagaggtacaagaaagcaagttcagattcatctactggtggacaatctgcttctgaggctaatgctcaggtattaattcattattccttctctacattttttcaagagaaactttatttgaaactaattaaacaatgatagatacattaaattaatatcatgcagaaaaggaatttgaatgtaattgcaatgaattataaactaacatttttaaccatgatttcaaatctcagttctacgagcaagaagctgccaaactgcgggtgcaaataagcaatctgcagaatcacaataggcaagttgcattagtaaaaatttcactacaatatcgaagaaaaaaaaaacatatgaagagatctcaagtattatttcaatatttggtaaaaatgttttgaatcgcagtcaaatgatgggtgagggtttgagcaacatgaatggcaaggatctcaaaaacctagagactaaattagaaaaaggaatcagcagaattcgttccaagaaggtatttgtatttctagtaacaagaagtttctttctatgattttgaaagaataaagtatgcagatttactatgttgatctaattttatactttcttcctttgtttgcatgtgctacttcccaaacacctacatcagaatgagctgctatttgcagaaattgagcacatgaagaagagggtaaatgttttccttgtattcttgttttaatttctaaggtcatttttttttttttgcatttattatctaagtggctcccattacaatttaatcaagtttcttaagtttagcccaatggtctctagttaagatttcacaaatatctgtattagggctctacaattgtttttcatattctgtttaagtttcctcttggtcaaatttggagatttccaaagatggtagtgaggatatatagatcattccattgcatgagtattattcatgatagcttgagtagctcctagagcctaaagatgaatcatcttaaaaagatgccactccataaggtctaaggcccccactcaataagatctagaaagaaaaatgaaaatttgtaaggattcaatcttgtgtataaaatataaatgtgaattgtagctgcaaatgttgtcacaaataaataaaacagaattagatcatataattattaacttgagtttggaattttttatttatacactttataatattatagactatagagtttaatttattttatactatttctacgcaaacatttttcaatattttcaagtagtttttcgagagaaaaaataaatttaatctgaatgttattaaaccgctttaaataaataaaaacacaattgcacaataaaatatcaattttaaagcaaatatgtgagacactgataactaaccatatcacaatattgtagacggtgtaacgtttgacattttgtatatgatgaaactttggcttagactatatgttcattcttatccctaaataaatctatatataggtgcctataattataatctgtgtttttttttgggagagggggtatacaaaatttcttctacaatgactttcaaagtatacatagtaactaatatgtacatttcacaggagatacacttgcacaatgacaaccagcttcttagagcaaaggtttgtcattctatcatcaatctacactctttatatatatatatatatatatatatatatatatatatatatatatatatatatatatatatgaagtttgtattgtagtttcattatcaattttctttttttttttgagtgtgtagatagcaggtgagaggagtcaccataatgttaacgggttgtctggaagcataagctatgcatcgatgcaatctcagtttgactctcgcggcttcttccaagtgactggattacaacctaataataatcagtatgccggacaagacaacatgtcccttcaatatgtgtaagtttctcccttgctaggtttcacattcattctataacttgatatgtatttgtttttaattccttaatgttcaaatcactagttactacctattaacaaatctcataagagtcatcatagctttatatggtcatatcatagttccattgggaaagcagatatagaataaatgaagcaaatagttttatggatagatattaacttgcccctatgtataatatggtgaaaaaagggtaaaaaatgtgaagcacaagcccaaccaaggggtttagttgagtagtgttcgtctgagttcaatttctataaataaataaaaacacaaaaaaaaattataacaaatgaatctttcaagatacaaagggacatgcttgtggacatagttgttcttcacacaaaagagtcaactacaattatgatttcagaaaatcccaatagtcatagcatgtcaattaaaaaaggtaataatagaattgaacctctagtaaagatgattcgtgaaagaaattgggatttgtatatatgaaggaaaaaaaaaacatatggctaaagaattgctttagttggctttaaataaatgttttctcaacataaattgaaatttagtttcaataatagcttgagttagcacatatatacccgtaccatgacttgatttcgggcaaaagaacctaaataatacaaattaaataaaaaattacgcatttgggacggttttgaaactatttacaaatctggggcagtgggaaccgcccagaattgggcagcactggaaccgcccaaatccaggtggtaccaagggggtagaaccgcctggatttgggcggttccagtgctgcccaattctgggcggttcccactgcttttaaaccccaaaattttactgttcacctacatttgcactattccagcttctctctaaaagctctgccttctctctaaaagctttgccttctctgtaaagattttgcattgggttttaaggcgatttaacacgccgaaatagggcatgattaaacacgcccaacaaatagaggcgtcaccagacacgccctaggttaggcggcacacaaaagggggtcacgccaacatttgggcgtcactgacccttatataagggtgaccatccacaactcgtcgatatcaataatatggcattcctaggagaaacaagcagtcagaccatagctaattcaacattagccttcatttttccaaatggatcgatgaaacacaacgacacaggtgtttattttgagtgtccctctccaataccaatgcgggttcctgatcattgttcttttcaaacactgaagagtaggatgtccgacacccttatgctaagccgtgaccattttctggacgaaatctactatagaaagccaactgtacgtgtaggtcagcaatgtttttatcattctgctaaacttaccaatgataacgatgtttgcctaatgttaacgtgcaatgaacaaatgtcgagcgttggccctatagaaatattatgcagcatcaacagaacacctgacggtatactcagcctacttgaatccacaatcgtcccaacacatgatgcagtgctatattacaacggcaagtggaacataccacggcaaggcgattttgtgggatatgcattcactggaacaaatccaatcagatttgacattccttcaggatgcaacattgaaacactgaaggatctaatcaagcaagttgtgcctgttggccttcctccttatggaattaacaactcacaggtggtaagaaaattattttttagacaaccaacccattacgcttattcagacaacacaatcgaatatcacataaaagagttgataaccgatgcagacgtgttgaaggtcttagctgaatccaactattggaagcgtttttgcccaatacacattttagctgtttttagcaagcccgttgcccaaatggaagaagacatgtctgctacacaacatatgtgaaactgctaagtaatgttgttattttcgtatgccattattgttattgttagtgttatttgtatttgcattttggtaaacactgtttattaagtgtggttaggccgtgtggttattttaattgttattgttaactcaagtgatgtcgttattgtatttttcagttgacaaataatgaaaggctcaaaagttgtaaaacaaatttgcaattcgttagaatgaaatacattaacatccaagtacttaagcaaacatcataaaaaattcatgaaacagcacgacgatccggacaagctctccgattatgtccaacagccttgcaaattccacatctgctgcgtctttgactggtttcgatttcgtccatctcgtttcgaattctggtcgcctttggacgaccctttccatgcaacatttccctgtcgggtatgataactggaccatcactcggtggaatagcaccttcattaccaattggttgccacggaaatgagtaggcgtgcaccaaattacttatgaggaacacatcatccacgtactgaaaaggattctgacgcacatgtaaagcagcagctacggcgtgactacatgggtatttgaaggccttaaacttgccacattggcaaaaacgctctccaaggttaactgaatatgtggtctcgcagccctcaaacacctcaaattgtgttcgctcaagattatatatgctgacgtggtggcctgtaccaacggtctggttatgcctcataacatccatcacatttttgcaatatggcattgaaggatcaacttgtgaaagagctgcctgacccctagtcacaaaatattcaaccaatctgctgtacgtgtgcttcaccagagcagtgataggcatgtttcttgctcctttcaacaccctgttgactcattcggacaagttagttgtcatatggccaaatcgcctcccctctacatcatatgcacgtgtccacttctccttcgggatgctatcaatccattctgcaaccttagggctgctatcacgaaatcgtgctaacgccacgtcaaattgaatcatacagggtgtataacctgcaaaacaatcatcccattaacactaatctacttacgcatatatccatttaatatattcacagaattgttaatcatacctaaattcatcagcgtcttcttcaagcgttgatttctgaacttttgattaaaattactggcaatatgacgaaggcaaaacacgtgatgagcatgaggtggttgccaaccaggatgattcaccacagcatacagtatgcttcggtgcctatctgaaatcagacaaatattttgcctttgagtaacatgcaaacgaatgttagccagaaagtatgaccaggcttccaatgtctccccgtcaactatggcaaatgctagtggcagacattcattgttgccatcctgagtcgtggcaatcaacaatttccctgtatacttcccatacaaatgagtgccatcaatctgaatcattggtttgcaaaaattaaatgcctcacaacactgtctgaaagtccagaacatgcgatgaaacacgttttcctcgtacgagtcgatttgccacaaaataatctttggtttgaatatcataaaatgaacctggtgaaaaacgaagcatgtagccacaccaccggggcaaatatgcatatgattcttcccaattcccataaaccattgccactgctttctgctttgcaaaccaggccttacgatatgaaactctaaatccaaatgaatgggtgatcctttcctgaaccaatgcaatcgacacagacggctcctccctgatcattcctaacaatgcaaatgtaacatttactttaaaattaacaactttaaagaaccattatttaactcatatacaggaaatttaaaaaatacgtacctactacaattgatgcaataacatcagcatcaagctgtctatgaccctgtgaaatatggtcatttaggcaatggtggttgccaccccatcttgaaacaatccacttctcaccgaacgccggtttaattattctaaccctccatgggcaaccctcgttatgagcaacacacctcatgttaaacttgttgggcttgctctcaaccacatatgcttcttgatgctccttcatcaggttccgcttacatgcgatttgtgcgtcctttttggaggcaaattcttgtttaacaaacaacggatcccctaattgccatggaccctgaactgaaccggaaccggaaccggtaaaagattcttcttcgcttggatgactccaatcaatgtatgtgtagtgaggaattccatcccaaaaaggagtcacctcagcacctacaaataccaaatcaattgaataaacataacatgcacactaaaataatataacatacagatatataaatgattttagtcatgttacataccttcaacaggttcttgtgattgtctacctcctacgtccggatggtgatggatttcagacgaccccgcagcagtgcctgcttggaattcagtcacatccacaccagcattgtcatcattatccgacgcactagcatcctcttcaagaagacgatcttccatggcaatgttctcatcatcgtcatcctcttcgtcgtcatccataacccaggttgggtcatgtgaatcttcctcagacacatttacaaatggagcagcacatgacgcagccacatctacaactggagcagcatatgacgatctacgcctactaggatttaaaggaactgacctaataggtaaaacatcatctgccacatactccacgtacaactctaaaaaatctttcgttgccaacttaaaaaattccaccattagcaactctacgtcttcgtcgtccacaacttcaaaacccatgtactcttcacgttggcataatcttcccgtaatacgtgtgatacattggttgtcttgcagacctaatttttggcgtatcttcacatgtacatcacctattgtcgagcttcgcttcatacgtgtctgccttttttccccttcaaaaacaacaccttgtctcccttcaaatatccttccattataatataacacaacacggacaaactcctcaccacctgaactcatttgtttcactcaacaaaaactacataagttgaaaaaaattatgtcagaatatgttgttaccattactcataaaccatagaccctaccccttacactatcaaattttataatataaacactaacaatttcataatataaacattaactaactaaaccctaaacattaagtaaattcaattgaacaaaaccctacttagaaaaaccctaactcgtaaccctaattcaattgaacaaaaccctaattcataatccctaattcgtaaccgttaaccctaaactgaagtcactaaattgacaactaaactaaatcctacaacctaacattttttctacaacatgaaataaccaatatggctctaacaaatttaaaattcaacaacataatatattaaataatactcataagttaaataatttaacttacctgttggcagagagaggtcagacaaaaaagctttagagagatgtcagagaaaaaatttatagagagatagaaggcgcaacaggttatgtctgaaaaaaagtaaaaagaggaggatttaaggcaggtggaaccgcccagaattgggcagcattgaaaccgcccaaatccaggcgattctacccccttggtaccgcctgaatttgggcggtttcagtgctgcccaattctgggcggttccgactgccccagatttgtaaatagtttcaaaaccgccccaaatgcgtaattttttatttaatttgtattatttaggttcttttgcccttgatttcgtaaaacaaagagaagagataatggggagtgaatgagtaaacaagtcctaatataaaatacaaaatatatacagaaccgaactaatttgcattgcaaaagttatgttttaatattcaagttattttgtccgttgacaggcatatttgtgtgtcccatggagacttgacttattgtatatttggaattaatgaacataaatctaatgcttgttcttttatcttgtactctatcttgtgcagttgaagagtttaagcttaagaaggagaaagacttagatttcctattgtttgtatttgacatctagtatgatatatagaaatgctaaagcctaggaagtatatatccagaactcaatggaggcaattcatttaagtattcccctcagtactatgttatgggctatttagtatgtatacaggtactctgattacagagatttgcaccatgtcatattttgtcaacttttgtatacttttcatatttctcctataataggcttctatatatgtctatttcatatttcacttactatgaattcaacatcttactcatacatgcacctgttcttgagtatgatttttttaggaagatcattgttatttgtgcaaagtatccaccacattttgaatatgattaatttaagatttaaatacattttagtctttgtgatttatcatttttttatattttttccttacaatttttttacttgttttgttttttagataattaacgcattaaacagtaaaaaaaaactatctaaaatgttataaaaacaaaaaataaaacaaacatttttgtagagactaaaaaaattataagaacaaaatgcaaaaaaaatattataagaactaaaaatatatttaagtacccaggctaatttccagcattgttaagcatatgcaagtgcatatcggcatcgactgcttcaacatctacatactcagctctatgagaaagcttgaaaggaatgttgtgatctacaaccataatgtttctttcctgttagtaaaaattgttccaagggcaaaagcattaacaaagtgagaaaataaaactggaaaaaataaaagcactcaagtatctgcaatatcagtataatatgtattatgtgtatctgaatgctaattaatcaagtttgttagattaaaagttgagagaaacaaataaagaaattagatctattgatatatatatatatatatatatatatgcgcaagggtaagtggtcataagttcgggaaacagtttttttgaatatgtaagagtaaggttgcatataatatttctcctccttacttgcgcataacgtgcaacctccggataataaagtatgtaaattttttatatatgcaaggataagattacatccagacaatgaaatatgtaatttatatatatatatatatatatatatatattgtgggtgagagagacaatctttgaactttttaaaatatataaaaacaatgacacgagctgatcaaaagggtcgtactgatatgcaagatgagaaaggtggaatgttagacaagataaaagctcaaaatagacaagcagggtaagaagaatgattaaactcagtgagaagtgtcacatgaaaataagcgaattgagaaaggctactgtgagtgtgaccatcctacttagcttcactgcctgacaaagtcactttcttgatacagtagtaaccacttctctaacagcttgtttgagtattagagcctcacagaagtgttctaagcttcatgtggttatattcaaagcttataaataggattacaatcaattaaaacactgttgggcaagttgagaagccatagaacagttataaactgttttctctgccactctgctcaaacaaactgagtagcatgaaacttttttcttgtgtagtgtatccctgctctgcagtaacttttgaccctttcctagagtgttttccagtgtagatatgatacacattcaacaacttatacaacaattcatgcaacattacttttttgcgtctatctctctccatcatcctatcatttattatatttcaaattcaattttcctctctttttctctattggttgtacattttgttgtccaagtatcatttctcattgttttaattcagtctgtttgttgagctctatctttttttcactcttccattatttatacctttgacattgtgaccgttagggcaattgaatgttttcttaaaactcgttttcaaactcagcttgatgattaaccaaatcatcactttagttaaattttttagaaggatactattttgcaggtgtttatttcagctataattaggtaaaggtttcaagtattgggttgctgtagcgaatacacctcattcttataggtctacaacctttatttatatcttaatcttggtgataaccggttataaccataaatccaaaaaactaacaattaacatttaccaaaaaaaaacaataaatccaaaataaattaaacataattaatgcctataccactatatacaacaacagcaataaaaactatgaaagatactggatagttttccctttccttgagggtaagtggcccttggcaactctgatatctgtagattcttttttttttaaaacttcaatttctgtgattagttagaaaagatctggaacaaattaactactattcaaactatcataaagaagttcttgatctgcaggaacaaaagtacaccaatacatatgacatgaaatagctatatataacaccacaatattgcaaatgaaattccaataattgattgcaattaatctccttcgtctacaatatgattattataagttctagcaaaaatcaggtacatccttaaataaatatggttgtaagagtttccatcttcatgttaacttaacaagatgacagatatccattgggtgcgcgatggttggaatgggagcattataagcacttcttgcactgagttggttggccatctcagtaggatgaaatgcatcaaaaaatacgtgtaggtttctgttcttgcatggcttctcattagggatacactgcccattcggccccactttgcagcacataacagtttctgaaatccctacatgcatggggccaccaacgaaagttaatatatttaataaacaacatatctatttacttcaatttcttaaaacgatatgatcataattgtattaacataatagtaaaaattgaagacatgcatgtgcatccttttggtcatagtttcaattatacaaattcaatttagccaatcttttgtggaaagtacaaagatacattatatatgcattttacaagctttctgctacgaggaaataacaaatacgttaaaaccattttagatgaataagtgtttgaatatatacaggcacagtaaattatacaaaatccatacttgctggtatatcatatacatcaattgaatcttagtactactataattttggctatgaaaagaagaagaaaaaaaaaattgttaccttgtaactttgaggcgtgtaatgagaccacagcactattaatgaagataaatttggcatgaggtaattctttattgaaacgatcaactactggtttaagcttatcattaaaaatgagtgctgctctattttcctcgtcaacacataatgacccatttttcccatgaatagagatttcatgcggaatgcagcctataagcccgaggcctatcaaaacaaacttccttgccccaagtgcgtgcaaatcctgcacatagaaacaacaaaagtagataacaaaccattaatttggtgcatcatgtatattataaatgttacttatattacgtctgatcctttttttaagaaacaagttttagtgtattttatactaaaacttgtttctgatattatctttttctagaatttgaagtaaaataatacctttaaattccttgcatattcttggacaagggccacagcatactgttcaggagaatactttcgacttgatgggtaatgctccggtaagaagtagttgtttaagtagtcattgctgcctatattcacataatataagcacttatttaggtggtggtgtgcttggtcagggcctccaagtttctgagtgatttgggaaactatgactttatgattttgcaactgcaatcccaagctaatatcctcacccttcaattaaaaattaagtaaagtaaggtttttgctccattagcatgagaggataaattaagtaatacatccatgatatattgtgtatatacacctaatatcaatagctgattttctaataaacaattgaaattactttacctttaaagtgcgttttagcttgtgagttgttcaatttaaagaaatcagattcaattaagtaaatgaacatgtgatttgatttaatgcatgaaacaaatgacacatcacacaaatcatgacaaattaaatcacaaaggcaaatatctcaaaaccaaattataggtaagatgtatatatataaattagatatatgtagtaaaagaatttgacatataccaaatgtaacccggtctcgttgcgaatccccgctgaaccggatgcataattcacgcctttgagtatgtctgaaccaccggtatttgcaaagggtgggataaaattttccaatcccaaaagctcagctgcaataacataattttatattgaataattaactgaaaactcatctatacattaaaataacatgaaaacaaatcatgttaatctatggaatttattcttttcaagttatcaaacttaacgtgacaaaatcattgttttttttattagaattgagtttggattccttaacaaggattcaaattctagtctttttatgaaaaaaagaagagatcttactaaaaataatttctgaagagatcaactatggataaaaccggtaaaacatcttttgcacctataatccaaaaaaacttgattgacaaaattaaagatcacatgtccactttcattaatcgtgtctcaacactcaagctcttcaaatgaaactccagacaaaatattttttgtccatgcccaattgcaactatgtgaaagaaagatatatacatgttgagaactgaattattattgattatatcaactgaagtacggccgttggtaaatcttccagtggggccaagtggaaaatcaatcccataaggcaagttattaactttggcatctgtttgtagattgttgttgtttccactatcagataaagagtctccaaaaatgaaaagacaaggtacttggggcttcccaacaacacaataatgttgcatgtatgttgcactgaagaaaaaaatcaccactaaccataacttggtttcataatccatatcaaagaaaaatattaagagggcgaagttcagatccaaaatattagtggtccaaacacaagggtgactagataacatatatataaagggagagagaagtgagagaaaggaaggtatgacccagtttaatttgtggagaaattcgttgaaataatttatctatgtgacacattgtaaggccatatgttgattttagtaagtgaatttcatgcacacactattagaaaattactggaacctacatacggcagaaactagaatttcgccaagccatgagattgtaactatctcaagttttcaatttggacaaaatttaaatgaagttccttatgagtgatttttatttattttatttacttgtttaagaaatttggaggtaaaaggagggaaaaatgagggagggttaaaatcactaccttttaatttctatctccctctcaatgttggtagagtaggaaaatgatttataattttaagactatgtgacttaaattattttaatattttattgtatcccttttttctctattatcatttattagatataactgcatatattatcagtttaaaaaaattacatatattctctagattttttcttttcctatacgaactaaagaaagtgatctttcatgatcactaaatcaaattaaaaatgacctctttttttcctcctcttttctctgttaaaatttctctcctccacctttactcccttgaactaaatacactatacatctttgtattaaatattgcagtttaataattcacacaaatatttatataaaattccatgatacatatatttattatttataaaaacatctaaatgtcgtcatttaaataataaaaaatatagtaataaagaatttaatttaaatcctggtttgtttgaaagaagtcaaatgaaagcaactataaataaacatagaataaaatttattcataaaaattaaaaataaatattagaagatttacaacactatctttatcttactcaaataacgaaatttgatcactcattagaataatatttcctaaaattataattttttacaaaattttcacaaactgctcaaggtaaagtttgaatttaatagataccaaaaattgaatttaattacatgagttgtttcattaattaatttagattcaaccacttacaaaacaagatacaaccactttttgaagttttagatttttgcccatttgttttgaagcatttgcttttctctgatacttctgctgctacttttgttatagattgcagctagttttctgttttacttttattttttactagctcaattgattaaatatgatatatgaattattataaatcttttattagttcttacgaataaaaaaaatacaacacttcactgtttgtattttctaatacaaaattacatataccgccggcagctcaatggtaattgtggaaggcagtaatgctcaaagccacatagcatgccacgttaattctaggtcaataccatcgagctactacacctcttacaaaatttgagctactgtgttactcataaatataaatattgtaaatcttcacaggatcctaaaacttggcattggaaaatggttttgggaccttccacaacagtcgacgttattgtgttcaaggcaattctgcgtcaatcaagccaccaatgaacatcatatcctcatctccaacggctagtattttgaaagaaagaccaaatcagacttcataacgtccagcaaaatccaagctaaagagtatatttggtaatgagaaaataaataatataaatgaaaataaaaagtggcaataagtgagatataaaatgataatttgagttgtttagttaaagaaaaatagaaaaaaaataagaataaataaaaaataattcaaatgaatcgcaccattctaaaacttattttcgcactttccttcaaagtttccttcaaagtgcagtgagccgaatccaaactctgattgtatatctctagcaaaaataacaaaactctgtttgtatataatttgtccattctccataaaaaaatagttacttaaaaatagtaaaatacgtactaactctgttttttttagtgatttactctgcatttttatttttaaagttcttattttaaattttaataaaagttgggtcaaatataggcacacgttttttataatgtgacatatcatttatattttaatttctttttaatttaaatttatttttcttaaattaaatataaatactctttataattttagttttcttatttgtattttttaaattttatatacaatataaaacacacacacacgtattataatttatatgtttaaaaactatttttcttttcttgatgccgtgaattccatttttttttaattaaagtaaaccttttaattttctactcagttaatttatactggaaatatatatatgtatatatatatatatataattataaattttacatgcattaacgatagccgtaaaatatataaaacccttgccaatttgacttctaagtttattttgtcatcaattatttgtattaatttttttaccagaaatgttaaagcaaacagtttgttgtgaaagttatcttaatcattttggaagaaacattcaaaaggagaatcgatcagccaacaacatatatactattattcactataattaaataagcaatcttccaaaactttacgacaaattacacctgtacttgtgaacccatgaacatttagcatatatgaatatgtaagagaaagagagaaaacttaagactcttatgccttaaaaggaggagaaattcttaggtgcacctggagtaagacatttttcttgctctgatcctttcattatttgccatgtcagtattgtgggtcattgttgtttcttacattaatgacaattgttaattttcctagatagattaatgacaatttttattttttctaggtagattactgacatgacaaacaatgaatggattagagcaataaaatgtcttgctccgggtgcacttaagaatttctctaaaaggagtaacacattcgaagaacattgaatatggttgtggcacagcttaatagccaccaccctctggaccatgttcattgttcagagatcatatctgagctaagcgttggatatcaaaagggtaagcatctgatgcagattgaacactgtaagctctctgagccacaacaacattgccagcttcagtaggatgaaaagcatcccaaaacaagtactctctcctgttttggcaaggtgtttgcattggaagacatgtaatttgaccattgttccttccaaacccacagcacccagcatttgtaacactgaaacctgaagattgattcatgtcaacagaactttgtgagttaatattatttgatgctaaaaaaaagtgacaaaaatcatgactacaaaataaaatgcattggtttgaaaataattaccatagactgaagggttgtttataatatcttgaaagatgtcataacagttaatgaagatgactcttgcatcaggtagtttgttgttgaattggtcagtgagacctttcagttttttgttgaatatttggattgcagaattgatcttttccacacatgttttaccatctgggctgttttgggccaattcatttgggctgcaacctaattggcctattccaaacagcacaattttccttgctccataattgtacaaagtctgaatgacaaacacaaacagtcaatatttcaatttgtggaaagcttttcaattttcaatttcattcctgactttataattgaaaattaaatggctattttgaacactgcatgttaccactatattataatagaaaaattgaagatggtgaatatcaaatggtaaaagacagagagagctaaagactaacttttagtttttcagtatatgcttgaataagaacatcagcatactcatctggtgagtactgcctgctgctggaatagaattgaggcatgaaatagttgttgaggtaatcattgctgcccaacccaattgagtatatgcacttgctcaagtaatttgcagctgagtcctcacttcccagtaaatttaccacttgagacactatgttttggaaattttgcacctgcccactaaaactaatacgccctccctacaaaatatatgaacaactttatagcataaataccttaacaaatgaagattaaaaacagtgatgttgcatgaagcaaaaggaaactataaaggggtacaagttgctgcccagtttcctctctaattccagcagcagcagatgcataattgactcctttgagtatagcatcgacgctagcatcagcatatggaggtatgttatcatcgaatcccaaaagttcagctgttaaatttcaacagaaagttaaaacaagagtgaaacctttctatggttatatacttacaagaatcaattttatgtgccagatctacttttctcttgttcctgtttgtttttaccaaattagttcttctgataagtaaccatctggccagaggcggagacaagacacggggtcgcccccctaaaattttattatatatattaaaaattaaaaaataatttgacaataaaaaaaagttacattgcataatataataaaatataatattttttaatattatattaaaaaaatagaataaaatattttttaggattgcattcaaaaataggatagaatattttttaatattgtattaaaaatatttaatattatattaaaaaataggatataatatttttatgattgtattgcattatataaaatatttataagattgtattgcatattataaaatatctttaagattgcattgcataatatgataaaatatttttaggattgcattcaaaaattggttaaaatcatatgtttaaattagtataaatagaaatgtgttgatagcatgcatttcattccaaataatattagagcgctttagagagtttatatttgcatcattaagagaattgctatgagattatatagaagtgtttgacaagtctgattcttaactctctatcagaatttaaaggtacttatttattatcatagtggagttgtcaattggattaattatccaatttgaacgtagtcattttttatccaattggatttttcacgctaaaactgattgtgtcttctttatctcttatctccatattattactttgaatttgattttaaattgtgaattattttattaagactcactaaactttgccagtttattcatcaacccaccctatttgcaatttgtctagtatgtggtttgcggtttacatctttttgtatattagatttgtattgtcttcaaagtacttttatttatgatataattatttttatgttcatttcctctcaataaaatttttgtctccgtcactgacagtaaattttcctatttctttctttatctgtaattctagaattctacctctttatcaatgaaatgaactacacaaaactctaatcttaaattacatattcaatgcgggcaaacagatccatgtaaatggaatttaagggtcagtcacaaacctttttgaggggtaactaactcagagtagtgccaactctagtgtcaaaagttttactttttttcacggatgacatctgcatgttacgccttttttaatttttttatttcaccggtaaaaaatattaatgcatcttaattataccctttccttctaggtggtggacatttattgtctgattttagcataatacagcttgccatccaatagaaaattatgcatgcatatattaagatgcttttagttgcagttaattgataggttcaaaaatagggaagaagaacaacagttcttagaaccattttgatgccattgactcactataactatgacttttacaatgacgaattgatgattgttataagtccatgcatgtgaatctagttttaagaccatgcaaagatgcaaacgtgtataaatttcaactaaaatgctgcatgccatgcaaagtttataagccaattaagcaagtgcaagctcaccaattgcatcaacagtggttttcccattggaaaaccttccggaaggtccaccagggaagtcaatcccataaggcgcgtaatcagccctagccaaagattggagctggttgttgttcccattatcaaccaaagaatcaccaaaaatgaagtagcaaggcacttgtggtgcaccttgaacaccactccacaaaccaagagaaacaacaacaatgagtgccaacatgcttattgtgagatccaatgcttccattggagcaagaaacggtgttgcttgcgaggaattgaagtgaataatctaggtagctaaggaagataggggcatgtgtgagtgattgaatgtggaaggtttgacacgagtataagtatatatagtagtagagagataaggctctatactagtagtagctatagtgtagcttttacgattgggagtgttagttaggtgcattaaatggacgcggatataatgtgagattgaatgaaatggctccactaccaattccactgtaccaccccacctcattgatgaaatctgatcattgatgtgatccagctttaatttagagttgcatcttgcagggatggaaatttggacattacaacgactagttaaaacacttaggtattatgatacgacactttttatgtttttgttttgagtttttccggaatgttagattaggaatgttaaagtttcgttcagtatgggagtttttaaaattattttcaggaatttaacaagtctggaaattggttttcaaataagtttcttactggtttcaaaaattaagtttcttcctcaattttttctctgagaaagggtggaaaattcaagttttatgtaaaatagaaaaagttttagacacttgtatacgtgattttgtcgtgttcaacagaacgagctccgcagcacgagggcctctatatgtctagatgctacatcgtctccctatatgtatccatagcctacccgtcagagttgtccaaccattaatatttgaagttcattcccaagaaagaagacaaagataatagtattaacaagttaaaaaaatataatcactactataaaactgtattttactattccaatcgatttccaaaaattgttttaaaataaaatgcgatgtgttaaaatatattaaggtgacaattttgtaaataggaatgtgcaaatcacgaaaatcacgacggttttgttttgcgcgctcaatttactatttcatctccaacttaacgtattcactcactcaccctcattgtggtttccctcacttagctcgtgctcatgccttccctcattgtcgccgccgtcgaagatgtctccattttcgcgtctcctccattgtccccaaagcgcttactctatctcgtccctcccttctctctctccctcttctctccacgcgccgcctcaccttcgccatttgcgccgaatcccaaaacggcgccgacaccatcaccgcacactacgacttccacctcttcaccatcggcgccggcagcgacaacgtccgagccgctcgcttcgctgccaactacggcacttccgtcgccatctgcgagatttctttctccattatctcctctaaaatcaccaaaggcgtcggcgaaacatgagtttcttattttcaatgtttttcaatttcgctttttattgaactagggtttgtcgttgtggaggctagtgaaacagagtttcgtgtttctgaagatttgttaggtagggttcaggctaaccaagctttttcaacaagctaatttgtagaagctcatttgtttgatatattctaacggatagcattctatcattggttctgcttattcttaatagttttcaatttaatagtttcccacttcccctacatctcttttgctatatatgctactagtcaattgttcaggaatctcattgaattataaatttatatatccatattaaagtaaagagctattatagtgaaagtacgttgttcccaacttctattttatttattttaacatgtcctgcatattagaattggtttctgatagaacataataacattattttatccatttagtttatggcttttggggtggtagtttgtatattctgtataaccctctaatcccatatatattttccaacttttctgcacttgataactcttgaaacaatgctttgggtgtatgaaacacatgcccgactggcactggaatctggggacctgtttgagtataatcaggtttgttctgtatattttttgaagaaaagagacttttatgttttaattcattttagtctttgattacttttttgtacttgtttttgcttgttatgcttctgtttcttttgttttcctgagatcaaggattaatatacttcattaaaggtaatcaatgctatgaagtagtgatttataattttaatcaacgagtaaaatttggtcccatctttgcttgttttggaaatacgaatgatttattatagaagttgaagatgttattaaccttgtaattggactttagatattgacgccatttgagtgaatgtagtgccaagtctcagttacgaactctttatgccgaaggcattgaggggtccaataataatataattaatgataagatatattcatattttacatcaacttatatgttaatctgatatatcttatattattattatcattattattattattattattattatttgtaatgtttacactaacactatataaaatttttgttacataaaaatataacaataaaaaacttaatgtgaaatcgttaatatatgatttcgcaaaaaaaatcattaaatatatgatacttttataaaatcttgatattaatttttcaatacaaaataatgtaatataagttttacataaatgcactactaaaaaaaagctctttcatctaaaattttaaaaagttaatataaaatttattttaattattaaaaaaagattaattcattttagctgatataattaattaaattgactcataattattagtttattttaacaagtttcaattattaatttactttgactttttaataattttacatttacgtgactaatttgtattttttatattttgtagtgatttggtgattaaataccattattagatatgaagatcataaaagaaattaaaagaaatgggcagcatattttttagaagttaaaaacaagcgatttaaaaagatttacatgatataagaggaatttatatattatataaatatttattgtaatcattataatcacttaataatttattgacaattatttaagcataaatatatatttatttattataattttttagatctagttttttgaaattacatgttgggtttgttataaaacaaaggtaacattttaaaaaataaacaatactgatttctagaaaattgtcttaaaatgtttactttttaaggtgattttttgaaaaatcatctttaaattgtcacatgttttttaaataacatattttacgacgatttctaaaaaaaattgatatagaaatcgagattgtaagacgacttaaatatcgttgtagaaagtgttgactttctacaactacaaattcaaagacgattggaaattatcataaaaaatattcaataataatctttaaaaggattttttataatagtaaataagagtgaaatagtattttaagtaataattttttttattttttttaaaccttatcattttattatccctctatttctatcatatttttcttcaaccaaatcatctcttttgtattcaatttctcttattttctcttttcatttattttttttcgttctctccttttaatttcatcctcacaaccaaatgaccccttaatgaacacttaggagataagcaactgaattatacgctggaccaaataatgaattaataaagtaagatgttggtatttgattttgacagaatagatgtatttttttagtggctgaaaatagatgtatgtgttaataatgtctacttggctgccttgcaaatcatcgtagtcatctcgcgtattaatttaattaaataattggtcatgcgaatggcaagtgagttacaaatgaaaattactgtcaagttaacgagagagtaattaaaacgtagaaaaatgttagaaatacttgtttttcttaatctttgtgagagaaaagaagtttaaacatcaataatttgagatggaggaagtaattataacttgcaaattaaaagagaattgatcccgaataaagaagttacattatctgacagcgttcaatatttctgagtttatgcaaagatatggatatgaatgcgttgtaaaatgattagatcatctgaaaaccacaaatataaacttaacttataaattataatcgaaaattcattaaaaaaaaacttatatcacatatatcaatcattagatggaagtgcatccttcatacagttcttttatggaatcttgaggatacgtttcctgcattaatattacgttggagatatctacatgaaagtaaatgtcaattaattattgtgaataaaagaaaaatcgaccgcctattattacctcaaacatgcactagaggatattgaaggacgtatttcacaccagctttaactagcaataactaaaattaaataaataaactttaggccaaaatataagaattgcttttaagaaatattttttataacataatttatttctatattataaattcgattttttaatttcaaagaaaagtattactattttgtacagcttaacacatagatcaataaatatataattatttcaatttatccaataattttaaatttaagttttgaatacataagttaaatatttataaaatcagaggtatctaaataattataagattgataaagtggttgagggaaaaaaggagaaaaaaataatattcgttatttaatcacaaatcaccatttaaatatatatatttttatttaaataactgtataaaaactttttagcatatcggtgtataatcttttttcttaaataaacaaactaacaaacatccacagataaaaagaatcagaatcacccaccagattaattgacatgaacaatagcatgcagcagctagggtaggaacagcatctacaaattaacgactatgaatccggtctttccaatggatgaactggttattagtgattatgatttatggcccagcggcacatgctcagaataagaatgtctttttctctggatctaccccttttgggtttcatgtatgggatggtaatttggaaagctggaatgatcaaattataaatatgccccttttatttgtctccttgattgtccctctacacataacttaatgacacggaacgaaaaagacaacgatttgatatataagcatatatgtcttaataaattataaaatcacttaatcttttttattatttaagactctcagtattaaaaaattgtatcactacaagaaaaaggcctgtttccgataacatatttccgaagcattaatattccgtcggaaattgcattttttttgtagtgtatatattatgactcaactaatttaaacagttattaaggttaatcatatttttaaatataataaaacatatgacgactgatcaaattaattgggactaccttttcagtgctaatgtgatcatctaataaaaagacaagcaaaatattagcgacaacttgttattaattagcattcgataacacttatttaaagtttttttattctaacagtttgatccatcctatgaaatcatatcacccatgaaagttgttaattaagattcttctatctagcaacaccttaattaatatggcataaccttaagagtttgttaaggattagattcaaagggccgggaaaagtatttatgatgaataccttgacaatcaaagacagaaaacagaataataacggacacttttttattagccaaaagagatttatttataaggtaccggcaaacgccaaaaaaatgatgatgatttacaaagacctaccccttgcacatacattcaccagcttagcaatccaactcgaccaattgtgtctattcccaagcccataaatatccaacccgagacatcaacatatcgcatattacatgttgatattcatccaacaccagtttagacccgatttaagccatctgatctcattttcctccccattacaataattcccatccatcataaatattgtatacaagacaaaggatttgataccactcaaaataagagaaatgaaaagctttaagtttagcctccaaccatgaccaagacttatattttgttacctccatgacagaaatccaagtcaagtaattgatagcggaagatgatgttgtttctatagcaccataataacggacataattaatgcaagggggaattgaaaataagcttaaaaacttctttaaaaaaaaagattccataattttttggggcaaataaacacattcgtccataaaattgtaaggcgtcacacaaatttattcttaaaaaacgaaaaaatcaaatttagtctataaatgtgcaaaaaatacaataaattaatcctacagacaatttaataacaaattagtccttaaactttataatttaatgtcaaattgatcctcaaaaaatataatttgtaattaaattgatctttgaatattataacttaatgataaaataatttcacaaatttaacgaaggactaataatttgatgcactttttacatatttagggattaaatttgtatttttcatctttcatttcatagatcaatttattatttcattacactcttaagataaatttgactatttttaaattttttaattttataatggtgaaagtgaattttgaactacttgtagggtcacactagcttattaaatggacactttcaccccctaactttaggacgacaagtgctctcaagagtcaagatataaatttggtcttcggaagccatgcaatactttgtagctaactattcctatatgacggggtctagcatgcgaaaggcaaacatgtttcgtataatacaaaagtaaggagaaccgttggatttgcatcttcgcggtacccttggtttttttttatttaagttaggcacagtacagtatgctacaccttgttgaatgcaccctatggtccacagggatttagtctatttgcgtcagattccaatgttgaccgtattctttgtgtcttcgaatggagggagaaaacgaacaacaacttagcgaagtagcaaaaatattaaaaggttattaaaagactggggttagaaaaaaaagttgatggtttaagttttataataatggtgggaaaattatgataattgttgaaaaagatgaatagcaaagaaaaaaaatgaaaaaataagaaaaatatttaatttatttaaaaaataccatatattgatgttaagtaattaagacaattaatgatgctgtaattttgtaaggttgtgattttagaattttgtgtttttccataaaataataataatataaattatattaattgattaggtaaatgtatattaatgaaagttgtgttataagtttgagttgatgtaaattattatgaaaagtgaataataaaaatattaaaggattttttaattgattggtagttttgtaaggttggtaaaataaaaaattgtttttttagaaaataataataattgaaataggatgtttgtataaatggaatttttgttataagtttgagttcggcattgaagtaaaataatatgaaaacaaaacaatgaaaaaatatagatgaggccataggtggggccatatttttaattgggaagtataaaatgcgattattaataaactaaaatttatgcttattaatgaataggccagccgaagcaatgccttaaacaggtgaggccataggtgccttaaataggtgaggtcataggtccttgacaaattgtatgacatatttccacctgtaatgagagtatcccattagaagaaagtaggaaatagttattattaattgtaaatatgaatttaaaaaatgtgcagcccttaagaccgtaatgttgtcatatttaaacgacccaaaaaccaactgttgaagaggtttacacattttattagaatcattttaatgtttaaaagagtttaattcctataaatatagatagcgaacaaaaatttgagtttttagttttggagcttaaatgacttaagtagactgtttttatttttcatattttatgcaaaataaaacaaatatgaaattgatatatcaatttaatgatataatatatgtataatagcttaagtatatattaatttaatgatatatatatataagtatataactttgttgatttatgaattaatcaagtagagatataaatagcataagtttagataattttttaaagagtctaactttgactcaagttcgatagcttaattgtaaaatgaagtcttgaattatattcgagttgattcaataaattgtgaatcctatgatgactattttttttaatctaagcataagttggatttcattttcatgtaaatgaatctgatgagacaagttttatatattgaattggtctaaaaaggtttaaaaatgctgtcacaaaatcgtaaacaatcattattttaaaaatagtcttttcattaaaatgaaaatataaagcactaaaatatatatttttaaagataaacttctaaactaaattaaaagtatgttttaaccctgtaaatatacttgacaagccctataaaactcctatataatgttgagttcacaaaataccttcttatatatttttttaatattaggttgaattgtaattttgatctccttaattatttaatttgtaattttgatgtccttgtttataattgtaacatttgacctcttagttttataaaattgtaattttggagcgtgatagattattaactaataattgtgattattaaagatattaaattaaaaaactatcaatcattaaaaagttaataaaagacaaaaacaaaactatacgacttttaaacgttagagaacaaaataaaaaatatataaattaataattaaaattatatttattaaattatttaacaatcttttattaactttttaatgattaatagcattaataagcataaattttagtttattaataatcgcattttatacttcccagttaaaatatggtctcacctatggcctcatctatattttttcgttcttttgatttcatattattttacttcaatgcccaactcaaacttataacaaaaattccatttatacaaacatcctatttcgattattattattttctaaaaaaacacaattttttattttaccaaccttacaaaactaccaatcaattaaaaaatcctttaatatttttatcattcacttttcataataatttacatcaactcaaactcaaatgaacttataacacaactttcattaatatgcatttacctaatcaattaatataatttatattattattattattttatggaaaaacacaaaattctaaaatcacaaccttacaaaattacaacatcattaattgtattaattacttaacatcaatatatgatatttttcaaataaattaaatatttttcttttcattttttttctttgctattcctctttttcaacaattatcataattttccaataaaacttaaaccatcaacttttttttctaaccccagtcttttaataacctcttaatatttttgcgctgttgttcgtttgctccctccatttgaagacacaaagaatatggtcaatattggaatctgacgcaaatagactaaattcatgtgcaccatagggtgcattcaacgaggtgtagcagactgtgttatgtctaacttaaataaaaaataaaaaaaaatgagggtaccaattctagggcaatatgaaaagcgaagatgcaaatctaatggtcctccttactttcgtattatacgaaacatgattacctttaacatgctagacccgtcttcctatatacagaatcatcgatgctttgatattaaattgaagaatttaatgagtttgtctaagtcatacttagtaacgtgctttgttttgagtactccattattatgcatttatagcaaaaagtccacactccactctcttcaattcatggatgtttatccaacattgcaagttgtcgttgacgtttgcctagggctagaggttagcttttttggatggctcttggcattcaaaccaaatctgcaacccgtgatccttagtaattatcaataatcgctcctacaattttagcaactagtaccagtagtatttgtttttaaagccaaacctcttactattataagaaagaaaaaagtaactaactaactcaaaatgaaattattttttagaactaatttatagtataagaatttgttttgacaggcactcttttttaaacatttggataattattaatatcttataaaaaaatggatctaatatgtacatatagatgttcgtttcctggaaattctcaagcgcatattagttttgaggtaaaatttgctgtgcaaaaaattatttaaaagttagtatttttcttctaatctaacttttttcatatatattttttttctccttttttagtttccatttccccttcgttttgctagatctaaaggtatgtaattatagggattgttgacttatttaattaatggtcgcaaaaattttcaagtttaaatgtttataataaaataaaataaaataaattttagttaaaagaagattgtacaccatacaattagttaagagtaaattataaagtactagctagtaatataattttatatgaatagggatcgttgacttatttagttaatgatcggtaccaaaacttttcaaatttaaaaataaattaaattataatttatttaagataagtttgtaccaaacaaagtttaattaagagtataagaaaaaatgattatatactaaattttatacaattatccaatcataatctaatgtgtctattaagtttgttgaattttaaaataattcaaataattacttatggttacatgatcatgatattataaaaatatttgacattattactgtattaacattaaactccaagatgaaatataaagtataaactaatataattttataaatattgtaactcctcacaggatcctaacacttggcattggaaaatggttttgggagcttccacatcagtcgacgttattgtgttcactgttcaaggcaattctgcgtcaatcaagccaccaatgaacatcctcatctccaacggctagtattttgaaagaaagaccaaatcagacttcataacgtccagcaaaatccaagctaaagagtatatatatttggtatgagaaaataaataatataaatgaaaataaaaagtggcaataagtgagaaataaaatgataataatttgagttgtttagttaaagaaaaatagaaaaaaaaattagtataaataaataaaaaataattcaaatgaatcgcaccattttaaaacttattttcgcactttccttcaaagttcccttcaaagtgcagtaagccaaatccaaactctgattgtatatctctagcaaaaataacggaactctgtttgtatatataatttgtccattctccataaaaaatagttacttaaaaatagtaaaatacgtaccaactctgtttttttagtgatttactctgcatttttatttttaaagttcttattttaaattttaataaaagttgggtcaaatataggcacacgtttttataatgtgacatatcatttatattttaatttctttttaatttaaatttatttttcttaaattaaatataaatactctttataattttagttttcttatttgtattttttaaattttatatacaatataaaacacacacacacgtattataatttatatgtttaaaaactatttttcttttcttgatgccgtgaattccattttttttttaattaaagtaaaccttttaattttctacccagttaatttatactggaaatatatatatatatatatatataattataaattttacatgcattaacgatagccgtaaaatatagaaaacccttgccaatttgacttctaagtttattttgtcatcaattatttgtattaatttttttaccagaaatgttaaagcaaacagtttgttgtgaaagttatcttaatcattttggaagaaacattcacaaggagaatcgatcagccaacaacatatatactattattcactataattaaataagcaatcttccaaaactttacgacaaattacacctgtacttgtgaacccatgaacatttagcatatatgaatatgtaagagaaagagagaaaacttaagactcttatgccttaaaaggagtaacacattcgaagaacattgaatatggtttaatagccactaccctctggaccatgttcattgttcagagatcatatctgagctaagcgttggatatcaacagggtaagcatctgatgcagattgaacactgtaagctctctgagccacaacaacattgccagcttcagtaggatgaaaagcatcccaaaacaagtactctctcctgttttggcatggtgtttgcattggaagacatgtaatttgaccattgttccttcctaccccacagcacccagcatttgtaacactgaaacctgaagattgattcatgtcaacagaactttgtgagttaatattatttgatgctaaaaaaaagtgacaaaaatcatgactacaaaataaaatgcattggtttgaaaataattaccataggctgaagggttgcttataatatcttgaaagatgccataagagttaatgtagatgactcttgcatcaggcagctggttgttgaattggtcagtgagacctttcagtttgttgttgaatatttgatttgcagaattgatcttttccacacatgttttaccatctgggctgttttgggccaattcatttgggctgcaacctatttggcctattccaaacaacaccattttccttgctccataattgtacaaagactgaatgacaaacacaaacagtcaatatttcaatttgtggagctagctagcttttcaattttcaatttcattcctgactttattgtaattgaaaattaaatggctattttgaacactgcatgttactactatattataatagaaaaattgatgatggtgaatatcaaatggtaaaagacagagagctaaagactaacttttagttgttcagtatatgcttgaataagaacatcagcatactcatctggtgagtactgcctgctgctggaatagaattgaggcatgaaatagttgttgaggtaatcattgctacccaacccaattgagtatatgcacttgctcaagtaatttgcagctgagtcctcacttcccagtaaatttaccacttgagacaccgtgttttggtaattttgcacctgcccactaaaactaatacgccctccctacaaaacatatgaacaactttagaacataaataccttaacaaatgaagattaaaaacagtgatgttgcatgaagcaaaaggaaactataaatgggtaccagttgctgcccagtttcctctctaattccagcagcagcagatgcataattgactcctttgagtatagcatcgccactagcatcagcatatggaggtatgtaatcatcgaatcccaaaagttcagctgttaaatttcaacaagttaaaacactagtgaaacctttctatgggcatatacttacaagaatcaatttatgttccagatctgcttttctcttgtacttgtttgtttttaccaaatcagttcttctggtaagtaaccatctggcagtaaatttttcctgtttctttctttatctgtaattctacaattgtacctctttgtcaatgaaataaactacacaacactctagtcttaaattgcatattgaatgcggcaaacagatccatgtgaatggaatttaaggatcagtcacaagcctttatgaggggtatctaactcagagtagtgccaactctagtgtcaaaagtcttgctttttttcaatgacatctgcatgtgactccttttttaatttttttatttcaccggtaaaaatattaatgcatctttccttctaggtggtgaacatttattgtctgattatagcataatacagcttgtcatccaatagaaaattatgcatgcatatattaagatgcttttagttgcagttaattgataggttcaaagatagggaagaagaaaaacagatcttagaaccattttgatgccattgactcactataactatgatttttacaatgatgaattgatgattattataagtgcatgcatgtgaatctagttttaagaccatgcaaagatgcaaacgagtatatatttcaactaaaatgccgacatgcaaagtttataagccaattaagcaagtgcaagctcaccaattgcatcaacagtggttttcccattggaaaaccttccagaaggtccatcagggaagtcaatcccataaggcaagtaatcagccctagccaaagattggagctggttgttgttcccattatcaaccaaagaatcaccaaaaatgaagtagcatggcacttgtggtgcaccttgaacaccactccacaaaccaagagaaacaacaacaatgagtgccaacatgcttattgtgagattcaaagctgccattggagcaagaaacggtgttgcttgtgaggaattgaagtgaataatctaggtagctaaggaagataggggcatgtgtgagtgattgaatgtggaaggtttgacacgagtataagtatatatagtagtagagagataaggctctatactagtagtagtctatagtgtaccttttacggttgggagtgttagttaggtgcattaaatggacgcggatataatgtgagattgaatgaaatggctccattactaattaccaccccaccacctcggatctatcttggagaggggtgggccaatgcatcatctcatttcaataaaatcattaatatttattcaaagatattatattttacacctcctaattttataatttgtattccctaattttatatatttgaacttttttacctgttcacatgtaagaataagtaaatatatcatcttattttgataaaaagtgcacacatatttatcttaaaattttatattttatatcttttattttcgtgtttgaacgtaactatttcatatgataataataattattaattttttattttttaaataaattgtcccactgtcccatattcctatatccaccaccgatcccatctcattgatgaaatcttatcactgatgttatccaactttaatgtagacttgcatcttgtagggatggaaatttggacattacaacgactggttaaaacacttaggtatgatacgacaatttttatacttttgttttgagtttttcctgaatgttaaagtttagcttagtatgggaatttcaaaaattattttctggaatttaataagtctggaaattggttttcaactatgtttcttactggtttcaaaaattaagtttcttactgaaatttttctatgagaaagggtggaaattcaagatttatgcaaaacagaaaaagttttttttccataattatgtctttcatttctgaaaatattttagacatattaaatatatacatataaattataacagtcttttagaattttcttactaaatattataattttcaagaaacatgattttttttagtttattacgtagtacataatattttagaaatactacgtacatatataatattttggacatctatatacttgattttgccgtgttcaacagaacgagctccaccgcacgacgacctctatagatctagatgccacatcgtctccctatatgtatccatagcaaactcgccacaactgtccaaccatttgaagttcatgcccaagaaagaagagaaagataatagtattaacaagttaatatatatatatatataatcactactataaaactgtattttacgagtcaaatcatctcaaaaacctcttaaaataaaatgcagcgaaaattttgtaaataggagcgcacaaaacaatgacggttttacgaaaaccgtcgtagtatgcgcgctgaatttactccttcgtcctcaacttaacacgcattcactcactcaccctcatcgtggttgccctcactcagctcgtgctcgtgctcgtgctcatgccttccctcattgttgccgccgtcgaaggtgtcaccattgtccctaaatcgcttcctctatcttgtcccttccttctctctctccctctccccaaatacctcctctctctatctccacgtgccgccgcaccttcgccatctgcgccgtatcccaaaacggcgccgaaaccgtccccgtacactacgacttcgacctcttcaccatcggcgccgacagtgacgacgtcctagccgctagctttgctgccaactacgttgcttccgtcgccatctacgagcttcctttctccattatctcctctaaaataaccgaaggcgtcggcgaaacgtgagtttctgattttcaatgtttttcagtttcgctttttattgaactagggtttataattgtgtaggctagtgaagcagagtttcatgtttctgaagattggttaggtagggtacaggctaaccaagctttttcaacaagctaatttgtagaagctcatttgtttgatatattctaactgatggtataataaccttggtgaaaaaaaaaataaattactgtagcagttactgtagcccacgcctggggcgtgggaatccatgcctggagcgtgggaagtgctccagaaagccatttttggctggaaacccacgcctggagcgtgggaagccacgctggaagcgtgggaggcacgggagaggcctataaaaggccattctatgcgatttttgggggaaaaccccctttctccttcttcctctggcccaggcagccattgaagggcatgggaagctccataacttcatcacacctcatctaaacacctccaaatcactaataaacatgagagaaccttgtgagagctaagttccagccaagatttgagagaaaccccaattcctgaggttctttagagagaaagctgagcttgagaagagaagaaggcgcttcttggatgttggagctgggagaagggattctccggccttcttcaacagttttgaggtaagaaactcaactttcaccgtttaatttgtgatttggataatggggtgaatagtaaccaaattgtgatagggctggaattaggcttaggttctttagggagatgtagtcaggaggttgttctgagccacatggcatgttgaatctgagattgtgatgaagcttgagtttggctctgggacgagagaagtgggtgtgaatgagctatgttatggcctgaattaacttaaatacctttacaaaagtcattcataaggccaaataaacggtgaatatgtattaatatgtttgatttggccatgtttggtatttgaggaattatgaatgaatagaccattaaattgactgatgcagagtcttaccaagactctaagaccatggtcaggctgagaataatcctgttgaggatctgtaagggggcctatacagtgattaggctgataaccttaagatagacgattgagggattgtagggaaagaatcaggcttcctttcatttcaacggtcgagtaccgttgttagatacctggtatagtgttctgatgtgactgtgctgcatgatttgaataggacaaggcacgacaatgtcagcagcatggactagccagatgaagatagaggataaagcatggtcataccaggtaagttcagtgtttcttggggtgattcctctgcttgggggtcactatttactgaattatgtgtcgtacggtgaatatgaacactaggttagtgttctgatttcttattagatatcattatatgactgttgatgaggatcctagcactgtgatggtgttaggcatgatattgttggtcttataggcgtataagacatgtatgtgtgatagctagtgtagttaaacactaggatagaggattaagctgtattgggtataagagatataccctgatgttctagtgatgaaatgaacactgtgttggtgttcggtgcctgatgataagctaacactgcgagagtgttatgcttatattgttgatagttctgtatgacatgccagacaccttgatgatgtatgattatgattatgttagtaaaacactgtgatggtgttatgatgtgtggttaaggaatgccattatggcatattggtattgatgtagattgacactgtgagagtgtcatgctttgtattgattatattagcataatgtatgctgtgttggattttgattgatgataatgatactgtgtgttatgattgcatgagcattctctggccagagaatagtggactatggaccccattgggaatgtgcccttaagtggatgatctcccttgggataatccataggcgtccatgtaaaccctgagtagatgtgcctttaagtagatgatcctattcaggtattgggcggcaagtcctgagtagatgtgcctttcagtagatgatcctactcgggcctgagtcctgaatagatgtgcccttaagtggatgatcctattcaggtcctcagtgtgaaagtcctgagttgagagatttctcaggcattgtgtgtgaaagtcctgagttgagagattcctcaggcattgtgtgtggaagccctgagttgagagattcctcaggcattgttagagttcagtgaggttctgggggaattgtgtttatcagatgatggccccaggcgtgggactaagttccagagaacttattccctggatatgtgtgacacctatgatgaatacatatagacatgagatgagataagggcacaggccttgttaggcacccataatatttagtatgggagaaatgcttgatagtgaaccagggggaggtaagacctccaagaaccccgggcttactgagattttatctcaccccgtgtggggtttatgttgcaggtgcgtagaatagaggatagatccctggggagaaaccagtggagtcaagcagggtaactgtttggattagcatctgtgagcttggagctccctgtggcgtatacatagtgaggtagtttctgtctcctgtcatatctatattgatatggttgttatctgcccggttcttagttagttttgtttatctggatcaataagggctagttatagttatattgtgatactttattatgtctctgttacatgctatacataatgtatcaagaaatacgattcttacatgcttccgcagcttattttatgagattctgatattataatgatgttaacacactgggtgcacacggggtgttacagatggcattctatcattggttctgcttattcttaatagtttttaatttaatagttccccacttcccctacatctcttttgctatgctactagtcaattgttcaggaacctcattgaattgtaaatttatatatccatattaaagtaaagagctattatggtgaaagcacgttgttcccaacttctattttatttattttaacatgtcctgcatatcagaattggtttctgatataacataataacattatttgatccatttagtttatctactgggaagggcttttggggtggtagtttgtatattatgtatatccctctaatcccatatatattttccaacttttctgcacttgataactcttgaaacaatgcttcgggtgtatgaaacacatgcccgactggcactggaatttggggacctgtttgagtataatcaggtttgttctgtatattttttgaagaaaagagacttttatgttttaattcattttagtctttgattacttttttgtacttgtttttgcttgttatgattctgtttcttcttttttttcctgagatcaaggattaatatacttcattaaaggcagtcaatgctatgaagtagtgaattataattttaatcaacgagtaaactttggtcccatctttgcttgttttggaaataggaatcatagaagttgaggatgttattaaccttgtaattggactttagatattgaagctatttgtgtgaatgtagtgtcaatctcagttgcaaactctttatgccgaaggcattgaggggtccgatatggattttgctgcttaaaacttgctttgtgtcataatgcattcaaataataataaagatcttgtagcaaggttagccttacatgcttgcttgattcttttttcaaaaaaactattagagctgaattatgtcatgtgattcatctatctgaatttcgtgatattattgttaaaatcttcattattgaaagttaccagattgagtcattttggagttatattcccagaaacatgctttgataattgtattatgtttcaccatcagaatattgtgctaatattattataatctgcactgttggaattttctagtttgggtcctttgggagttcagttccctgaaaaatacgttgataatttggaacatgttattaagaatttagaaaatggtttgtgagggaaaggctcatatcaggtcctgataagcaaacacaaaacgggatcaatatatatcaagtctttcaatggctatacgtaaatatatttccttgaattattgtgataatagtttaatgatatagtctcaaatattttgtcatgttatcatagaatgtcacgaatttgaatgtttagtgtttgtcaataccaggttatctcacgaagcaaagaaggatgaagctgtaaaacatgcccttgccattcgtgctgctgtaacttcagcaaattatattgcattctttagactgtacaaaacagctcctaacttaaacacctgccttatgggtgagtatttttaattaactggtttttgtagcttgttggtaacacgtaacatatatgttaagggggataaaatgaaatgaattttttaatatccacagatctctatgttgaaaagatgcgttataaggctgtgaactgcatgtgccggtcatatcgcccaactctacatgtttcatacatttctcaggttcttgggttttcaactggcctggccacaaatggagcaagtgatgagagagacacagatgcattggaagagtgttcagaatggttaaaagcacatgggaccaacataattactgataacaatggagatatgttgctagatacaaaagtatgtttgatctctatcttttgtattcattgtcctgtaggtgctaatttgctctgtgaattagttaaccgttagttaacccatacaaatctagaattccctagttactagtcaactttaacaagtgttttcttaacctggttaatggttgtggattggtgatttaatgagaaatgtttaattttgcaggtttcatcatctactctgtttgtgccagagccagaggatgttgttggtgttgctacctgtcagaatatatcacttataaaacatgtatgcaaccatggatgatacagatattgaattgttacagcttaataaaccttcttcacattcgaattgtgaactatgtctgcagattagagattttgtttcagaacaaatgtctgtaagaggtattgaattccataccgaggagtctccccaagctatcacaaagtcagctgatggcaaattctctttaaagaaaccagcgggtgcctcaaggtaaggatggagttttgtttcttaaaagagttaggcacatactgcatttaattttttaatggtgaataagggcttcgtttgagaagaaatgctgttttcatctctagttcgccacttgttattatgatctcatagtcgttgttaatggcagtgcattgtgtatagtaaacttggaaaccacttttgttttgagaactccatggtattcaaatcttcccacattaattgtcttctatatatttatatctataacatgtatattggagtccaagtaatgtaaaagatataaagaaaagtgaaagtgcgtgatatatactcgtaaaatatacgaagtatatcattatactaattcttcagtatcttaaatatttttagactctttggtaaaaataaaaaataaaaaattaggtattaagattgtctgcataatatagaagattataaatttatactaacaatataatatattatattgatagtataattaatgataacatatattaatatatgtttatctgatatatatgttattattattattatttgtaatatttacactaggactatatataatttctgttacataaaaaatatagcaataaaaaacttaatgcgaaatcgttaatatatgatttcacaacaacaaaaaaatcattaaatatatgatacttttataaaattgtgatattaatttttcaatacaaaataatgtaatatacattttacataaatgcactactactaccaaaaaaaagaagctctttcatctaaaattttagaaagttaacataaaatatattaaatattaaaaaaatattaattcattttagctgatacaattaattaaatggactcataactattagtttactttaacaagtttcaattattatttactttgattttttaataattttatatgcatgttattaatttgtattttttatattttatagtggtttggtgatagaacaccattaggcatgaagaacataaaaaaaaaaaaaaaaaactgaaagaaattggcaacctactttttagaagttaaaaacaaattatttagaggatataagaggaatttatatattggataaatgtttattgtaaatattataatcacttaataatttattgacaattatttgagcataaatatatttatttattacaatttgtttagatctagttttttgaatttgcaagttaaatttgttgtaaaataaaataaacattaaaaaaaataaataacattgatttctagaaaatcatcttaaaatatctattttgtaataagattttttgaaaaatcatctttaaatcttcatgttttttaaaattttaaaaaaactaacacagacaatttctaaaaaacattaatgtaaaaatcgagattttaaggcgatttaaaatttttatgaaaattgttaattttttatgcagatccaatattaaataactgtctttgaaagacttttttttataataatgaataagggtgaaccagtattttaagtaataatatttttctttatttttattttttaaaaccttatcattttattatccctctatttctgtcatatttttcttcaatcaaataatctctttaatttctcttctcatctttttctttttttcgttctctccttttaatttcatcctcacaactaaatgaccccttaatgaacacttaggagatcagcaactgaattatacgctggagcaaacaatgaattaatgaagtgagatgttggtatttgattttgacagaatagatgtattttattttagtgactgaaaatatatgtacgtgttaataatgtctacttggatgccttgcatatcatcgtagtcatctcgtattaattaaataattggtcatgcgaatggcaagtgagttacaaatgaaaattactgtcaagttaacgagagagtaattaaaacgtagaaaaatgctagaaatacttgtttttctgacagcaatatttgatctgagtttatgcaaagatatggatatgaatgcgttgtaaaatgattagatcatctcaaaaccacagatataaactttttaacttataaattataatcgaaaattcataaaaaaaaataaaaattatatcccatatatcaatcattagatggaagtgcatcctacatgcagttattttatggaatcctgaggatacgtttccggcattacgttggagatatctacatgaaagtaaatgtcaattaattattgtgaataaaagaaagatcgactgcctattattacctcaaacatgcactagaggatattgaaggacgtatttcaccccagatttaactagcaataactaaaattaaataaataaataaattttaggccaaaatataagaattgctcttaagaaataatttttataacataatttatttctatattataactttgattttttaatttcaaagaaaagtgttactgttttgtacagcttagcacatagatcaataaatatataactatttcaatttatccaattattttaacttttttttaatacataacttaaatatttataaaatcagagttatctaaagaattataagattgatcaagtggttgaggaaaaagaggagaaagaaattatggacttgaatttttcactaacaaaaattaatagaattaatatttatgtattaataatatataaaattattttatattgtcattgatattgctgtatagcctttttttttttctcaaattaacagactaacaaacatccacagataaaaagaatcagaatcacccaccagattaattgacatgaactatggcatgcatgcatgcatgcagcagctagggtaggaacagcatctacaaattaacgactatcaatccggtctttccaatcaatgaactggttactagtgattatggcccagcggcacatgctcagaataagcatgtctttttctcgatcctgacctaccccttttgggtttcatgcatgagatggtaatttggaaagctggaatgatcaaattataaatatgcccccttttatttgtctccttcattgtccctctacacataactttatgacacggaacgaaaaagacaacgatttgatatataagcatgtcttaataaattataaaatcacttaattttttttatttaagactctcaatattaaaaaaattctatatattatgactcaactaatttaaacagtcattaaggttaatcatatttttaaatagaataaaaccgttttttggtggattaaatataataaaacatatgacgacgactgatcaaattaattgtgactaccttttcagtgctaatgtgatcgtctaataaaaagacaagcaaaatattagcgacaacttgttattaattagcattcgataacacttatttaaagttttttttttattctaacagtttgatccattctatgaaatcatatcacccatgaaggttgttaattaagattcttctatctagcaacaccttaattaatatggcataaccttaaaagtttgttaaggattagattcaaaggggaaaatgatttatgatgaataccttgacaatcaaagacaggaaacagaataataactgacatttttttattagccaaaagagatttatttataaggtaccggcaaacgcccaaaaaatgatgatgatttacaaagacctaccccctgcacatacattcactagcttagcaattcaactcgaccaattgtttgtattcccaagctcataaatatccaacccgagacatcaacatatcgcataacgcatgttgatattcatccaacaccagtttagacccgattgaagccatctgatctcattttcctccccattacaataattcccatccatcataaatattgtagacaagacaaaggatttgaataccactcagaataagagaaatgaaaagctttaagtttagcctccaaccatgaccaagactttatattttattaactccatgacagaaatccaagtcaagtaattgacagcggaagatgatgttgtttctatggcaccataataacggacataatgcaagggggaattgaaaataagctttaaaaattctttaaaaatccagaattttttgagatgaataatcgaattcgatcatgaaattgtaagacgtggacaaatttgtttctaaaagataaaaatttaaatttagtctctaaatgtgtaaaaagtgtaataaattagtccaataaataatttaataataaattaattcctaaactttataatctaatgtcaaattgatcctaaaaaatataatttattattaaattggtctttaaatattataacttaatgataaaataattttacaaatttaacatcatgattaataacttgacgcactttttacatatttaggaattaaatttatattttttatttttcatttttcatagattaatttattatctcattacatttttaaagataaatttgactttttttttataatggtaaaagtgaattttaaactactagtacactagcttattaaatggatactttcaccccctaactttaggacgacaagtgctctcaagagtcaagatataaatttggtctgcggaagccatgcaataccgtgtagctaattaactattcctatatacagcatcataaatgctagtgggtcgaagaatttaatgagtttgtctaagtcatacttagtaacgtgctttgttttgagtacttcattattatgcatttatagcaaaaagtccacactccactctcttcaattcatggatgtttatccaacattgcaagttgtcgttgacgtttgcctagggctagaggttagctttttggatggcttttggcattcaaacccaatctgcaaccgtcatccttagtaatgatcaataatcgctcctacagttttaacaactggtactagtactagtagtaatattttttttaagccaaacctcttactattataagaaagaaaaaaagtaactaactaactaactcaaaatgaaattatttttaagaactaatttatagtataaggatttgtttcgacatgaactctttttaaacatttgaataattattaatatcttataaaaaaaatggatcttatatatacatatatatgttcgtttcctggaaattctcaagcgcatcttagttttgaggtaaaatttgctatgataaaaaattatttaaaagttagtaattttcttctaatataactttttcatattttttcttctccttttttagtttccatttccccttcgttttgctagatctaaaggtatgtaattatagggattgttgacttatttaattaatggtcggtaccaaaattttcaaatttaaatgtttaaaataaaataaaatgatttttatttaaaagaagttgtacatcatacaattagttaagagtaaattataaagtactagctagtaatataattttatatgaatatggatcgttgacttatttagttaacaatcggtaccaaaacttttcaaatttaaaaaaaaaatagaatttatttaagataagtttgtagcaaacaaagtttaagttaagagtaagagaaaaatgattatacagtcatctcatctaatcacaattcaacaatattaattttattgacttttaaaataattattttaaaataattgaagcgattagatgatagtgtaaaaattttatagtatattgacattaaattctaagagtaaatcataaagtataaactaatataattttatttgaatagtttatctaattaatacttttaaaagatgtgaaactgctttggctagcgaactaacaatatatagtactatttcttacctaatgtctaatattcagcacggggatagaagaattagtgtttgatattttcctgtatttattgactgtatcatccccccaaaaaatactacaatagtactataatattgcaagaaaacgtatggtgcagtaagatgcttggaggttgtcactgaattgaaagcatcctgcatgttgaattacgtttgttatttcatgaatatgcacggaaaaacccacatggcagtgacaattaagcagaaattttctttatatagtacgggatacttttatcagaattaaaaattcccccctctttgagaattgttctacattaatttgatcacattcgcttaaaagttttttaatattttttctgaaagaagtgtcccagctgtgaatcttgatgttgatcgaatcatgagccatgacaacgaatagcactcattagcatgtgattacaggctgactcggttgtttcataaataatccatctgcctttatgtgtgtttcccttttttgcaaatctctaagactattcgaataagacatgcatggtctccccattttttgagatgtaaaccagacatgttcaaatatggaacactcaagtaaaaaaatgatagtttcttttttaacaagtaaaaatggaagacattgtcataagatttgtaaacatcatgatcaatcaattgaattatattctcaactaaaaaaaataatcttttatttataagaatcaatgacaatgtcataaaaaatttataataattcacacatctttattcaatcagttagatcttcttcggacaaaaaaaatttaatgactaaggagacatgtattatctattttataagtttacattcaaaatttgagttaatatttacgttatacattactttactgatatttaaacacataacacactttgacttataaaccccataggattagtattagagtggagtaagacaaaatcttcttgtatatgaatatgataattaagaagtttcttgctaatagctatgtagtatatgaatgttcttttgcatgtatttcatgggtatgaaccaccacatgggcgtaataatgagccattgcccaggggaaatgtgctgtaacgttttcttcagcaatgctaggctgttatacgcgcgtggtccaacacaaactgttaaagcctaaattaaatcctaatcgtctctagtctttaatgttcggtataatgtctcttgacttttgtttcccttggaagatttgaactacgcgttccatcatagaatgtcgcatcctggtggcaatagacttattttattcatatagccttttactattctttatgaatagtaatggcaaaagttacaataatactatcataactttaacctagaattcttctataaaaaaacactgacctagaattccgccataatattgggccaatgaggttctttgtttttacagagccgatgagtttcaagatcaataaattaggttattagttgactttagaaaaagtaaaaaattgatttcacaattattaagaaaattaattaatttcattaaattatattatttttaattaaaaaataatttttttaaactactcccattggaacttgatatatctcattaaacgaaggaaaagtagtaaaagagaacaaaaaaaattgtgtttttgtttataaaagagaatggaagagacatataagaacattaatgatttttagcttgatatctgatttttactaaatcttctaataaaggagttgaagaaatctctaatatggataatgagttattataaaaaatctcttaaaatctgcatattattccaaaaagaataaattttatttcttttttaatcttcctaaaatctcaaaataaaaataccattaaagaaaaaaatggaagaaatcttgaaatttttttaatcatatatgacattatgggatctaccaaaaaatagtcaaagatcctaattggatatctactactaaaaatactctaatacttgttataaataaaatttcacctaaattttacaaatgtatattaaatttcagtttaaatcaaatttatatctctttaggttaaaaaacgggtacatgactccctctaactactatcagtactttgcggtgtctgaccacaattctttttgttgggactctgatccctctttttgctcccattaattactatgaccgcaatttcaatgggcttcttaaatacagattttgctgaccttccatgagtttcggcctgttccttctatgttctgttattgttctttctcttttttctataaatttgggttgggttttgatagagtatctttagactaaagggtatcaacatagtgaaatctgcttcctacaccattttcgtaatggtggaatatccaaaatatttttcgagttatgcttcatacatattcgcataataagtttttttttttatggtctcgaacctgcgaccttcacgttattaatacgatgctccaattaactgagttaatagactaattatgttgatacatataacactaaattttttaatatatatatttaatatacatataattttatataataaatttgtaacaattaattttaatctaataattaatttatagtttaacttatctataaattttgttttgtaacatatattgttacgaaataatttatagtttaatcgcatgtttgataaattaattattagataaattaaactataaattaattattagatcaaaattaattgttacaaagtctattatgtaaaattatatgtgtattaaatatacattaaaaaatttagtgttatatgtatcaacattaattattttttaatataattgacctattagctcatttggttgtatgaattatgcggatccgtatgaagcataacacgaaaaatatcttaaataacagcacaagtaatccaacaaaaaataaaagagagaacgtgtgtgtttgttttaagactcttgaaatcttcccctttttattttcaaaacttgttttcaacatatttttatattaaaaaaatatgtatagattttaaaaacaaaacaaaagaaaattttatttgttaatttctttttcagaaaacagattttaaaaagaattgtataagataacaatatatgtcaattacataatcattattacatatctgacatttaacaacatttttttgtctaatatttattaaaaatgttactaattttttttggcaacattcaaaaaatattgtcaaattatcaatgtatgttactaatatgtttttgcaacattttatcaaatgttgtatagctcatattgctaaaacctaaaaatttcacaaaaagactttagcaatatggactatatgcaacatctaataaaatgtcacaaaaacatattaataatatttttttcataatttgacaacattttttgaatgttgtcaaaggttttaaacaaaatttttattaagtgttagacaaaaaaaggttgttaaagatcatatatgtagtagtgattatacaagatcaaaagggttctttatttattacaataaagcatcaaacttaaaactaaaactacaaaattaaattataaatctaattggcatgcatgcaattgatctttttctaagagttcaagttcttttaaggccttatgttcaaagtagagaatgaactctttgtttaagtgagtaatgacttcagtgtgtcttaatgctcaaacaatggcataaaattcattgtcatgcataaaatacttaaatttgtcatcattatataattaagtttctcataaaaaagaaaaatataagattggtctagtagttaaaaaagagatgaaagaagaaagaagaaagcaaagatcacgagtttgaatctctcaactaatatttctaaaactataaactaacatttgtcgataaaaaaaaaaagtttctcatgaaaaatatgccatgacataaaactcattgccatactaaaaaagaaaaacacttatagcttcatttccctcttatcttggtcaactttaccaagtagcaagggtgcttacttgattttcaactcatcttttataaagaagcaattgtttgcataattgttatacaatgctcgatagtcttattgctcaagtctcccaagaagatgacatgcatcaaaggaaataacatcacatcctatatgattctatgatatttccaagcagatgaaaaatatacaatataacatttagaaacttttaccttactttctttgttatgtcattgaaacttgtatggaagtggatgtttttgtgttgataacttattcaccatgtagttttatactacattttcacaccctttgtttattgtaatactagtatggtaccaaattcaatctatagtagaatatttacaaaaagataaaatttgaatttcaaattgcacccacaaatgatataaatactaccgttgcaatagctttacttacatcaattgcatatttctacatgaatctttcaaaaaaaggactagcttattttaataaatacatccaaccaacccaatccttttaccgactaacatctcagaaaatttcacaaactcttatctcttagtttttgacattttggaaatatattagctgatgaattagtaaatgttgttcttgtttctttagtacctttagtagttcctatacatctcatgctccttggattattcacaagcggtattcaagctctcatttttactactttagttgcagcttatatagataaatccatggaagtagaagaagctctggtgggatcctcacgtatagaaaaagattgtagttagtttgataaggatcgagtgacattgcttctttgatccgaaccaaggaatctcttaaatattattcaagataaatcttattctatcattgatcaaaggtttctctatgaaaaatacgaatcggagtttgaagggggggagtcctcaacccacaacaaatagaggaggatttttcaatcacatagtttggtctcctagaatatggtgcccttaagacttcctatttgaggggttaacttctcacacccagccaatttcccatacacccagccatgaataagggaatttcgaaaatgcccatcttaaaataatgcataaagtgggtgtttcaaattttttcttatacacccagcagaccaaacgctttctttgatcttctcagctccgttctcctccgctccgctgcgcccttcgtcttctccgttcttctcagctccattgactcccatcttgtcgtcattgtcgaatccgtgagttctgcgttttatttttttcatttctgctatggttgatttggatatggaattgttttgatggatacggattcccaattcggtagaagaaatggaccaatccgtaagaagacgtcgtatccgtaaccctatacggattggcaatccgtgaggtaaacaaaaggcttatcttttaaattaatgcatttgttagagccccaatgatttgagatttctctattgggccaagtcatttagggagaagtggatcatttatgataaagaggatgagttttaagagaatgatttagagttcttgcatggcagaaccatgcaataccagacacgagataaatctttcagagattagagcttttttcaaataagccaattcatttgggactcatagattcactctttttcctattaaaagataagccttttgtttatgtgtaaagttagtgaatataataatagtgtgtagtcttttggtaccaaagatgagtagtagcaggtctactgtataaagttgatgtgaagcaaaaacacttcaaaaccaaacatatcttgttgatcaagctagtacttgtctgtacggtaaagaaattgcaagataaattgttttgtatataataatataatgttatatgataaattaatctaataaaaatatgtgaattgatcaaaatatttttcttttaaaatttaaaaaataaaaactaaaagatatattttaatcttatctaaatatataattatttaaaacaaaaaaatgtataagttattattgtgaataagcatgacaaacgcgtgggagatcaggtatatttcaagttagtttgctaagaagttagttagaaatgtttatcaaatcaatgatcattcaatcaatttatacaatgttcttatatgatactcctctactatatttcaaactttatgggtatgatgacattatgtttgtgctagttgtattttttttcaaaccatttcatctcaaatttctaatactaatcaatattggttaacgcttcaaaaccaccactacactccggaggagtattttgtaagctacatcaccagtaatataccaaaaaaatgtgttcgtacccggaaaaaaaactaaaagtattaacggttcattgtttacaacaattcaattttttttaatatcattttttagatattttagtttacaaaagaagtagggatatgtcacttccccaaaaatatattcaagaaacccgaacccgtaggtgcagatcgtctttttatccattttctgaagtagaggtgttgatatatcacaaaaaaaggtgttgataaaatttaatttagatgatcaaatgcattaatttaattttggagatgaacatcacaagggggaaagaagtcagttaaggacgtacgtcttaaaaacttaaaaagaaaaagaaaaattccatattccatataagataatattggggtacccaaaaaaaaaagagatgatattattaaaaaaattcttattataattataattttaatttactagaagttataagagaatataaaccaaattaattaaaatattcaatgaattcctaattatagtaaatgcatagtaatttttttatttatgagaaaaaaaattctagtcaataatcaaccatttatttatgacaaataatatcgtattaaatatttttatgttgacaattgttatcttccgtgatagaaaattttaaattgaaattataattcttaattcaaaatagggtttgggttaagaattgattgcaaaaatctgtgtcataaatacaatattgatttaaatggtcaaataatcattaattatattttcaatcaaatcattatgttcaaatttaagatagtagtatcggttttacgaaataatcattgctttagaaattgtcatgtgtggagttttcttcttcttttttcaaacattttactttttatagaacattttactttttttaatgcaataaaacattttactttgtatatagtaacattttctttaacagtgtatataataacatagaattcaaaaaaaaaaaaaaagtaacatagatagatttgttatcttttacacgtatctttttttttagggattttacacgtatcttaaaacacacccccttcccaaaaaaaacctaaatcataatggacaataattataaaaataaaatataaatcataagggacaattttttaatatcctacgttgatgttcactaattaaatcattctccaatttcaattcattgtattcgcatgcatggctagtctttgattggacgagaatgaatagattaatctaacgcattatactctttaatgtatgctctttcaaatacatgatcttctttttccccttcaagccaattacctcgtctatgccttttatctcttcattgtatgggtaatcttccttgttctatcatggccaccacccttttgatcacttctacaaaaccacggtgtgaaaacaatgtggagttgtggtcagtaatgtgaagcgaaatcatctcacgaaatattctacattcttataattatcaggttacaccctacctgtaatgggcatattttggctttcaaaattttcaacaaaataatgtctcaagtaggtatattttgttgtctgcgttataacttgcttgtgttgcctggtgtcattttatccattattgtaaatgatttatttatttaacacatgaaattttgcaaaatctgctataggcatgttaagggtattgttaaagatatgattagatttgctgattatagggatttatttccctctttcccttattatttttatcccttcagaacacacaattccagcaataatactttttttttttgtgctgaccggcaatacttgtttaggtatttttgaaacagtattttgttttggtagtcattcaattgttatgaattttaagtacatttcaatattttgttcacgattcaatttcaggaattttctgatccttgtcttgttatttgtctaatgtgatgagaagcattgcgattatttttatgcctgatggttactttacgcatatatcatcagtatgatttttacttcattgtcaatagagaagttgttttagcctattgagacatacaacattgactaatgacaatacaatacgtggatcaaagcatgcatgtgttagttctctagagtgcattttcccatttggtaagtaatagaaatgtgggaaactggaaaaaatatgtaacaaatgattggagtgtgcaactattcccgtgtttatttgagaatgtgattgagcattatccattgttgaatatttgaaggtaggaaaaataattttaccttttgagtaagaatgctgtctttgtaggaatcaaataagtgaaaagacttaacatggaaaatttcaggccaagcgtatgccagggaacaattataactgcgtccctttaacaccaaggtctagattggaaaggcttctgagggaaagagagctaaggaaatccttcaagcttattcaaccaaccgaggaagcaagagatggcagcaacgagggagaacaattttatggtgattcatgcataagtgagaacgaaatttcgggtattcataaagaggaagagatcacggaaacgaattttacagatagaagccaaaggcaagatgagaggccaagcaaacaacgtttgttggtggtagctaacaggttgcctgtgtctgctgttagggagggtgtggagtcatatcgccttgagatcagtgtaggcgggctagtcagtgcacttctaggcaagaaaattttgtcaccttgcactaattgtttctttggtgtgttttgttaatttatttattgtgaagtttgtaattgcaactcaactttgctaattagttacctttcttgatgatctcatagaggtcacaacaatgatagttatcttcacaacattctaataataatctattacttataggaatagattgaatttttctatttttaaagtgaaggttgtatgaagcttgttgtttttgttgaaggtgttaaggaatttgataccagatggattgggtgggctggtgtgaatgtgccagatgatgttgggcagagagcattgacaaaagctttagctgaaatggtattgactcaaatttataattcacaagcatgtggccactgatcaatgtagtgaataatgataatctagcaactcttctctttgcaataccaaagacacacacaaaccatcagtaattatgcgttgttaactgcagcgatgcataccagtatttcttgatgaggagatagttaatcagtactataatggctactgcaacaacatcttatggcctctgtttcattaccttgggcttccacaagaagatcgacttgctacaactcgtactttccaatcccaatttgacgcatataagaaggcaaaccaaatgtttgctgatgtagtaaataagcattatgagaaaggagatgttgtttggtgccatgattaccacctaatgttccttccaaaatgtttaaaagaatacaatgaaaaaatgaaagttggttggtttctccatacaccctttccttcctcagaaatacataggactctaccgtctagatcagagctgttgagatctgtacttgcagctgacctggtggggtaagttattctcatgcatctccaacttgatgttgattatagtagcaactagtacattcacaagctaaatttctttggtatataggcatcaagggcatgcatttagaacaagctagtccatctttagtcaaaaaattatcttccaccttgaaatttactattcttgcttgttgatggcactatttagtcaataatatcaagtggtatgttgctgcttgctaggatatttgagaactctagacattttgtttaatgttgtgattttaatattttcattggtctgcatcccagattccatacctatgattatgcaaggcattttgttagtgcttgtactcgtattcttgggcttgagggcacacctgaaggagtagaagatcatgggaaactgactcgtgtggctgcggtatatctgcatatattattttccctttctaattctatacatctaattgtgaaactggaatttcatcttgtgttgtatgtttatcagcattgaatagctttacgaatcagtatgcagtatctgatttcattctcatgatgacaatgttttattttttgggagtgtgaaacttcagtttcctattgggattgactctgatagattcattcaagcccttgaactccctgaagtccaagaacacatgaaagaactgaaagaaagatttgcaggccggaaggtaggagccatatacgccaaattttaatgttcaacaatttgagaagttgagattattcctcagttctgttctacatctgcctttctctgaaaatgtgaatcattagaatcactttatgtttcttatcaaatggacaggtaatgttgggtgtcgatcgtcttgatatgataaaaggaattccccaaaaaatcttggcatttgaaaagttccttgaggagaattcacactggcgtgataaagttgtcttgctgcaaattgctgtacctactaggaaagatgttccagaatgtatgttatttctctagaaaagttaattatcacttgaagcattttcatccattgacttagactatgttttatttattttgtttctcgtcttatcatagttattggcgtttttcatgactgacaatattgacttaatgctttggcagatcaaaagcttacaagccaagtgcatgagattgtaggacgcatcaatgggagatttggaacacttacagctgttccaatacatcatctggttggtgttttaaacatctacagcatatatgtgttgtttggtatttgacgatgcaaggatcatgagtgtggatgctatctattatttgggatctcattgaaaatattaaatttctcatgtcactactatatatgagttgatccccgttactacgagatttgaactattcatcatctatatattgtctgtgttctatggattgtccatttgatcattatgttgccaccaaaaagctgtaaattcaatgtctgggttgatctacttaattcaaatttgttattctcaatttgtgttgttagctacattctctgctggctgttttacaaaacatatcattatcacaaacatattcacgatgtctcatttcttcatctctattatttgatcaagtgatataagacaaaagtgcaaaaggaataaaaaagggaataaccattctagcagatgaacaacaaacctactagacagattctcctgaaaattaccaggaaatgaggaaagtcctctgaatcataagtgataaataggagttgcattttatcacatcttattttttacatagcaaccttttgataacaagacttgattgacaagtaaagaaaacatacctatacaaagtactctgatgggattttaattctatcaaaatttccgtaaaattacctccaataacccgataaaattataaaaattctttgcaaaattacaataaatcttcaatagttgatcttcttttgtcctgcatcaccaaggaactttcaacctattctttctagattaccttgatattattcagaatgtggagcttttctattacacaatcacttatctgtgtaatgtggtcaaacgaaaaattatttcccttccatcaaaaattaaagttatatttattttttaaaaatattcaagtaactaccttgactgttctttgcacacactgaccatgcattttgtctcgttgattacacatccttctcttgaattgctaaaattttagggcaaagtaaatacattgctaatcttcccagaagagtgacaaatgaagcgaagtcatatgtttatttatcatacagaaaatatttgttattgttattctgttgaccttgtaatgatttctggaacatctctttctatgattacaggatcgatcacttgactttgatgaattatgtgcactctatgctgtaactggtaatcattttctgctataacatacaagatttagtccatgttgtccttatttattcaaagtaataatattttttatatagaagtagtatcatatttcaccattggattggtgaaatactcaagctgtaggacattctttcttgttattgaaaaagaaatttcattatctttgcagactctttcacttttctttaatatatgttccacgtgatttaagtcctctgcttgtaacatgtacctggctgtaagaataaattgaactgattgatatttatttaccaggagatgaggaaagtcctcaagaatcatatttcttgatttttaattcatcgagaaaagaataattgaagtacaatgacttacagttgtttctttatattcacatttgtaatatacttctgttttatgcttaagatttgacaactattcctgggaatcagaaaatggcaacaggctgcagcatatcttctttataatatattataaaatccatcttaagtagttttattgaactaagtattcagcacccatgatatgtatcataccagtctgactcacatcgtatttagatgtagcacttgttacatctttaagggatggaatgaatcttgtcagctatgaatttgttgcgtgtcaagcatccaagaaaggggttctcattttaagtgaggtaattcagttttttaatgttctcatcatttattttggctgcatctcttggatactctgaatgtatttgagcttcatatttgagaacgtgatttatgttttactaagatcaccaacatttcaaatgattctgccattaagcatagtaatgttgaggtatatgtatttagctattttcataaaacagcaaaacataaaacaaatttactgtcatttaatgaataagactttcctaaccttaactaggtcaagctagcaagtcctaagaattataaacaagtttgtttttcctttatcaccatatattaatctatagcaccgcacatagtctttttttattttatttattttgaagtgtttacgcatcaatggtgttaaagtttttctagtctcaagctcacagtttggcttgttggaaaaagaaaaaaaaaactagcctagttaagctgagacgttcagctttctttttttattttgtaacctgaattgtgtatagtttgttaggcttaactatagagaaaaatcatcagtatgttgtatctgtttcatcaatcatccgcgtcgttgttgagctctgtaatgacaaggtctacttttgatggtaacctggttatgctataatgtgttcataagtatactatggtttcttgaatattgagaaccagaatttgtttttgtcaaaggctaacatttgttgaaagacatatgtcaagagaataagctagggtaacatgaaatgattgcttttgatgcatggaattgtggttgctgatagactgaaatttaaataattataatcatcttcccctatcattatcattctataatccacgatgcaatattgatgtatatttatttttcttttaaattaactatgatgtccgtgttctttatcttatcaccatcattgtgaatgttaaatatacgaaatgatcaatctattcaaaccaatatattttctgttcttagttgttttctatgtacagcccatgagtgctttacaaaaactggaatatttgtgataaagtgacagatagaaaaggatagggttgatactaggcttctagttcaagacttcagtaggaatgtaagatcatactgtagattatattctttataaagttattgtttgtctggaaatatcatcttgtttaaataaaaacaaattcttatatgtccaattattttattatcacataattaactcctaaaatcactaggctttcagtataattcaaataatttagaattctttatttggtatcagtttgcaggtgcagcacagtctcttggtgctggtgctatcttggtaaacccatggaacatcacagaggttgctgcttctattggttatgcgttggaaatgtcagctgatgaaagagaaaaacgacatcagtttaatttcaaacatgttgagactcacacatcacaggaatgggcagcaacttttgtgaggttttaatcgtataacactgcttgcattttgtttttcttggatcaattttgttccatattttatttttcttgtaatatgtaacagtcagtcttacacaagcatattagatcgaccactaaagctagtttgaaatagtgtcaatgggaaaatggagaaaaatggaaattctgtctttgaaatagctatattggtcggtctattgctctagattttgtcctgaccttctatggtggtctgtgccacttatgcttttcatgattatttattctaaaaacaaggttttatttttacagtgaactgaatgataccattgttgaagctcagcttaggacaagacaagttcctccattacttcccaacaaagtggcagttgattgttactcaaaatccaataaccgactaattatactggtaagctgtttgttagatcatcaaacactgaataaagggctgtcgcaaattattcaccctattttgtgcaataagtattaggcttacatttataaatggaaaccaacatgaccttacttatacaagtgcaccgcacgtgtttaagagaaacgcacatgaggacttatttgtttccacttgttttttgtgaataagtgagaagggttgccttctcaccaacttatgtagctccttttcactaaaacaataccattttgcctcatctgcactgcagggtttcaatgccactttgaatgaaccagtggatgcccttggaagggctggtcaaattagagaattggaacttaaattacacccaaatatgaaggaacctttaaagaagttatccgatgatccaaagacaacaatagttgttctgagtgggagcgatcgagcagtcctggacaaagtactatcaagaaaacttcatgtgtttttggattttcagcaacatttgcttttggactaacaactactttatgcagaacttcagtgaatttaacatgtggttagcagcagaaaatgggatgtttttgcgacgtacttcaagtgagtggatgacaaccatgcctgaaaatttaaacatggattgggttgatagtgtgaaggtaaattagctgcatgaatacaagtgtttctcttattaagttcctttagtttcaagtgtgattttttgtgattttttttttcatattttttataaaatttcagcatgtttttgagtattttactgaaagaactccaaggtctcattttgagcttcgggagacgtcagtagtatggaattacaagtatgcaggcatgtgaaaattttctgttaccatcttcccttttaattttcaacctacttatttttttataggactaacatatgtttttatccttaataaatatttaaatttgtttattttttgataaattttttctttatattaagtctttaataaaacaacaatttattttttatcattgtcacttttttttagtctatgataaattagtaaattttggatttatttcttaataaattttttttattaatcttttttcaaaggaactaatatcaaatgagaaaaaattatcagaaaacaaatacaaaattcactaatttatcacgattaaaaaatgtcaatgatcaaaaatcaaatttttattttatcatggaacaaaaataaagaaaaactttattaaaaaaatataaaatttggatatttattgaaagatcacaaacatattttaacacatcatctctttactcccttcccagcaaagtgggagccttctatggttaattgctaacttattgtgactgcaattaacactagatgttgagtttggaaggattcaagcaagagatctgcttcaacatctgtggacagggccaatatcaaatgcatctcttgatgttgtccaaggtggtcgatctgttgaggttcgcacagttggcgtgtcaaaggtataagcaatttcagctggctagtagagtctctcacctatccttttctgttcagaagctttatttcctctacatgctagcacctgactttttttggtatagggagcagctattgatcgtatccttggagagatagttcataacaaaggcatgaagacgccaattgactatgtcttatgcattgggcactttctagccaaggttagtgcactttatttgattttctattcttagttcacttgagactttgttattgttagagtggcagagcactaagaatgactagattgttgccttttggcagtctggtagcaatgatagaacatcaattgataaggtaataaaatataatattgaaaactgaaatcacacacaatacagcagtacacttactttcccaaagacaagtctccggcagagagtacccaaactgcaaataactacacccttcttatttacacaacttactaccaaatatatactcttaatagataactgtcagtagttagttattttatatgcatgcagattctaatatggaactacctccaattcattaagggtcctttcctaaccaacttggatctcagttcccatcacctaaggactcaactgtaaatattagaatgaaatttctaaaggagcattgattttagattgatctacatcagaaaaagttacatttctaagccttctataatgattaaggcaaataatggttggaaatgaactgtttcaggatgaagatgtgtatacattttttgagccagagctcccttctgaatcacctccattaccaagagctatgctatccaaatctaattcttacaggccatcatctctgccaaaattaccagccaccaaaaccgggtcgaaggcagctcaatacaagaaacaacgttcattgtcaaacatagaaaagagagaaattgatcaatggagaccaatgtatagtgataaaatagcattgcatgagggttcctcagtgcttgatctaaaaggtgagaattacttctcttgtgttgttggacggaaaagatcaagtgcacgttatcttcttaaaacctcagatgatgttgtcaacctcttaagtgacttggcagaacattcttcatcaccaacttaacggattgtctttttgttagattgtttttttcttggtaaagtgtctattcatatcatttgattatgcaatgccctacatgtctcttgtgagttgaatgaatctcaaactggcaacgtacttccagcatgtttggaactctcaaaactgtgtttgaaattctaacttaattttgctatataaaaaaattagttgtttgggtgtttcttttagaattgcttttagttttactcatagcacgtttaacagaaagcaacaaaaaaaaatgtagcttttgccttagattgagattttacactaaagtccactgttaacttgcgtaaaatcaaaatatttttaagttggtaaatttttaccaaaacattacaggaattgaatgaaggagtcccactcaatcattttcaaagattggttttaattttaaaaccagatatgatccaaatttaaagtagtttaaattaaatcagtttttttgttttaccccttacgtatttgttttaatgtgagaaatgaaaaatttttaaatatatatattaaaataataaagaataagatggcaaaaacaaatactataattttataacataatacggcgatatgctaattccataccaataaacacttctattcttcaattgatattaataaatgagaatacaaaacatgggggcatacacttattcagtgacatacaaaatttagaaaatggccgcctaaccaaagctttcactgtttaacaatgctcttgaacttttgaactaagttttacactatatgtggtattaaatgaagaaaagatgactaatccctaaatgaatgggtggatacatcaagaatacaatttacagctaccaaagaaaaattaactcaatgcaggtcctggttggggcagaatggtgttcaaaatatgacacaaacctcaatcaagtttagttccccttaaacaactcgaattaattcccatgagctattcttctagtcttggtttgttttggcacatatgcatattggccgaagtccacagtttttattggcctgagttaagacaagcaggacacaaatcatggtgttgatacaaaagtataagggataatgaattccagtttggcagaaatgcattacctattatcagaagtgtttcgaacatctttcagaggagcacggagaccactgacacgagtgccagaagtgcatctaaaggatgatatcacggagacaaatctttccatagacttctcagctatttctgaatactggcccagatgggaaatgtttgtcccaaatttttcttcttcagcattattctctgtaaatggcccgtcaacattgtgatcacagcaacctataatcaagaaacatcagaattcagagaaacttcagcctcagcgagatatttcctttcatgattatttaaaaaacatgcatatattcagtaaagttcatggcagatatctctgctgagcctgaataaaacaaatggaatccgaaactgagaatttactcctttttatcctcgttgaagagtactatgttattcatatactcaaagcacgattttccataaactgagcttttgctaaacatgattttacttttacttttgctaaagtttatggatgtttgaacctctctttgtgatttcctacttttccataagggttaatagttaatacttaatactaataaattgtctatcttacctctccaactcagacaactccacaagtctgtactctttaccttataatactataccaaaagtagtcaatattaaattattaattatgtttaaagataagttacaatttagaaccaataggagcttttcattatccacaaaagtcaaattgcactgaccaaaaatacaaaagtcaaatcgccatgaaaatgaaaccgaaaatgaaatttctaaatgaagaagtagtcaatcagtatgcatagaagcttctgtgggagttgtaaagccacattcttaaaagatgataatgcaataacaacatcagtggtagccaccactttggacagcaagtagaagacaacaaaagcaaagaacataattagtggaatagtaagacaattttagctaacaagtaataattcataccattattatgaggaggtgaagaacagtgcatttgcctgggctgcaaattttcctggagaaagtcatttccatcagtgcatgagtaaaaggagaaagtgttaaagaaaacataaggtccgaagtttaaaaatcctacattttgaatattgtcattaggggagatcttccttttcaggtctttattcttcaaatggttgttacataaatcactgtcagatatggcctttcttctcttgtcaatgacaatgccagaggacaggtgatcttgtttctcatcacaaacattattttctacttgcttgtgctgaaataagcactccttacaattaactttcttgttgcctccctgctctttccttcaactgagtcaaggactatctggtctttattcttcacatcgttgttacataaatcactgtcagataaggcattttttctctcatcaatggcaatgccagatgacaggcaatcttgtttctcgtcacaaacattcttttccacttgcttgtgctgaaaataagcactccttacaattacctttcttgttgcctcctccatggtttttcctttaactgtgtcttggacatttgtgtgcccattcaaccccagacatggtttatgaattggctgcctgggctgtcgcagtactgtatgttcagggcttttcttctcttcacccaccatagacaattcatgcaaacaatgaaatgagtaactaacacatgtaaaggcagtaagggattttcccatccaaagcaaaccagcagatttatatcttaccatgacatggagactctgtaaattcagaaatgtttgtggcagaactatatcgaatctaaagaaagaaggaagaatatgtttaaaaaaatatgtaagtctcactaccaacaatgagtagagttttcactgttatagttcaatattcaggcaacttacatggctattaggaggaggggcactgccccaattctcagagtcaataaccgatgcagtagagttctttgtttcattagcagcagtaggtgacacccgaggagctctgaatttccttttcgcttcaagagaagtaaaacctttcatggctaaggaaaagctactctaaagaagaatagaaaaaaaagctgctagctacaagtggtatgttgtaaagaaacattgagcttaaatgccactgaaattcattgcctcaacttgattgttttaaatgttatatatcttgaatctaaatttttagaaaactggtaactaaagcatcaatagcatcaggcagtatcccagtgaagcatagaattctgccctgcattcatccccgttaaacatgctaaacatattaaaatcaattcaagaagaatgctttgtaggatacaaaagtacttagttaagagattcttctgcacaggcaaatcaatctttttctttgcactttcagaatgagttttgaattgactcgttcccacaattgcaaatctggctgtaagattctctccctgccatttaaaagaaatagatttttaaccaaaagtcccctttaaacaagggtttaattgaaggaccatacacccatgtatacttcttaaatgcttttaacatttattaaaaagaaaggggtgacaatctattcatatttgctcagaacatgtttgtgaaggtgatactaactcccaagaaaaccttgtaccagtactatagcataaggcaaacaaaatctactttatatgtagaatttacacaaactcatgcacatccacgcaaaccaaaggcaacggttatagaacactagcaacagtcttttcagttgttgtcaatcctattcctatcattttcaaaattcatttttttttcacaatcatgcaaattgtccttattccaaaaatgaacaaatgaaataagtcaatttattttgaccaacacatgcaagaaaaacagaggtatttcagtttactataaatttattctttcactttaacaaacacacactttggtatggatgaagataaagaagaaattgatgatgtacctcaaatggcattttggtaattggatcaagatccccttttgctattctttgtgctatatcttttggcatgggtgtatcccaggttaaggtataacttcaagtaagatcttagatgattgaacaaaatggagcagagtgatattaatttaaaatggcaagagaacattaaaatgaaggatatgggcctaaaaagtctaactcatcaccaatatcatcagatatactagacaaatgaacaatattttcattaattggatcataacccgttgatattggaaagtaagtatagctttcttgaatgactcttcataaaagggaggcacagaaactccactatatctcaagtgcttaagaacctgatacattgcaatttgcattagaaatacaaaaatttcatatagaaagatttacatacaagatttataagatatatattgttataaaaaaacacttttaagcatttatgttatgtgtatagatgtagacctggctgcttaagtgagtttaaacagggaaaatgaacattgattgctaaaataacatgcttgttagtttttatggttctgaacagtcatgcttgctaagtgtatcagctgcactcaccttgtcataacttctaaattttttaatgcttgcatgggcccttttgagacccatacctggcaaggactgcagataatcacagccactcaaaatacacatttcaagaacatttgtctgttgaacccttcaaactaagctccttattcttttgtagcatggaatactgaaactgaacaccttgaccaaacttgtccattttaaagataatctaaattttcaaggaagaagcaggccagtcaaaaccagtgagtacgtcaaagtaggaataaatatacactagtatagaaagataacaaaaaacatctatagcttaagccacgtggtaaacttactcttgggcaaccaaacggtataagatcagagtcttcagttataactgcatcaacttgtccacttattgccaagaatgtcatctgggcatctgcctcgtaaggagcaacaatatactgcaagttctcctgcttcaatacctttcaagaaaaacaaggttaaatatttagttggggatttaatgtaattattgtattgaatatattcaaacgaaatacatatgtgatacaccacacacacacacacacttcacaacaaccagaccaacgctgatatattgaactcctttatacctgaattagttcaagtgcaatttgaggtgaaatatcaactgctttctggtagcactcataagcagcagctgaatttccatctgactcatgttcaactgcacgtgcaagattatcctttctagccctgcacttgtagcatagacaatatttgattcatttgcaaaagagcaaatacaatcaatgagattttaaggttcttaaatctgcccagaatcaaagcactcctctttggtgatctgtaataaagctcataacctctttatcccttaatatcctttagtacttaatctttggtaaaaagagagaaaaactacgaaactcaggccccataacaagatgttgttttcatgggtgctggagaaggattggtttttcagtatcttagtttgaaagctattaaattattaatcattctatccctaatcattcagtattccatccatcctctatatttcacattaaaccaagttcattttaattttacctcaatttcagaaacagaaaagcaatcaaacaatgacaaacgcaaagaaacaagtatgacatttagaacagaagcagaaacattgagcaagtcaagatcataaacatggcattactgctattttcaacaaattgtgcttgtgaataagaacctcatgtaaacatgaagcatacatggagacagagctcaagaaagttttgttcaaaattgtcagcttatatcatttgggaattccctacatgcagacccactgtacactgaggaagtgaaatcccacaaagggagaaactaatgcaaatgcagacagctggtacaagcacagcatcaaatccttctttgaattttgaaattagataactcacagagaatcaaattaaaagaaaaatgaaaacggttatgacttgagcacattaagcttcttactctactcaatgtaagactcataacattgccacctcctttaagaactgatgtttacggaggcttcacactatcaacagaaaccctgcctgataatagccccttttcctcacctatcagtacttgg

SEQ ID NO: 4 - DNA, 646429 bp, Glycine tomentella
  source 1..646429: mol_type = genomic DNA
gagattcaattaatttttttcatgttatgattggtgattatagatatataacttagtgccttgtttttaactcataataataataatggcgaaggtgtttagttgttatgttctgtattgtttgtcaagatgcaatttgtgtagttttgattttttttccaaatgaagtatttgatcttttatctcatatttttagttaaatttaattatttatcttctaaaaagtttaatttaatattttttttgttcagtttagtctttaattcttaaaaaattattttggtcatttcttttaatttagttctttgttccatttaagattgttgtctttagtaatttaataataaactttatgtgctaaaaatgaagtggagggaaagaaagaaaattgaattaaaaagtttatttttaaatgattaacaacttcaatattaaataaactgaaaaataaagaatataaagaatcaaataagttttttaaaagataaaggataaaattgaaccaaaaaattaaataaatcatttacccttaactttcagcatactagtgaacagtgatctagatttgagaagtatattaagcataaggatcaatcataattattaaagcattataaaaccataattattaaaaatacaagtaagcttaaacatgttaataaagtgggccaaatggtatttatcaactgttaatttttatataaaaaaaagaacagatatttgtcaacagtaagaagtatggtctacatgtcaaaagaaaaaaaaattatatatagaagattaggtataacaacttttaagaataataaagaatgttactgatagaaatggtttttctataattattaaaaacattttttaatagttataaaaataagtggacttattattatttttaaagaggaccatttttggaccaatttaaggaggacttaaagatgttaataatgtgggcaaatgatatttgtcaactatttgaaatattgtctacatgtcaaaaataaaattacacgttaaagattagaagataacaacttttttttttacaagagaatataacaattttatgactaacaaaaaatgttacttatagaaatggtttcttcccttcctacatataagctaattatagagattataaaattgatttgataattaaaggaaaaaggaggagaaaagagactatgaatttaaatcttccactaatataaactaacaaataatatttctcaataaaaaattaatctttctgaaggtagataagaccacaatcttattgaatgtcttattctaaaaatgagaataatataagatacaaatatatagttattatgtgtggtgcaaataagtcttgtttgcaccactatctatttgtattttggtgtcattgaaaaaatttcaaaatattgaatttgacttgtgaaactaaaataaaaaagatacacattaaaaaacagaatgtttttgtaaaagttcaaaataagattatattttatcaaacaaaaattaattatataactcccctccccctgaagttatcttccaaagcttatcctcataggaaaagttcaaacccccaaaatacaattattgaaagagattattaattgcaatagtgtgttaatcattagttgtaatattgtattacatttaggtttttttattgtattttggtacttttttaattagatttaaaatctcaccttgataatttatataataaaaaaatgacattaatagtcaacataattttgtttgatacatgatattaatatattcattaattttaaataatgattaatttttattgagaaatctaattgataatctttgttaggatttttctcttctaattatattttttctaccccacaaatcaaaatcttgtttaaggatattaaattccaataataaattctactcaaatcaataagatattaatagtcaacatatatcaaagagaatctttaaacctaaatagaaataatacaaaacagttcacatctaaagtcttatccttaggtatgattaatattaatataaatatttcaaaataaaatagaatattccataaaatttttaaaaaggaattgtacttttattcaaaagtttattatatatattttttctaaagttatcgtcgcaagcatggggaattaagtttaaattaaaaaaatgacctaaatcaattattgatagctttgatatcaagtacatcgctttaatagttcaaataaaaaatcttttgacatatttggtttaaattatatgaagttctgaaaagattcttacgaatgcttaaataaatcttgcaaataaaaattgaaactagggacacataaggtatgacttattttaaattagagaagtgtgacaaaatattgtttgaatgtaaatgttaaaggtgcaattgtagataacaaataaaaggcgtaattaaatttgtttgtttttagattatttctatttcttgagagaacttaaaatatttatttctttaacttttgttttttacaaaatatgtacttatgattgatttttttaacttttttctcacatatatcatcttttaaaggtgatcatgtttaaaatatgatttggaaaaatatgattgggtattaaatatggatacatcttttagtaaaaatttgaatcttttatcggcgatgctgagagagtctaactcccattgtttgtttgtctctttttttagtttttattaaaaatattcatatataaattatgtacttaatatttttggtactaatattttcttgagcatgatatatatatatatatatatatatatatatatatatatatatatcacgatgagttgtcaatgtcattaaccatttagcatacataaacggtatattctataatttatatttaataacttattctattgtaagtcaataatggacgcattgctatttaagaacaataaaatcttccattccatccacaaacaactaaagatttgttttgtttgacaccaaaaaaaaaataaaaactaaaggtttttttttaggcgtaaaatttgttgctatatacgattttaaataaactggatgtcaggcattcaatttattttttcatgttatgatcaatgattatagatatataattcagtgcctttttttatgtctaggcatgatattatttttcagaaattacattcttaaaaatattataactaaaaagttatttctagatatattaaaatgagggaaaataagatagaagttaaaaaggtatgttaaaaattttcatatgatataggattctcacacattcacataaaaaatgtaataattttttataatttatatcaatcataaaatgttatatctttaaattcacatttattataaaaaaaagtgtatttatcgaaatttaaagttgattattgtcaggatcaatatagttaagataggtttcatgatctctcaagttggactacaagtatcctttattaagagaatatgagagagaacttgtaaaacaaagaactttgacattcaattaagtgtgtgagtgacttgagaatgaatcaagaaggagatataaaacttaatatttatagcgttggataaaaacttcatatatttaattataagagatatcacaatgatataaccatctttgtagataattcattgctaatagataagtaggtacctaataaagaaatagtagcattattattagaattcaaatatatatatattatcagtttattagactaatagttcatctattaagagatttacgtctatactcttttagtaggagaactgaataaaagggttaatatatatatatatatatatatatatatatatatatatatatatatatatatatttcaatatcacatcacttattatgttaatttgtgaatttctaacaatacatgaattaattttatatgacttaaaacaaatatatttatagtgaaaatataatatataaattttttaaaaattaatttttaaaaatcataagaaacaggagaaattgacattttcatatttattattgtgagaaatcaacttttaatccctcgaatacgcttataaaaaataacggtgaaggttttagttacgtatgttctttattgtttgtaaggatgcaatttgggagattttaaaccgtgtgcaacatgttagtgaatagtgatgtagatttgagaagtatatttaagcacaaggttcaatgactcctaaaaagaaggataatattcaataataactattaaaaaatacaagttagcttaaacatgttaataaagtgggccaaatggtatttgtcaactgtctgaagtataatctacacgtcaaaatagaattacatatagaaaattagttataacaacttttaagaataataaaagatgttacttatagaactggtttttctatgattattaaaacaacaattttttaataattataagaaaaaagtgggcttaaacatgttaataaagtgggcaatggtatttgtcaactgtttgaaacagagtctacatgtctaaataaattaaacatagaagttaggtaagataacaactttccacaacaataaaagatgttacttacataaatgttttcccccatccgacatagagctttcataaaagctaatcttactagagcttgagcaaggcagtctcatttgaatgttgtaaatctaaaatatatagggctaatatagaaggaaaaaaaatactaatgtaggaacactatctatttgtgttttatttatctatatttttatttatatctaatgttaacaatcttcaattacaattactacatgatattttatttatttatttaatttttaatttatcctgaaggttacatgctaaaaaagattatattaaaattaacagtggatcaattatttatgactttggtgtcaatgaaaaaaaattcaaaatattaaatttgacatgtgaaacgtaaataaataaatatacgtatttaaaataaaaaaaatttcataaaagttaaaattggattatattttatcgaaaaattgatcatgtaaggtttccccctctaacgttatcttccatagcatatcctcataggaaaactcttaaagttcaaacctcccaaaaaggacaattatcgaaagagtttattaattgcaatagtgtgtgaatgattaactatgacaatgcatttaagaataggacaatatttatatgtaatactttttaaaatgtatttttgtttttattatttattcagaattgaaatttcaccttaataattcacttccttctttcgttccttttttatttgttaaatttttaaagattttttttttcattttatatgtagtttgcagagttcaaaattatattaattatacgtacctttatgagtttatcaattatatccttaattgttttttatctttaattaatttacacatatatttattgtggagtaaaaagataaaagagtgaaatagaaaatttaacaactattttatcataatcaaaaaaattattttatttattggtttctacaaaaacaatcgtaaacgacggataaaaagaaatggacgtaatatataataaagatttatatgaagagtcaacataggttatcaaagattaatttcaaattaaaataaaaataatacaaaaaaccaaattgaagcaccacatctaagttttatctttaactgaataaaaaaaatctgttttatcctttcgaatatactataattaatattaagtattaacatgcatattttaaaataaaatataatatttcataaagaattaaaaaggtttatacttttattaaaaatctgattatatttttttttcctaaaattatcgttgcaagcatatcctgagggaaaatttaaagtttaaatccaaaaatgataagtattaaatgtataagaatttaaatcttaatttgctagactgactttttacgttacctaaatcaaatcccattattttatttgcatttttttttcgtttttaaaatgtagaattcacgtataaactatgcactttttcatttcgttgatgtacgtataacttatgcacttaaaacaatatatgatactaatatttttattgagcatgatatcacagtcacttgtcaactatgttattaactatttagcgaatctctaaaacaaatgtatctttagtaaacttattgtattgtttttttagaggagtaaacttattgtattataaatcaattattgttgcatttttatttgagaacaattaaatcccccttaaccaacaactaaagattttgggaaatcttttcatatttaatatatgataatattttaataggtaataattactaaaatatttaatttgtacatttaaattacatgacaattatttaatttctttttttaatgttttttcttacttaaaaaattaggaatttaacttctttatgaggtatggaagttattgaaaaaattagaacactgaatttaatgtgcattatatgctcaccatgccaatgcacgctaagcgcatatttaggatttagtgcatggtcacttaagacaattgtactttggatgtgtgctcagcgcacacatgcatacttagcgcaaagtcatttttgaaaaacatgattatgcaacgttttgaagattataaaaatgtgacaatgtgcttttaaagggagttagtcagcaagggcacaaaatagagcaaaagagtcacttgggagctcttcttccatttcctttgtttcatcttttgttttttagtctctcataatgattatgagatactaaattatccattgttggggtttgaataccaaatactctttgatgtagtgaattttactatctatttaatgttattttaatattattgctttctatttaagtttattgtcttatttatgatttgatcactcattcacatgtatattatacgattttaatcattgaaaaatatttttaccctaagaacttaaaggagcttctaggtaattcatgtctataaataaaatgatgttatttactcttatttatgcatatttattcttaaagcaaattacttagtttaattcttaagagattaggagtgaaattatatgatttagactttttcacgtgaagaatcatgattagagtaatttagttaatgaaaataatagttggaatactttaaatgatgaatatatatatatatatatattagatataaataaaaaattatatcatttctttttttactggaaaaaatatattaattttaaatatcagataatacagtaatagtaatgaaataggaataataaattgttgggttacattgtttctctgatttctttagaatggataggtcttctatatacatatgaaccttttttttcttttcgtatataacaaaataataatataaaagcctttatatatcaacaaattaggttttagaaaagggactaataattttctacaatgtggtaaaaggattgccttcgaaacacatggtaaaataaatacataagtcttacacatttattattcagggatgatgatttaaacacgctgtaaaataatgtctatgattttggacacttcacaattttacaccagtaaactccattggcacataagttttctcagtctccctcttcctattattaatcatatgtattatttgtcatatttatatttctttggtgtaaaatatatgtgatagatgtttaagaattatttttgtaaaaacaacttaaaaaaaaatctagatgtgtataacccacccaatgaacaaaggccacaccttggcctcccagacgtttacttaaggctaaaacgacagctaaccacaaagtacaaaccaatctcgtaaaacttattatttttttggtgaaatccaatcacgcaaaaataaataaaaaacgaaatgagaaccatataaaatcgataagtcataaagagtaataccaaaacacacgcaaagcaaatgaagtagtaagagcgagagtgtgatagagagaagagaagaagaaagggtgagagataatgcggtgttatggtttaatcgtaccgggaagcgaccagcgcttctgcgtccccaccgtatctccagtgttcttgaggcccaacaaacccattatcacgacccgaatcgcgtttccaaaggcgaccctgaataagaacgagggtttcgtggtggagctgagcttctacgagcttctgggcatacccgaatcgggttcggtaacggagatcaagaacgcctacaagcaactcgcccgaaagtaccacccggacgtgtcaccaccgggtcgggtcgaagagtacacgaagaggtttattcaggtgcaggaggcctacgaaaccttatctgatccttcccgaagagctatgtacgataaggacatggccaggggcatcaacttcgccttcaacgctcgtcgacgctataattaccacgatcaggttcgccagccaacttagggctttttaattattccattcattttatttgaatcacatgattcgccatttcaggagatataaggttggttgggtcatgggtggttaagaaaaaagggaagctgctaacaaactaaccattatcatttgtcgccatttgaattgtatgatttggcaagtgtaggatgaattgcaaattgctttgaattgttcgatgtatgatatgattcaataatttgttgtgttttctaattttttgggtggcttttcttttaacagtcctcgttaaagatattgaaaatttaaataagtttaaattgtgaaataaaaaggaatagggaattaggtatagtgctgcttagtgaatgttgtttggttgttcttttactttgattccatttgcacagtctctcgctctgtgcatgctatttggttgttctgttctgttttttttttttttctcttaattctgagatgacaaagggtttgcacacttacactaacccacccaatccatgtgcccttatttttgtttttgttttaacttacgacatattacatatggcttataatgtttcgtgaaacttatggataatatgtattttttttttcaattcctagtttaaaattatacattgagctctatacatcgtttatctgatatactagggctgtttttcactttgtgtctaaacttatgatttgatgtgagttaggattcacaattgaaaaattagcttggtgattcaaaatttgatttgaatttaatctaatctgaaatattgtcttactactgatttgttcacctatctcagtcagcaaacaaagcaattgactgtaactttgacctggaatgggaattgcttcatcatgcacgtttgagttctgatattttatatttctgggtgctttttataagttagtaataggaacttgattctttctctgttctatgttttttgttttccaaaaattacagttgtagcggtcaccttgcttctattggaattctttttcatgatggtatcacagaatcctcctgctgtttgtgaacttatattaatatttaatgtgtctattacagaatttgacttctgctctgcacctatacataattgatatttttataatttatgaggactattctggcttttgttctttttccatttttttccttttcgaatatgtcgacttgaatcccagcctctccgccacaaaatctgaacaagtgtgttgtagttgcctcttcagcacatgaaaatctgtttacaagttaaatttctttttcatgatggtataacagattcttcctgctgtgagcttgtgttattttatgcaatatctattaacttctgcactgtacctacacccaatcattctattttcataaattatgagggctttcggcagatacttccttatgacgtttcctggtaggaatacattgtttctggatttctattacggcttttgttctttttccaaaaaaaatttaaatctttttgaatatgtcaacttcaatcccagccaccaccataaaaaattaaaaactgaataagtgtgttgttgctgtaacatgtataaatggctcttcaacgtattaaaagtctgtgcaagctaacagtgtgaaaggatataaatattagtattattaacaataacaataataatgatgatgaaacgtgtctgcgaatgagattgagtgtgatcttaattatttctttattcatatactactgttcggaaatttctttttatcgtggtaatgagtaagtgggaattcataaatcatgcatcctaaagagatagggatttcttaatttactgtatttgcttgttcagttgtctaattcactttttttccccttctaattttaaattgaagaaaagcgggtaaaggtgtttggctagaacactaattggtttgctcactgattctaagctgttggttttgaatcaggtggttgaacaaaaaagtgaatggaaagctaggtggaaatctcaactgtcagagctgaagagaagaagtaacagcaaggatgttggagggaatatgtcatgggcagcacgaatgcgccagcagaaggatgaattgtcaaatgaatcatgaccaggattttccttagttctctatatttaatgtaactagttgtatatatagacaatagataatgtgtacatcttcgtactcgagatcaaatcagatataaagttgatgttgagaaaacgtgcccttggcccattgctctactcacagttttaagcgtgctaactaatagtcggctgaattaacgtctctaggccattttagtgtgttttggttagcatttgcaaaattggttttagataaaatggcttttgaagttaatggatttatatttagatcattagatgattttattctaaaagcaagttagtaataaaatttaggataaattttttatttaatgcaaaaattatttataattactttaactcaattgattagattaagaattaacttcttaatggaaaattaaatatgtgaatattaattgaaaattatgttcgttggtatttcaattgtaattttggatattctaaggggaattcaaatagtgtttatataataaagtgagatttgagtctagtccataaaatcatggtaactttataaataagttgaagctagtacttaactatttatagcttcactttagattttttaatcaattatgctaaaagtgattttaaactagacacactattagtgtaactagcagctagacctgtgtattgcaaaaaaaattctaagaaaaaaaactaaagaggaagggagaataaaaaagagtaaaataaaataaaaacttaaaaaattgttcttgaaaaactgttcaactgacatgtagcgatgtcttgacaatttttttaatactttatttatggattgttctgtgtggttgttattttggctgtgagaagattttggggtgcctactgatgtgtaaggtgggagggagaaaaatagtttggacctaggttgccagcaagtgggattaggaactttggttttcgtttatgcatttaaatggacgagtatcaagggtcaaatatgattgaattttctttttgatccggcaaaattgatcgaattaaactccacaaattacacaatttggaaggtggaaaaaatttctgttttggttaccaacaaatttgtttcggctgagaagatttttgggttgcctatttatgtgtaaggtggaaaaaatttctgttttggttaccaaccagtagctttaggaagtttggtttaatatcaagggtcaaatatgatcgaattaatctccacaaattatacaacttgaaagccccttatgaaacgtgtcatatggtagttatttgggcggtgagaagattttctgggtgcctatttatgtgtaaggtgggagagagaaatataatttcggactttgttttttttttttttttccggaatgttttggactttggtcattaggaactttcgtttgtcaagggtcaaatatgattgaattaaactccacaaattatacaatttgaaagcacctcatgaaacgtgttatattaagaaaaaatgtgtatgactttaggggtgatgttattcgccaattgattgttagttttaacatttctcgaaaaattaggatctattttatatttaaaatatacagtaatggtaattaaaaataaataaatttgtgtatccgattgtgagttgttgaaacaataattttttttaataatgtgaaaactctaaatatatctatattgaaattaatttctgctatcaattttttaataagagaaactctaaagaacaacatctttttctacttttcaagtctaaaaattaaacttgaatttctactttgatctagtacactctgatttcatgtaaatgtttcaatttataatattaaatatatatggaatttataatattaaatatatatggatttgagacttttaaaaagagagattttatttaaaataatttcgtatctctatttttatatttgaaaataaaaaacatctcatatcttttttatgctaagaagtttcctaatataagaaaaataattatcaaataatcatgattaattacgataacttgtcacatgatctaatcttgatatgtagcaataaaaatttattcttatttatagacaactaccacattttatataataatactcttcatttatattaattatattcttggtactaatgaagaatataataatattctactaaaatatttatttgattaaattaaattctttaatttaattatgaaataatttttttttgcaaaaattggaacactcgtttgtgtgtgatctagtaggttcaacactagaccgatagtaaattaatcacaattaatttactaatcaagataggcgtctaacaacacttcttaaggtccggataacatgaagtaacttttttttttaccttcaagaaccaataggagaataacgtaataattttttccatcatttacagctcaaagttaactctagagtatattattactatcaaattctaataagttaacatattatatttaatcaatggatgacttaagaaactcttttctcctttcatttaattgttctagtcaaggtcttaattctattatagaactcaaactcattacctagagttgatgattttcttcttaattaatcattaattctacaagtatttaatcatatccaatattcatttaactagtatcataaggcattaggtgtccaaaattaaaatataacaaataatttattaattactatgataatctcaaattaaagaaaattattatatttcttcttaagaacttcctattggcatgtcaaagtaatattaattattaggaattctcaattgagtcagttaaataatgatattcacatgtaaattatcttctatatatgtaatttaataaatgagattcattaatttttattcaataaataccatcacatatatattgatctatctgaattattaatgtcctatttagaataatcctactatcaagaacaatttagattaaaattataaatgaattttttctcattatcatattctgtatcatgataataaatctttaactttaatcaaagatttatcaaattaataatttaataaaaataattataataataaaataaaaaataattttttacaaaaattgataatataataaattggatgttggatatatacacacatttaccccaacagtgataaatgaaaaaaagtattggtttgattaattatgcagtggttggaagtaggaatcaaaaggaaactggccgaaattggccaaattgaatgagcaaaataacatacagaaaatgaagcattatgattcggaagctaatggatatgaatacgaataaggtaatatgcatctgagcatatttcaagatgttgtgaataaattgatgcataaaagttacatcaggtgatgagttgtgagcattgcggtggcaaaaatttaaaaataatattatttaattatttaattagcaaaagggggttgtttggggattatttagggatttggggctgccaaacacgccctgcctgggcgtgtttgaacacgcccaagctaggcgtgttcaaacacgcccaggcagggcatgtttggccccccaaatgcctatataatccccattgaaaaagacatttgccatttcgcgccttctctctagaattaggtctgacttctctctagattccgggtgctgcattgtctgaagcgaagccctgccgaaatcgtagcgctgccgacaagtaagtccatttaactgattgtgcttgatatttactttgttatatttgaaattagaaaatggttaggattatatgaactttgtagcgacatatatattaggttatttactagggttttaggtctttcaggttagttgtagggtttacaatgggataatggtttagggtgaggtgtagtgattagggttacgtaatttaggttagtattagggttaacatcgttagttactagggttttaggtatttcatgttagttttagggtttacaatgggataagggtttagggtgtggggtagtgattagggttacgtaatttaggttagtattagggttaacatcgttagttactagggttttaggtatttcaggttagttttagggtttacaatgggataagggtttagggtgtggggtagtgattagggttacgtaatttaggttagtattagggttaacatcgttagtagggtttacggcctggggacatatctaggtttagggtttagggcatatgtcgtgattatagggtttagggttgcatgtacatacgtatggttgatgtcttgcagtttaggttaggggtttacactgtcatcagggtttattgttttagggttttgggtgtacatggggattagggtttatgactaggggtacaaagggagggtttgtgggtgttagtttagggtgtaggtcgttggctctgattagggttaagatcttctgttgtagacgtcaggctaatggatttagggtttggttaaggtttaacattgtgattgtggtttatggccttgagaacagacctagggtttagggttaagttctgatgttgtgattacgatttaggtcttcggttacagacgtcgggtgtatgacacacctgttttggacttggggttagtgtgatgagggtttaggagttgggttacatacttggggtttatagtttccggtttagtgcgagggctgatgtcgagattagggtttagggctcatatttttttacttagggtttatggatatcggttaagctttcgggcttttccaattcaagttttgtattgccttgggattatgtcgtgattagggttatgatttagtccgacggctgatgtcgagattagggtgtagggctcatgttaagctttcgggcctatgttgtggcacttaataacataatgatattattatggctgaggtcgtcggttacatagttagggtttatggattctggtctaggttaatgttttgattagtgtataggtcgtggggtacagacctagggttgatggatgcggctttagggttaggtctgatgttggcattagggtttacattgtgataagggtttatggcttgcgaaacacacttagggtttagttatgttgttgttgttattacgatgtatgtgttgggttacagacctagggtgtatggatcccgatttaggtttaggaaattacatacacttgactaataatattgagtaattagttttccaattaaagtctttgacgttagtattttgtttgatgtggttttaaatttttgtacatgaatatattgaatagatggctgattcatcgtctacatcgtcgcgatctgcatccgatcctgaggctgagcccatggatcccacgcgatatgttgttccaaccccatacaagtggggcgttctgcgaaggcgtattcagcgcacacacgtttcacaagttgtgtggaacgggggcagcacacctcgagtactgaagactcgacgtggtaccgtgaaaggtggaccagatgcggaccagatacccgatgttgtatctgacatgttgcgcgcagctgggtttcttaatgtcgcacgcatgcgaaatctccaggtacacaaccacgcaattatgaaatgagttaagcctgcttaatttgataattgtttaatattttttatgtatttcagatggattctgcgcttatcagtgctctggttgaacaatggagaccagagactcacaccttccacacgccgcagggtgagatgaccatcacgttggaagacgtggctggtattctaggattgcccatcgaaggtgatgcggttactggagtgacggttgacgagtgggagaccgtcattgaggaggtgtttggtcacgaacctgaggataccgagcttagaggtggatatttgcgtctgtcttactttgatagacattttgcgcactggggtgaggtggtccccgagcctgttcacatgacgcggttcacaaaggcccacattgcacgacttatcggatcatggctgctgtgcgacagatcgggaggtagcatggtcgcagcacgatatatgtcgttgcttgcaggggattttgtggacatcggccgatatagctggggctcagctgtcctttcacatttgttcagacaaatgtgtgagtgtacagacccagacaggagtgacatcggtgggtgtcatatgcttctccaggtgtgggcgtggctcagattccccccaattgctccagctattccgctgcctacacagccggactggcattttggtcatcggtatgtgtgattatatgttgttgttgtttacaattgtaacaatgaagtgttatattatactaacattgattattttgaaatcaggtttaacgctgtaggtcgacttaaaccgcatgaactggtcgtgtataggatggcattggactcccttacccgaaacgaggtatttacaattatagtatttttcaattactgtacgtttgcatttgtggaacatgctgttaactagtaaagtgttattttgttatgtgcaggtcgtatggcaaccatatggggactacgacttccttggtgcttctgagcgtgagcggctgctgtggatggcaactacgcctatcatatgcttccatacggtcgaatattgtcagccggatcgatgcatgcggcaattcggcagggatcagccaatcccacgcgctcccaggaagctgaagggcgtgcatgacctttcgcttcggggtaaacgggaagccaactgggttcgcaaactcagaccgtttatttcgcggtggaatgctaggggcgaccacattgagcttccccccttgattcaggggttgttatcaccacaccatgagtacatggtgtggtacagagaacacggcaagcggttcatcacaaagaagggcgcgaagatggctcgtggtgtaagtttctgttccatcatcatttgtgtatttgatttaattatcgcacatcacacacctgacatttatgtgtatatgtttaaaattgtagcttgatgggctggaggcgttgtacttcgcggcgactagccccaacagggaggaggccttcgacttcgattgggcgggtgaggaggttggtcgattaatgtctgtgttcgccgagagttgtcgcgtggaggaagcaggcccacatgctcctgaatcccagcttgagcccgaaccacagatctcagttccagttggccgacgaacaaaagagggtcgtgggctagagcgtcggcggagaccggtgcagcaggttcctgagcccattgttcgaccgaggccacgcaccgaggggatgtttaggcccccacatattgcatcgacatacgggacacagcccgtatattaccaggctactgcgcagggggggcatgggggcatggactacgccgacttcagtacccaagcccagatgcctaccccagacccatcgcatagccatgccgcatatgttacgactgcaatgacatgtgcagatgtacatggcgggttcgtcggttgtggagtgaacatgcagcccgagtggtctgaggcacaggtcgacgaaatgctcgaccaaatggactatagtgcagaagcctgtgccgcttggcagccacactcaccatatggcaccgaagcttctgagtttcctatgccggtgtatgcagatcagggcacgccccacccggacccgtatcaggcaggcccgttccagtccgacgcctatcaggcaggcccgtcccagtcggacccctatcaggcaggcccgtctcaggcacaaccttcgcagccagtccccgccgagccaggtagttctcgacgacgacgcagacgagtacaaccttatcgacaggcacgtgatttgccgtggccaccgccctcactctgatttatatttttattgtattgtagtggactgtatgttgtaaacaacagtaactgttttatgagatattttgttgtattgtagtcaacatttttgttaacaccgcaaacgctttaattcataacatacacgattacaataaaaaacatgcttgcgaaaatgcattcttaattaaaaggagattttcaaaaaaaacatcttcggtgtacatgtcttattctagttggatttgaggtttgctgaaaatgcctaaaatttcaattggacaaaaacgtttccagtagttggattccgctagcatcctcaagacgtcttcatcgctcaccaactcttttatgtcatactgaatagtagtgtctgagtattgtgcatgtcctggatgacgaaaaaacatttttctaaccacctgtgacatgtgaatcccattagggggaaccccaacaggcgcaacttgcttgatgagggccttcagtgtttcaaggttgcatgcagaaggaattgcaaatcgaattgggtttgttccagtaaacgcataacccacagaaccgggtcttcgtggtatgttccaacttccattgtaatataggattgcatcatgtgtggggacgatggtggactgaagtaggttcattatcccatcggttgttctggttatggtgcataatatttctataggaccagcaccggacatttggtggtgacaccttaacattctgcaaacatcatcatcatttgttagtgcgatagaatggaagaaatagaactgacctgcgtctatggatggttgtcggtagtagatgtcatccacgaagtagtcatcggttagcagaagggtgtggtgaatcctactcttaagcgtctgaaacgaacactcattaggaactcgcatcgctatcggagtggcaccctgaaaacaaacacccgtgtcgttgtgattcgtacatccatttggataaatgaatgctaatttcgagttagcaatgttttggctgcttgtttctcctaagaatgccattgtatgcaaaataaaatttacgggacgagtcatgttgtgtgccacggtgtagcttatatagctgtagtcgcgcctaagttgggcgtgtctagtcacgcccttgttaggtgtgttcaaagacgtggtcggtgggcgtgtctagtcacgccgttgttaggcgtgttgaaagaggtggtcggtgggcgtgttcaatcacgcccttgttaggcgtgtttaaatacgtgttcggtgggcgtcttcattcaaaccataatcacaacgtgcttcaaccaaggcaaaacttgaattggaaaactaattactcaatattggtgtttgtatcacagcgcctaaaccctaatcgcatcataagccgtgcaccctaaaccataatctatcatccctgttaggcgtgttcagttaggtgtattcaattaatggtgaacgggtaacatatagtatcataaataaatagttaatgacaaaatgcaaattcatgtcgatcacaggcaaaacattatcatcgtacatgttacacaacatgtgttataaatcaaatacatttaacaaagcattcataaaacacacataacaacaaaatcatgaaacaccaccaccccgagtaggacaggtcgtacgagtatgtccaacttgcttgcacagaccgcatctacgaggtgtctgacccgtttcgacttcgtccatctcgttacggattctggtcgaccttggacgacccttcgcacgcaacatttccctgtcagggatgataactggatcttcactagggggaacgacaagttcatcgccaataggctgccaaggtaaagaataagcctcgaccaagttggatacgaggaacacatcatccacatattgcaaaggattccgacggatgtataaagcagcagctgcggcatggctacaagggtatttgaaggtcttaaacttcccacactgacaaaaacgttcagttaggttaactgaatatgacctgtcccagccatctgccacctcaaacgacgtatcctcaacgttataggtgcgtacatggtggcctgtagcaacgttctgattatgcctcatagcatcaatcagatttttacaatgtagttgtgattgctgcatctgtgcagtggccgtcttgccccttctgacaaagtattcaaccaatcgactgtatgtgtgcttcaccaaagcagtaataggcatgttccttgctcccttgaacaccctgttcactgattcagacaaatttgttgtcatatggccgtatcttctcccctcggcgtcatatgcacgagtccacttttccttaggaatgctgtcaatccattctgcaacctcaggactggtattgcggaatcgttcatacgctatgtcaaattcggccttacagggagtataacctgcacaattataaaggcatgaacgttagctgggtaagacatttttaaacctgactaaattacaaataattttgaacatacccaaggtcatgaggctcttcttcaatcttgcactcctgaatcgttgattgaaattactggcaatatgacgaaggcagaaaacgtgatgcgcaaagggtggttgccaaccggcatgattctgcactgcagatataatgctccggtgccgatctgaaatgaggcatatattttgcatttgggttacgtggaagcgaatgttagcaaggaaatattcccaagcttccaacgtctccccctcgacaatggcaaatgccagtggcacgcattcgttattcccgtcctgactcgtggcgatcaacaattttcctttgtacttgccatataagtgagttccatcaatttggatgacgggtttgcaaaatttaaaagcctcgcagcactgtctgaaagtccaaaacatgcgctgaaacacacgcttccctcgcaccagtcgatttgccacaaaataatcattggtttgaatatcaaaaaagccccaggtgaaaaacgaagcatgtagttgcaccacctcggcaaatatgcgtaagattcttcccaatctccataaatcattgccatggctctctgcttcgcataccatgccttacaatacgaaactttaaatccaaagctggtggtgatcctctcctgaaccaacgcaatgcacacgcccggttcctccttaatcattcctgaaaatgacatagtgagatacagattaacaacaaaccttaacacaaattaacttctttctaataaagcaaaaattctcaggtcataccgactacaagtgaagcaatgacatcaacatcaagttgtctatgatcctgtgatagacgatcgttgaggcaattgtgctttccaccccatctggaaaccacccacttctcacggtacactggttttatcaccctaaccctccaagggcaaccatccttgtgagcaacacacttcattgcaaacttgtcaggcttgctctcaaccacaaatgcttcttgatgctccctcattaggttccgcttaacagcaacttgtgcctcctttttcgatggaaattcctgttcaacatacaaatcgtcccctatttgccaaggaccctgcactgaacccgatcctgaagctgagccgccaaaagaagattcttcgcttgggtgatcccaatcgatatatgtgtaatgtggaatcccgtcccaaaaaggaacaaccgcaccgcctttaaatacaatacacaataataagcattggtttgcaaaatatatacatgaacaacagttatacgaaatcacttagggtttaagtcatgtaacttaccttcaactggttgttctgattgtgtcggtcgaacacccgcacggttccgcatttcagacggccccgcatcagtgtgttgctggaatgcatttgcatccaccccaacatcttcatcattatcggacgcactggcattctcctgaagaagacgatcttccatcgctatattttcatcatcatcatcttcttcatcgtcatccataacccaagttgggtcatgtgaatcttcctgagacatgtttgcaccaacagcatcatatgatgatgctgcaccatcatatgatggtgcactcctgggcaaaacaactgacctcctgggcaaaacagcttcctcaactacactgtaatccacatacaattctaaaaatttcttccgttcctgattaaaatattcttcaatggccatttccaattcttcatcatcctgtattggaaactccgtgtattcatcttgctgccatattcttgccgtcagcaatgtgatacaagtgtttccgtccacacccaattttggatgtatcttctgatgcagatcactcaatgttgcatttcggttgattcgtgtcatcctttgctccccttcgaagacaacacctcttcccccttgaattttccttccgttgaaaaaaagtttaacacgaagaacgtccgcatgacttgaactcatttcctgcaatcaacataaataaacgtcaaaaacacacaaacacccgaaaccgtcaattatgaaacacccgaaaccataccgctttaacacaaagtagacaacctaacacttctacagatgtacttactcccagtaaatcaccaaatggtgaaagaaagtcaatattgtcaaagacacaaagtcatcaagaagtggtcttgtttacacaacaacctagaccctaggtctagtcacgccaacccatacaccctaaccaccgcatacgccttaaaccctaccacagatcccctaaaccctagttgtgttccccctatcctaacccctcatcaccatataaaccataaacacttaagctgaatccctaaaccctagctgtgacaccgaaccctacaccctaatcaacacacgcaccataaaccataaagcggtaacacttaaaccctagctgtgtaccccgataactacaccctcagccagaacacttaaaccctacccaccccataaaccctaatcacaatatcaacactaaacgtaaaccttaagcaccacctaaatccattagcctgccgtgtacaacagaacatcttaaccctaatcagagccaacgacctacaacctaaactaacacccacaaaccctccctttgtacccctagtcataaaccctaatccccatgtacacccaaaaccctaacacaataaaccctgttgacagtgtaaacccctaacctaaactgcaagacatcaaccacacgtatgtacatgcaagcctaaaccctactcacgacatatgcccaaaaccctaaacctagatatgacccccaggccgtaaaccctactaacgatgttaaccctaatactaacctaaattccgtaacccttcaccctaatcaacacacgcaccataaatcataaagcagtaacacttaaaccctaggtgtgtaccccggttcctacaccctcaggcagaacacttaaaccctactcaccccttaaatcctaaaacgtcaacacagcaaaccatgaatctaaaccctaagctaaactacaatacctaaaacattagtcactaacctaatatatatgtcgctaacaaactaaatacaaagcacagtcagttaaatcgacttacttgtcagcaacgcttcgacttcgacagggcttcgcttcaaaggatatcaagacccacgctttagagagaaggcagaccgatttttagagagaaggcggaatggatcaaatgccatctgcaggggattatataggcatttggggggccaaacatgccctgcctgggcgtgtttgaacacgcctagcttgggcgtgttcaaacacgcccaggcagggcgtgtttggcagccccaaatccctaattaatctccaaacagcccccttttgctaattaaataattaaataatattatttttaaatttttgccgcattgcggttgcttggtttagtgtctgacacgtgtaagttttggtagtaaatcgtgacgttgattaaatattggttaacattatacatgttttactattttgactgataactaatttatgtcagaaaattttattaattatctttagtgtggtattttttttaattatatatatattttttgtttataaaatttaaatttgaaatcttacatataaaaaaaattgaatctaattttacttggaccaataattgttcttgacattgattaatttaactttaaattaaaactaaattgacattgtcaatggtacataccaagttgtcttgtaaaaggagggtatggaatttgattttccattaacttgacattgtcaatggtacataccatgttgtcttgtaaaaagagggtatgagattgatttcccatgaggcaccgttgtccttcccgttcccatatccatacctacgccacatgtcattctcccgaccaaagagagagaaataaagaggaggattaatttgcatttatcaataaaagttgtaatgccaaagtgttgcaaatttgtaacttgtgataactttctataagataaccgtgaagtaaagggtgagtggggattcttcccatttaagagtcataagttaggacaactaataatttcagttgggggacagggaatgggaaaagaagaatttgattctaatttctgatcacatgtaatagtttcaaagtatgttttcaacaacaaaaggtcaatctagtgagatggccccccttacaatcctctttgttatttccaacaatgaaactaataattattaaaaaaaatacattacttacttgcaaccctatatatgaagaaaactcttggtcaaaaatattgtctaccatcttaggagcaacagcacttggaatatgcaggtgaggctatgaagcatgtccctttcccaaagcctatgaacttgcagtgggcatcacagcttggagtgtcttcgcatgatccaatacagatctgttggctgctcacagcatctgaaaatataacaataatcatggttgctactgcaagaataactttcaccaaaatcattgaaacaagtgaacgaggcactcttgtgtacgatcgacagcttattgtggcactttgtatcctgtttgttgtgtcttcttttttctgagtaatgatgttgagtgttgcagagaacgaaaatagtcctttaagatttacatcaaaataaattagtataatatatatttctctatcaaagagaatcaagtgtaattttcaaaagaaacaggagtattgtgtatatatattgatcactcgagagaataatacagtgtatattttaagagctaagcgagtaatgtgtaatttcttcaaagtgagaagaatattgataaaatgttgttttcattttttaaagtcacaaacatatttttcaatccgttcttgttgggcaaaattataatgttctgttagagagtaattgttatgtgaatataataataccaatagacagaataaatatcaaaagcccagaatgtactaaaacataccaatataaaatataaattcgtgtcatacaaagtattatttatatagtgttaggattttttgtatgttctaaaaataataaaatattacatcgagttgagacaatatgaaatgtaatcacagttttttaaatcaaaccggctggttcaaataaatatcgtcctattattcggtccgtcacactcttaaaactattggataaagaaccgttcaaaaaccggtaagactagtcaaaaaccgtacaaaccggtaaaaactcacggtgaagtaggttgaaccggtccaacgcaaaatctttaaactaacatcagaggaacatgcataaactaactggtcatcaaatataagacatactcaacaagttttttttttattattataagatttcatttcatgtataaattatttttaactaaattactttaaattatctttttcttcacctatgaaaattggaaaaaatgaataaattttcaataaaattaagatttttatattaaaaaaatataataaatatagacaaatttaatgttaataactaaattgattaaattttttattaatcatgaatttatcaattatatcttataatttaaaacagatgaagtaagaataactcaaattaatttttaaaatatatggagtttaatttttaaaagggactcaagcccaacaaactaagtaagactaagcaacccaaaaacttgctacatcagcatgcagcaaataaactcaaagagctagtgcaggacaaagccttcttaaccaaaagcatctgccaccaaattggtcattaacaatccttctgacaaaaaacagatgaacaacacgtaaaatatttttattgcaaacaatcttgtttgggtttgaaatatggaaaatctataaatccccgtcattttgtgttacaactctttatttagactataaaaatgtcaagatcatactatatcaaacataaactctttttaaatgtttagagtttagactgataattgatggatgcattctcccacggtcggttcattttgatttccaatgttgtctacactaagcggtacaatgtacaaaattgattgtcttgtacaattgttgcataaatggcactaaatcgtttccgctcaaaattatgaatctatccctaagttgagtttgttccaaaatatgataaaccatacagcacttatttatctatctatagagcatgcagaacttaccattccattcatgcatatacagcatttcattcatacttataccctataataaatatgtgtattaaagtcaaaagcatcaacactataagcgttggtgtttctataaaataggaaaagcctgaactcaaccatggttaaaataggttttctcatcaacatcaaatcggaatcagataagtatttacgagttcaaatttaattgttatgtatagaattacgtatccagggtatccttaaaaaatagtcccaagtgagagaaggtcccaagggtgttggtccctaccatcgctccacgtttatttaccttttttatgacaagaactttcttaaaaatagccccaagttaccaattcaacactatggatttaaaagaaattaaaagacaacacaaatattaacaaatcaacaaattaaagataaaaatgattgtcacaattaatttaatgggcttgatcttcgcaattttctttagtggagtcaccactaattttattgaaatatggaaaaaatgaaaaatcttaaaatttaagagtcgcatgtgcattggaaaggtagaaattaaatccaacgtcttctctaaatcacccatcccaatttttttgatgaaaaaatcacccatgccaattgattgtacaaatatttgttttcttattttaacataaataagagaaaaataattttaattttaaagaactaaaaactcacatagtttgattaaaaataattgtgaataggttattttttttataaaaaatattatatatttttaaatcaaataaataaacttcaaaaaatgacaaaagaaaatatacatcgaaaacggtaactcttgacgtctcaacatctcttgaagtaccacaattttccaccaaaagacttttttgatgcatctaccttttccaccattttttttaccatgttccattttgatctccattaatcttgtcaacggtaagcatgtggtacaaaattgtttgtgttgtaagtggttttccaagcgttgcttcaaattgcaaaagaaacatttttatttatttattttaaacacctttctaatatctaatatttttttgatcatatcataagttgtataatatttatattatttttttcagtcactaggtgtctaatgatatgatggatgtccgttcatttttttttttttgtgtgtcggtccatccaaaattatgaatctgcccctacgttgagtttgttccagtacgtgataaaccactcgtttatttataagcccgaagaacttaccattccagtcatgcatatacaacattttatttcttaacatggagtgagcttcttattccctcttcctattcacctttgcttgcattgttcaacactctgaatcgttcaaattccaaaaacttgccacttggacaatggaaactaactcttctaggtaagattcaccaatttctggggccacttccccaccaaactttggcaaacttggctaaccaacatggacccttgatgcacctacaacttggtgaaaagccacacataatagtctcttcagcagatattgacaaagagattatgaaaactcatgatgccatctttgcaaataggccccatcttcttgcttccaaattcattgtctatgatagcagcgacatagccctctcttcttacggaagagcttggaggcaactaaaaaaaagttgcatttcagagttgttgaatgcaaagcatgttcaatcactaaggcacataagagaagaaacgattataaacttgttagaaatgtctgtgcaaatgaagggtcaattatcaatcttattactgagtcagtgacaattgctataattgcaagggcagctaatggtacaaaatgcaaagaccaagaagctttcgtgtcaacgatggagcaaatgctactgctgttgggaggtttctcaattgctgatatctgcccttcaatcaaagtgcttccttggctcacaggaatgaaaactaaacttgaaagagcacagagagaatgacaagatcctagaaaatatggtcaaggatcacaaggaaaataggaacaagcatggagtgacgcacgaggattttattgatattcttctcaaaactcaaaagagagatgacttggaaattcccttgacccacaacaacagcaaagcactcatgtgggtcggtatgcattattctttaggattacttttgaagatttccatatatacaactatatacatagatatgaaatttactaacataataaattacacttataatatatatatatatatatatatatatataattgaagtagcaagttattaaaatattctttctatgcaaaataagtgattgtactatacttgttttcttgagaagatatacttcgtttattagatgataagttctgataaaataataaaattgtattttgattatttgttggtgataaggttgaatctgaaaataatctctcttttatatatactttatgatcaagaaaattaaaattttaccagttaaaatactttatctataaaataagtggataacaactctctcttttcctttctttctttattaaatagattatatttcattttcttttattcttcttttttctgttccatatggattggaataggatttttattttatcctattatgaaataattaaataatatttttcatttcatttatttggttctattttaatgaaaaacagaacaaactataccaatcccttgggtcatccttaaatatctaaatgagcttaccaattaatagcaggaaaaacagaacaaactatacggctataccttaatcccttgggtccacctcatcactccccctgttgctaattggctacatttttattccttggccaatttcgaaaggggtccctaaattattgccttcttggagaagtcttcaactgcctgggtgcccataccccatgcccattttgctttgcttctttcccaaagacgtgagtgaggtctacgttgtttttattttttgggaattgcgatgcgatgtcgtataagccactactacatatgtttttagcaacatttaactacttaatgttatgaataagaccattttgtaacatttataaaaccaaatgttactaaattatgatattattttttaaaatatttatacaaagttaaaatattgtcaaaatatttttcgttacattctacgtctctcaccgcacgtttgttcatgacaatgttcccacatctctcacgccaacttttgtcctctgtattcttatttttctcacacggcagcttcttgctcatcctataaaaatttaaaaattaataaattaaaatattatttgacccttttttatttgaaatgttaatactagttgtaattaattttttcggaaagatgtaccagctttggattgtgctacaccacatatttagctttattatcaagagtaaattatactattcctggtgaaatctctcctattttttttctttatttcatcaataactctttcgattgtttgaaaaatattaccttgataatttttatatattacactaactccttaattgtgatcatgttttccataagaaaaattgttgtaaacattagaaaggagtttgacaagtatacaaaatgtcatagatattaatctaatttactctattaataatgttctaaattagattgatggttaattaatttcaggacatgtttgttggcgggacagctgcaccaacagcagttacagtatgggcaatgtcagaactcatgaaaaatcctaaggttatggaaaaggcagagactgaggtaagaaaggtcttcaatgtgaaaggttatatggatgaaacaggccttagacattgtcaatacttaaattcagtcataaaagaaacaatgaggctacaccccctgtgaggcattattagtctcaagagaaaacagtgagacatgtgtgatcaatggatatgaaatccctgcaaagagcaaagtcattatcaatgctcgggccattgggagagaatcaaagtattggaatgaagcagagaggtttgtagataactcttattatgatttcagtggcacaaactttgaatacatcccctttggggctggaaggagaatttgtcctggagctgcattttccatgccttacatgttgctgtcactggctaatttgctttaccattttgtttgggagctgccaaatggagcaatacaccaagaattagacatgaccaagtcttttggcctaactgtcaaaagagcaaatgatctttgcttaatccccagtccttatcacccaacatcctaacttggccatcaataaaaactatatgataacctggctaggtgtgcttatttatctttatcaagtgtattagaacgacgtgtggtgataaagtgacttgtggcgtgtttgtttcacggattaaaatgaatttatgagaatataatattcttatgtatgttatgaatttggaaaaaaaatattattccttaaaggaaaatagttataatgatttaattaacttttattttcatgaagagtgacaaagatatatttccatgaaattgtaggaaattatgttctaatccaattataacttacattttaattcttgtttttttattttaattattttaattttgaaaatattaaaatttagtcaaacacacttttaaatatctcaagaatatacttaaatgattacgggctatttgtttcacagccagaaatgtgaatttttcatgtttgttaagaattttgaaaaatattcttgagtattgtttatccacattaaaataatagttataccatcatttaattcatttctattcatgtgataagaggtgaaatagttatatttctatggggttgtaggaagctatacatgttcttgcccaattataacttccatttcaactcttattttttattttaatttaaaattttagtaatatttttagtaatattagacaaacacattaatatgaaaatgtgataaaacatcatttcctgaaataaacacattcttagagcatctttaatgttatatcttgagcaaagatcttgaattcaagatttgatcttcactagatctcccaataaaagaaatgaagagatctccaacatggagaataagttcttatacaaaaattttcaaaatctgcgtattgtttaaaaaagaataaattttctctctctttttctctccctaagatctcaaattgagatctaccattaaaggaaaaaattagaaagattttaagagatatttaatcctatgtggtactatagagtccaccaaaaaatggtataagatctcaatttaaaatctaccactaaagatgctcttaggtgtgtttaatcagacatattattaatttatctttattttttctttaatttattttaaaaattaatcacttattaatagttaattatttctactatttttttgaaaaataacgattaaaaagtaacacttccaaatatgtacaaagagagcaatgatgtgaagtactcctttattaatgaaggtgatagatttaaacttcttaccaataatgtagctaaggataaagatggacgggtgtcctcttgaattacatggctgtattctatcactatgttaatgataaatacgtataggcgacatttcattatgtaaataattttaatttggattaaatgtaatttttcatcatctattttatttaatatgtaattttgatttttctattttaaaattgagatatttatttcttttattttaaaaaattcataattttgttctccaatttcaaaaatacaaacatttgatcttcatattttaaaaaatatgtaattttatttctgtattttatattttagaaatttataattttagttaaatctttaattttgtcaatgtttcattttttttatttctgtaattaattaaattatttattaatgataccttaaatgaatattttagatttatgattcaattaaatcaaaataaaagaaataaaattagacaaaagtgagaatttgaccacagttacaaattttttaaaatagaaaaattaaattgtgatttttttttaaaatagaaggactaaatgtttctattttaaaatgagaaaattaaaattacaaattttttaaataagaagatcaaatgtctcaattttaaaatagagaaatcaaagttactgaatgaacaaaaataggtggaacaaaattacatttaattcttttaatttaacaaagtttcaatattatatttattttaattaatcaaatagttaacattttaagaactcaccgtcttaactcatcattaggtgacacaagtatgattgtgtggctgaagtaattgaggttgtctttgtttatcattgtctcgatcataaggataaattcatagcagctagccaccataatatttaagtcaattagtattaaaatgaaatccaaataaagaaattaaactctagctgatttataccttcaaattacatccttccaagtcaatttaagatttgaaatttgacttaaactcaatcttcaatgcctataaataaacatataatatatggaaaatgaaaggaaacttcaaagatagccttaggctgaaaacatttaattgcaccattgacccttgatttgtgctttataattttttatatgcagatttgtgctttttaattgcaatctagaacttggcatattattttatctcgaactcctaacaaccattttaatgaattgtcttttcattatattaattttatgtttttttcttgaagaattgactattgagggtgaacaaatacatgttctttttttttttttgttataattgtttaaaatttacttttttgacagaaatttaaggccaaaaggaagtatattatataaaggggtgaataaacaagaggtgcagacatccaaatcacaagctgtgaaattgaatctgcatcaaccaaaaaaacaaccgtaggaagttacatggaaaaccgaataccccaacaaatccctacgaggcattcctagcataataagtaagaaccccaaagaccttatcccgtgtaccgatttccatcgacggtggtgtccctatgaggagagacctcacccgcgatacaaatcaaatagcatcaccaaaattaaaacagtcctttcaagcaaattaaatgacatgcttgacattcaaaaaaagagaaccaaactgtattattaataagctctatttagtttaaagttagaatttattttaatagagatatttttaaaactatgacgtgtctcttaattttgctgtaaaataaaatatgtctgaattttagtttagttttttatattaaaatgtgtgtttgtgaaatattaattctttgtgtaaagcaaagcaattaagttcttttttttaaaaggaaataatttatttaataaaaagcaggaagaagaaacacaccacatcatatctatgtttaacgtgagacaaatatgactttaaagtttaacgtgagatacacatgactttaaagtaataaattatgtactacaatctaaaagttttccatgctcacaaacataacaaataaaaaaaattaatttgttgaaaaatacttaatctcattaaaacttaattatcctcaagcagaagatcgattatcttgagctcaaatttaagcttcaccatttcatcctccggcataatcatggtcacaaacttcccatcaactccattcttgatagaaccttttggccacggatacaccaaaacaaccccttcatctccaaccccttgaagggtgtagtaaacaaactttggtgtttgttccttcaattgtaggtcatacacattggtttcttccaagtctagaaatgtcaaattgacaccatacacaaagaaatcactcacaccttggtctctctcaactgcttcctcaatttgcttcctctcatccacaccttgatctgcaagcatgctagctaagattgtcaaatcagtgtcaacaattgagcattcacttccagcctcaaccttgcatatcacttggttgttacctatgatatcatttgccctcttatacgggtcggttctacacacggtcacggttttaagttcagatcctgatcgaacccgagccacgcaatgccaaatcatggcacatagggattcaaaaggaggagtttggtcaagacttggaccccaaattcgtgcttgcaagtagttcaaccgggagctagttaggtggaaggagaatgtgtccatttttttgttgttggctgggatccaatgatcccccaccgggtcaaaccgttttgctgaaactggatccttttccggctcgggttgtctgagtgttgggacggatcttgggatgttaaaaagctttgttaggccatttttcattattaggccccatgagttaatgaatcctgaagccgaaagcgggtcccccaatacatgggcccaactaagacccaatgaaattccaccgcacttaaatttagttacctgcatattgatcaaacgaaaattgagttacctgcaaaagccaagttgtatgatttacagtgatagaaggaataaccatctagaaataaattttcagatttttttttttatatttcgtctttaccaagtaaaaagaaacattaaacgtatttatactcttttatctaaatgagattttcaaatttttgcttctaattttcttatgtaaaattttgcttcttttactattattgtagtaaggatggaacattttaaaaatggagataagacatcaatgatattaatgtaattgtcttttaaataattttcgattatatttaatgattaaaaattactcctctcacctaagacgacatctctcttaattaattttttaaaaaacatttttttattatgcaaattaggaaaacatctttctgaacttttcattcccttgttcgtgtattaagcattaaaaaataaaaacaataataattttaccgtattattatttttgatgacttgtgtttaattcgacaatttgttgtatataatatgtaaaattatattaaatgtccccaggaaaacagtctttatcgaatttaaacgtgttaatgattccttaaaaaaaacgtgttaatgataaacttcattgtataccaaaaatatgagcctgataaactcgattctgatcaatatcggcgtatctatatagaaagagtctgatagtaaattaaaacttcattgtataccaaaaatatgtgtatgataagatttaaagataggtttaaatactcctacaatatccactttgttactctatgtagtaggtagtattaaatattaaatgcttttatttataagacattaattgtatttattttttcatataatatttatttattaaatgttaaaaaatttataagaagattaaacattactaaaaatcaaaatattacctcggaattatttatatataaaaaacaagtaataatgtattttaaccgtatacaagattctgtattaatgataccacctttttcttttttttttttgttgaatagttaggatctaccttatccctcttatgaaaggaattgtccaccataccatactatactgcgttctgaattaatgtaagggcaacttatgaagataggatggtattaacatctctaccagaaaaacattgcgactaattaacaggtcactatttcaaccaaaccaggacacgataaagagggggttttcaccaagagaaaataacttcattatgaatcaaatgaaagtattctttaattaattcttaaataaaaagtaagtaataagaatttttacgatttttgagtataaagtcttaaaaaaattatgattttgatttttttttaataatgaaatcataaaaaattcaacgactttattttttaaaaatatttatataataaatttttcaccactttaaaattgtgattaattttaaacgattttaaagtcggtttaattataattttatatttttgtttctactattttatttttctatcatgtagttggacactataagtctacaacttcatttttctcctatttcttttccttttaacatacttatttttaatatatttttcaatcaatataaaaaatgtatttgtacaaataatgaatgttttttcctttttttataattttatatttcatattattgtatttctattactctacttttgtgtcatactatcgtgcaagacaagttatggtataactgattttatttaatatttttatattttgttttgtaatttattattatttgttaaatttagaaacgaaaaggtccaaaaaatataaattaataatataaaattaattccttatttattttatctaattattattggttaagaaaatattaatcaaaaaataattaatggttaagaaaaaaataaaagtcattggattataaaagaattaattattttaattttaattattctttcaacgactttaaagtgataaattataaaaaatattaattataattattttaaattttaaaagaactaaaaaattaattataaaatataaaattatgattaaaataacttacaaaaaaaacattaatcacgattttgaaatagtgaaaaattatgactttatataaataattaaaaattaaaatcatttaattttttacgatttcactattaaaaaatcaaaatcatgaattttatatcactttatatccaaaaattataaaaattcgtacgacttattctcatttaaaaattaattcgaaaattactctcatttaattaattgtaaatggagggttaaaccttttagtagttctatgttccagttattccctgttttaattcttttcttcctcttttctcttctcctctcaccattcttttatatttaactctgtttctctcttttgctttattttcgatttatcattgggttcatctaccaccgaccccaattaatttgggttaaaggtactgttgatgttgatgttgatgttgacgttggaattatctctttttgtcaaaattcctatagagtggtagggtccttacgcatgttttattgtactatattgcgcagagggggcacattaaatgaggaatattttaatcgtccattaaaaaatttatatttgagaataaatttttacaattgtatgatttgttttgtgtatattatcatatgtctagctgttatttttttaataaacaattataactaactaactgttttttaggaaatggaaaataaacagaaaaatatgattttcaaattttcttattctttaaaaaaatcttatttaaatttcaaatattttatctttctccatcttcttactgaatgaaacattggataaaagagtcgatgagaaatacgtgttgtacagctgtagtcactagcgtagcaggactaaaccccagttagtagctagtagctactctttttattgaggcattgattattgtatttggtaatccttcgcggctcacaaactagtatacaaagtatatcatcttttgaaatattaaatcaacaaagaaagaaaaacactagtagtcctcaataactagggatgtggaccatttcatgaaaaaatatgggttggattaagattttgtgttcatatttattaaaagagtttagttgaacgagccggaccatcctgacctgtaataatgtaggtcaaatgtgggccaaagtcagtccagtccattaggttagtagctcaccaataaaaaataaaaatatttaatacgtaattaaataaatggtttagaaggagagtgattaagaagaagtgtacgattttgaataatccctaaccctaatatatttccatttagaatctaataatgagttatactatatgtacaaatatgttttgattgtctgcatcattgtaaaacacatttcttataatatgttaaaacttaaaaactaattgaaaatcattgttaaacatgtattccctggttgcttttacttctattaaacatgtatttatattaaaaattattgttataagattaagttaatacatattattaatttttagtataaataattatatttaatttttaaaataattttttacctttttaaaaaaaatatttatttatttattttttatgggatggcccgctagtccactaacccactttaaaatgggacgagctagtatttttagtccactttgcaacaatgggtcagcctcgtccggtccacttttttgataggttggaccagtccagtccgtttttgggtggactgatctactttaccatccctatcaataacatcaacgaacatgtcgatacaaccttaagtaatttacatctaaaataaattttaataagataaatattttattttaaatgaaaatatatataatatattagaccttttttgttaacgtataatattatttttaataaatgtgtttttttatattttatacaaactaaaaatatttttttatgagtctaaagctttaactttgtttgttttatccttaaacaggactaccaagtagctagggaaacaacgttgtacaactaaatttgtatctagagaaagttttaattaacttttttctttttaggaagaaaacttataaaaagtgtttggttttctgtttataacctttggactatatttggatggtggaaaataagctttaatttactttatatatatgtttgataaaatcactttcaaggtatttataactgaatttcaatataaaaaattctctttgtcaagtaggcgaaagctattactacttcacactcaacaaaaaccttatcgatgcaaaataaatatatactccgaaaatatttttatactgtattttaattgttcattcaaacgaatgacaggaaggaaacagctaccaaaaactacgagatgaagaccccatataactaatgaatacgggacatcgtttctcattgatttttgattttcaaaaatatattttccattattacttggtaaactagagacaaactagacgttcatctcatagtgttaattagtactacaaatctatgaaaatattaaacaaaaaagtaaatatatacaccaaatttaaaacataaagctctctctcccaaaataaatatcctcttacattattttacaaaaataataaataaatgaaggaaaataatagtctttcaaaaaattaaagtgatatttattagagttattggtggaaagtcattctctttctaacactctctttgtgattaattattttttaaaattatcaattttgataaattttatatctaaattataaaagagagtcattaaatgataagtgagatccatcaaaacttaaacaagtttcaaccaataactaaaaagtgttgaaaaagagagtattaaaaataacgtcactaacatttctcttgatgaaaaagagaattaatgttacattaaaaagtcaaatacaatacttattttgaaataatttttttgttaattgcaacacatcggatgtggaataaccaatactcaacattcaaaagaaatataaagattaataagaaaatcttcctctaatttcattgtggcctttcggtgtctattttcctttaactttattcatcagttaaatattaacaattaaaaaaccttttatctccattagtttgaattggttgtattttgatttcgagtgtgaaaattatagaaatgaaatattccatttcatgattaaaaaaacactaaaaaattcctatgaaagtagtactaggttttgtcatacataaaaaatgaataataactaataagtgtgtgtcacgagtgatgcataatatataaattagtatagtatctatagggaaattattaagcacctgcaacaaaacaggaggagaaaaagataattctgggccaatgacttggtgagagacgagcaacttgtacaagggccaatccttcatggctagccactcatctagggttttgttgcacttggcctcaatgaatcttgctccacaatcattgcacttgattaagggcctacctgaatccgatcgccgaaaccggccacatgtgatgaagtaatggttgaacaaagtgaacatgccatctttaattttcatgatggttaggtcttgtgcagcttcattatcaaagaagtacaccactctaaggtagtgaagcttcatagccaaatccaacccactagggttatggaacacatctgacccggtggcccggcctggcccaactgaggatagcctaacatcatgcactacacactcttctaagaccattttggcttgatcctagaaattgaaagcaaactctttggttggtgggatttttttttgcttaacaaaagagagagagagagagatcacaagggaaaactggaaaagaggctttgattgttgtactaaagtgagtttttgcctacgagcatatatagagtgatggagtggtgtcataagtgaaggaccatggagtggctggttggagatttaatggaaacttactatgcgtttcattcccattgggtcgtacgaaataagcggttggaaatgccaaatataaatattattttttgaaacattattgatcatttacaaaactatttttttttaaattttcttcatattaattatttttattaaaatactgttaactattttagtccataaataataaatgctataaatcatctttttttctttttcttgcgaggattgaagagttgaagaaattaggtttaaaaactgaaactcactgttattattctctccatatattaattatttagataaaaagtaattaactgaaaaaagtaacataattagtccaaatatttttaagagtaattttagataaaattacatttacaaacaaatttaatgttagcacttaaattaactaactttttaaatatatatttaaattagttataagtgtcttatattataaagacgaatgaagtaaaatattattactttctccatcccattattattgttgtgtaagaaaaaaattcaaaataatgtcatattaattttttatgtaatattaattaccttttttacttatattttttgtaatattaatgaataacaaaatttataaataaattatattgataatataaatttaattttataaaattattattctcttatttatttattattttttcttaatctatgtaaaataagctagaatgattattattttaggacagagagagtagtaaatatcttaaagatacttgctaaagaaattaataaataagatatatattaaatttgtactagaaatcctgaaagaatatattcttccacaatatttattttgatttttttctcttacagaacatttattatgattcagaagtagtaatattccatttctgattaaaaactttccacttttcgttatcattttccgtatacttcctctatttttttaaggatattcttctatttctttttaattgttgagttcttttacaaaaattggttactatctaactgttattttttttaaaaaagataatgttaattattattttatcaattatactcttatttttcacttaatttttaattattttacacttatgcatttatttatagaatggaaatgaagaggatataatagaaaagtccacacgaatgtcatttgaataaaaaaaattattacattttgtgtttatatagaaaccttaaaagatagataaaaaaaatgaataaattatttttagacaaacattaagaacactgattaaaaaaaataaaagaaggaagctttttaataaaatacgtaaaatcatgttttctttgattgttaaatacattctcatataatttcttttacgattcttgctttcccttttatacccggactcatttactaataatgcgatcaattttacattgttccccacattcacatggcaattaatattatagtctggtgagtggtgacatctcaccgatttatagaggaaaatagatcgatgtcatccacattggtttgttacgctttgcagctgcgtatttatagtctgtcgtaaaggatatttataatcctaaataagaaaataacttcaataatttctatgaattaggtgtttcaactttcaataacgtttgaaccggctaaaacttatatatatatatatatatatatatatatatatatatataccatattattaatataaaatatttatcgatttttctgataatcaatatataactcatatcaacaacttcttgactcagactatgtacggtttggatgttagtaggaagtatttacaaaaattcagaaggaataagtatataaacactcaaactgtgattttttaaaaatcaatattataaattttaaattattttatttactacccaaattatattattagcttggttattttatccagttagttggttactcctaatgattttttttttaaattatcacactaccaatgtttcaaatgtacattgtgattatgagtttccatgtaagaatgaaaaataaatcatctaattcatataatcatatttgaatggataaaatttaaaatctcattattactcaaaagagttatgtaactttttaaaaattgtgcataatttatgttatttaagcttaatcatttatataagacatcagacttgatcgaaaactaaagcaaatacagttcgtatattttaaacctgatatataacttttatttaaaataatgttttttttttaaaactgttttaggcccatatatcatattgaattgtcctgtaagataggtgtgtactcgcactttaaattcgagtaatgtatatatagactactaaatcatatttatattatcaaggtttaaagaaaatgtacgtgactttgttacttgggaatcggacaactacttataatcttgaccattcatatgatatggtccatatttattgttcttatttcttaaactaaacaagtgttgtcgcatgaatagttttcattctcatcagattcaagaaatctaatgatagcctatcttacattttttttaaaaaaaaatatatataaaaaatactaattacattttaactcaaataatatatataatcaataaataataactatttttttaaaaaaaattaacaattaaattacattttaaataaatatataaatttacctttttattaaattattattgttattttattattaactattaaataattattatattttaaatatatggagggaagagtagagggttgtatccactttaagaaattgaagaaaaaaactcaactccaacctcaatcttgattaaagtgagttttcatgtttgagtgtcaaaattagtatggctgaataacggggaacatgctttcagaatgggggagcatgctttcggaatgcacaataccatgcatgcccaacccaaagcatggcgaggccaactacaattaattaatgtccattattttgctcacaagatgtacttcgatgtggagggccaacgaattccattaatacatataaattttttttaatcatttactaatttttgacattcgatcttacgtttcatctaaaaaatcacaatgcaagttatttattatctcaatccactccactcatttataggtactattaattacgcgtattctttattttgattcattatattttataattattttattttaatatattaaattttaaaagttttattttgatcttttatatttttaaacgtatcgttttgattcttttttcaatgttaatagaaatgttagtgttctattaatttttaaaattttaaaataatcaaattaaatgttatatttttgaaaataattgataaatgaaattattatcgttattaaatgattaaattaaatgaataaaataataataataatataaaagtgatagttgttgtccgtagtttcatatctatatttttctaatttatttaatgattttaattttttaaataaaaaaataataatgatttttagtcgttattatattaatttaactattctaaaatttaaaatactcatagacattaagtttctaataaaaaattgaaaaaagaataaaaaatgatacattttaaaaatataaaatattataataaaatttttaaaacataatatacaaaagagaaacaaatgtgaaatataataaataaaaaataacattaaattattttaaaatttaaaagttaagataactctaatatttctaaagaaaaattgacaaaaagtatcaaaatcatacattttgaaaatataaaaaatcaaaataaaacttttaaaatttaatgtataaaaaatgaaacaattgtaaaatagtttttttgtttttaaagaaagtatatctaagttgtttttttaggggaatgatctaggttgttggaacaacaatattacatatgtataaattatactaatattgcactattttttactgcagcactataaatattctaacaccatttttgtatgtttttttttttgcaaaacaaaaaaacggtaaaaaaattataagatttaattatattttttatcctcagtttttttttattattggcgaatttaatgattgggaataaattttgaacttttttataaattgatgataaaatgtgtcgaattaaaaaaattaaaaactaaaaaattagtaataaaaattataattaagctaaactataaactttatgttattaatgaaacatgcaagctagtaatctatgttggaccaacactgacctttcctgcgccttccctcactttttacaaatcatttcaatttaatttgagtttaaatttatgtaattaatactcgataagtataatttaattgcaagcacacgcttaatttgtgaaaataaagtgatatatccaacctttgtagtttgtaccatatatcaccggaacgaatccagaaagacattaaaagaaggttcaacttttatacttttatttaagtatctaatttctcattgataattatttaataaatatatttaaaaaatatttattatcagttttatgtgtaaaattaaaaccaaaatcgatctactactaaaagaaattaagcattgtaccaaaaaaaaaagcatacatttactcaaccttctatttattaatttattttcttttgtcaatattttttaattttactctttttcttttcatgtatataaaggagcatgagggcccttgcgcccctcctaaatctgtccttgtatatcactatcatattttttttattccattatttatttatcttgactatcattatatagggcgcgcaacaacttttacagtaactatatatcaaaattattttttaattcctatttaaaaaaatagtatttatgtaggaattatatacgcactataatgaacatatgataattaattggaataaataaagtacacgtgaaaatttacatataggaaagtaaaagatgcaactaattaataaacacgatataatgcatataatgaaaaatgaaagtaccacttcttatagatattgtatctattgagttataagattgatttagtaattgaataaagaataaagaatggaggtaatggatttgagtttattaatgaataaaaattagcaaactatcaactaatatatgattgatctaataaaaagtgagaccaaaaataaaaattgagaacgatcttttttcctttaaaaaatgatatctggaacttttttttgtttatatataggaatggaagaagttttgagagatttataacaattcaaatattttttttcaattttgaaaccttttaaccaacatattagatattttttacttttaaaatgttaataataattacaaaatttctgtctggaagcctaaaactcgagatttaattagttgttttatttttgaacaagccatgttagtatttgtcaacaaaatatatatatatatatatatatttgcatttacaagctgtcaatactccattttatcaaaatttcgggatctaaccttgctaattcaagaatttcaactcccccattcttgcaaataaatatcttcggatcaaaataaaatatcaaggctctaaatcagccgaaaaggtatttccattgtccccattccccaacctttttgccgttcgtgttactgatgcaacatgcaagtatccaactcatctcacatgcatcgatcactttcatgttcatcaaccttcatcgaatttaaacaggtgtcaactgcctattgatagaaatgaatatataatgtcagagaaagtagttgaagtgaagataatagtcctacatacatttcatgttgatgttgataactaaatccgggttgctaagttaatatgccatcaaagtcttaaattcgatgtagttttattggtttatagctgacacctagacacttcattttgtccattgagctcaaggtaaaactaataactttgtgcaggacatgcttattagtttttgtccatagatcgaagtctctgtcaagttaaaagttttgaatgctcagttacaatgactttgattttaatttggcttatccaaaaaaaagttaaaaggtttggtcatcttacgtgtaataaataggtttaaagatgctttttcaagttttgtaattagttttatctaaacttttgttatttaattatattgtgcttgtggtgtttttttttaattcttattttttagtttttattagtatgttttatcattatagttagattttcaatatatttattaggttgtttaggtaagataagcatgattcaatgcacacaataatgaattttgtacactcatagggtgcttggctgagcattctttttgcttcattccccagcactttttaatcaaacaaattagcttacaaaaataatgccagaatatagcagtgaaattaagcatgggcgtggattaattactctcggtgacatgacattcagaatttctcttcaatataagtagtgggcatactttatcccatgagttaattctcttagctttatcctcttagcttcaacatttagtaggaataagtaagcatcgcctctcaatccaatttgtcagtatacaaaataaaccttccaccatagaatagagaagtctcttggtcccctcaatcatctttcccctgaacctagttaaactcccaattgagagcttctgaccggttcaattcaagggtgggtctacccattatggaaaggtcattaccctccctatccttttcttgattccccattctacgaattcgttgttactaattcatcaaaggagcaaaagcttttggttttaagaaaagacatatagatcatccccacttctttgtaatcagatcttcaattcgccaattaatattatgatgaaagctcctgaactcaagtttttcatgttaaaaatgttttaaccttgattaaagttttttctataaacatgcatttccctgatttgagcatcaattgctttatacttatgaatgtttatcaccatttattaaatgttttgactcatttatgttaagaataatgagatatataactacgcgcttcttgcatagttgcatttgctgccacgaatgaagttatgtatagaaataaataactttgttatttagcctttgcttaaatttcatagaacttcataatcaatctcattttgttaatttgacttaaagaaataagcttgttaattaataaagttcaggtaaattttccccaaataaattttggttgtaactaattttgggaatttcaccatcaataagaaattgggatatgaaaaacaaggataagggcaaggaaaaagttgtttaatttatgaatccgaattcaaaatcaagtgaaattagatcctaatattttaattttagtttttatttcccttttagtgtttatttaaattcttaaaaggaaaatatagaacagatttaatttcttcaattactttttttattagtaatattttagaaccgtcttcttcttatgaaaatgatattcaatttcagctagtgtcccagtaaagttatcggattattccctaagtcagtttccaggcctataattaagttaatatattctttaatattaatattatatgaaaccaagatcatgagataaaaaaaaagttttccgtgtcaaatgttgcaaggtgaaaatgcgctttttttgttaaatataaaacctaaaaaagattaaaaaattcagtaagattttaaaataatgacatattttcaaagattaaaaattcatttaagtcattttctataatacaaatattcttctacaactaacagggagaatgacatgaacctaactcagcaaaccaggttttgctaaccttgttatagaatccccacaaacgttttccaagccgctagaggagggtcagattttttatttttttatttatcagcaaacaaagaatattatacaggaagagtaccggcagggttagatatgtgtcttagctagttattatatataaatgtctaagtcataattaattatgatagcttagctaactcttctattaactaatggctacacgtttgcagcttcatcattcatacaccaaaccacatgattaggaaataaccaaatagccttccaaaaccaacttctgggatataaacgaagaagaaaatacgtctatttagaattttggatatattcatttacttctctaaaaacactttaaaaaaataaaagtaatatattttacataaactaaaattaacttatgcacgaactaatttgtaaaaaaaaacatgagtttttctaaaacgtgatttttaatttatgaaaacttattttattttatttttcttctaaaagtattttttggaaaaagttatccgaacataccttatactaaataaataagggattcttaactttgtactattgaaagtaattaaggagaatttctataataaaaaaagagtaaggagagtttcttactctttagcataaaaatgtagttaagacttaagagtgatacataaatgacccactagaaggctataaataaatgatccacgtgttggggtaaataaactataaatagcagcaaaggagacattataaataggggagtagtggaacagctcaacagcaggcaaaatacacacagtggtgtaatatgggtggggtacccctgatactctcttctatttatattttataatatagtgcatgttcaataagacagaagctttctagctaggagtttctctgtaatctataattaactagaatggtgatatatatcacttttttggtgtaatctaaacaagccgtgtattctactgtcagaagaaatttatctgaaatcacacacttatcccaattctgttgtcatatatggagatcgaccctcaaatctgaatggtcccaactcaccatgttggttcatttgctttctccaatgaaaaattgatatttattattaaattaaatacttataatatactgcaactattcttatataatagattaaaaaaattatttatcaaagtaaaataattttccatagtctttttcacccccttactttcttcaataaaaattatatgtctttaatttttacctatttgatttttctttaaattgtaaaactcacacaaatcattttctactttttttttccttctccttttcatgcatgcatggtgcgtcattcatagtgagagacacatggcttcaatcttttttagtttcaatatttcggcttttgtttaatttgagagagtttctacggttcccaaaaaattatgagagttttgacactgtttgtttttttaaccgataaaattattatgttatttgtcgtcttattaattaaataattttttatttttttcaaattagttcttgattatttaaaatataaaattacaattattttaattaaaaatttgattaaatataaattagagtaactattacctcaagaaaaataaaattgtgattctgtattaatattggtgaaagagattaggattcatattttaaacttatgtttaatcaaatttttaaaatttaaaatagttttaattttgattttaaaaactaatttgaaaaaaacaaaaaatctttaattaatgagaagatgtatgacatgataatttcgttggttaaaaaaataacaataccaaaaccctcacaattcttgaggcaccataaaaattctcttgatttgatccttcaataattatgatgtcaattcatttatactttttttttcttctccttcttatcaattcgagtcattcatagagagagagacattagtttatttattttttcttaaaatttcagtattttgtattttgtttgatttgagtcgtttgaccctgtccaataatcataatgttcattattttttcattaataagttacaggacaaaaatcactcaaacaatttaacgtgtgattgcataggtaaccactaaccactacaaatattaaaagagtctcattaaataaaacataagaattgaaatttgtttatatttaatataaaaaataagagatttttattatttatatattcattgataaaaaaaagttacacaagaagcgtattagagcaactttagtgcaagatcttgagtaaggatcttgagctcaagatctggtctttactagatctcccaataaaggaggtagagaaatctccaacatggagaatgagttcttgtagaagaacccttaagatctgcacattgttaaaaaaaaaataaatttttttcctctttctctctccctaagaactcaaaataagatctaccattaaaaaataaaataggagggatcttgagagatcttcaatcctacatgacactatgggatctaccaaaaagtgatctaagattccaatttgagatctaccactaaagatgctcttagactattaggtctgagggtataattaatagggcgagacgggaaggttgttttaactttgaacatgtgctttggtggtgcatgcatgcagctgcgctgtcacttgtctaactatatatattcaagattactagcagaatttatagcattggttctacttcacatgacaactacattagtactatttatattcaagattctactgtgtaaactatcctttagattgtgttttactgattttattcttggtcttttttttaaacaaaaaaacagacaaaaggtttcatccctcataattttttatgatttttttccgttgaaattaaaatcaaattctaaaaagtttataataatttacgcactttattaaattaactaaactaaattccgttaataaaagatatgaataaataatatgcaaggcaagatccaatatactctctattaaatacattatcaattatgtatctattattttatatcttagtgaccaacttaatttgctgaaagtttgagtccgtaattaaaactatatacattcaaaaaaaaaaaaattacatatgatatggatgagcatttttaaattctaatgtataagaaagaaaattttattgctttaagaataaaaataatttttattaagatttgttaacaaattttataattttcaataaattttaaaaaattaaaataatgtgtttaaaaactgtgttaaaaaatactaccaaacactaactagtcaaaaaatttatatgcactgtgaaagattaatacatattagcatacatataaataaaacaaatattttataccattatttaacaatgaaatcttatgtattgtaagatagttaactttgtaatagtcattttaaaaattaatttgaaagtaatttttaattaactagtaaatataaatagtgtataaaaactaaatttaaataaacttttcttttatcggattttatatataccatcatttcagactgaataatgaacactgaagacttcatcaccacttttgtgttctgcatcagactttctagccaagtggcatgttgtatctgacaacataaccatgatagatatataagaccatctccaatgcagtattttaagagagtttcaccaaaactcaataagaaatccatataagcttctagcattggaggtgcccatgtactatcttctaaccatggaatgggacgtcattcattgttacttgtaagggaccaaaccatgtccttaattatttttttaaaatattactatgtataattgttttaaattttatccatgaaataactttctttttagcctcctaattaaattttctccttctatcatagttttggccataagcgtaaactattcacttgatcactgaactgttatcattttaagtttgttctcataaaaaaaaattgtgattttttagttcctacaaatgcataaaattttagttttgcttctatgtttcctgtcgttaacattggagaatactttaattttaaagtgatataaaattgttataaaaactttctgacggtgacaaattactaaaaaaatatttacgaaaaaaacattttcatataaatactaaaactttttttgggtaagatataatgactagataatttatcataaagttcatgtcggctgagaaaaaaaattaatgttcatgtctttttcgtcataaagattctcggttgacaaaagaatgattttttttttattcagttcattagctttgtaatctttcctcgggtttttagttctaggcttggccctccttaatcaacgaaaacaacgacggaagctgaacatagctatactgggccaaagcccaaaactaatatgataaacatgggatgttggttcatttcagattgagctttacaaaatgcaatgggacacagctggaaacaataatgagtataggaagttttagtcataaacatgttgttcaatgttttatctctagaaagcatcaggtcaagaaatgaggattcccatgatgatgaagaaagaaagaaaaaactcagatagccattggaaaagtaaagtaattgttaaatgtatccatcttattgttgctaaatgtatccctcctcctttttttttttaataactttgcttatatacatttttttctacttttctccctcttttcaaatatatctcaccttctttcttcctttggcttctccttacaaatactacctcttcattcctagtccattttctggctattactttattttctttctctatgccttcgatcgcttgagtcatcctcttccaacaatgctatttattcggttagcacaaactaccccttagctgtaaaagaacacattgaaagctcatattcttaatatgaaaggttatattatatagaaagatatttcatgttctgtttgaatcatgttcgtttctactaagtttagaaattaaattattaaagtggctgccagagattatcctttggtgtttgtggtaaggccatatttttttttgttcgatactgttgtttcaactatgaatttgtccttattattttgggattagacacatatacaaaacattataaaaggaatacatttgtaattttttattgcaaaagtcgtcagagaagaggaaagaaaaacaaaggcattgtcaaagaatatgaaaggtaaagaactgaaagaaagaagcagaagtgtagaatatttgaatgggttaaaagagtaagaaaagggggaaatgatatttatgtaaaattactaacagaaaatgggaaagaggtatgtttaacaattgttgggagaaaaaaaaatatataattggaggctgataccatagttttgaagaccgatctgttgttggaagaaaaaaaaaacacatttagaggctgataccatagttttgaaaaccggtcctttattggaaggattaaaaaacacaattggtggttgatactgatacaaaaattaatgtttaacaattggagggaactgcgaaatttgtgcagagataatgtcagaatataaaaaagaaataaacggaagataagaaacatctacaactaaaaatacggaaacagatcttaaacaacaatttcactatcctagataacagggctcttttctaaaagaaagataaatcttaaacaaaaaatcctaaatctttttttttttgagatgaagaaaatcctaaatcataacagattacaaaaaattaaacaagttgactaaaaaagtaaagttttcattagttaggctgaattttgaatccaattttgaaaaacaattaaaaccaaatcaaaccgtacttatacatagtttgatatatcaataaactttaccttgtttgtggaagacttgaaggtgtaacaccagtacaccacctttctctcttacctaaacatggacttactaatgataagttactataataccatagagttttttttaaaagcaatgttaaaccacacaatcaaccaaatgattggacttaaatgattaatgtactgaaattaagattgaattatttgggtaatatgtaagtttaatcattgacaaaaataaattttgattagattttagttatcttcctaccaaattttaaattaattaaagttcatttttataatgaatcaaaaggttaagacaaaaaaattcccacaaccaaacataaagagtttcatttataaaactaactaggaccttagttgtataaataaaattttataaaattccattatcaatttatttattttctttataatttcattatctccattatcgttttattttttgctgacttgaatgtcttattacggtatcaatgttataatgattacaatgtacttgtaaacttattaaatattaactgaatgttttagaaataaaaatataaaaaccaaatcatttattcaaattaaaccgtaattcacttttataatttaattagataaaaaaacattatcagcaactttttgcataaaaattgattcaaatcaaattggggtttactatgttatctacacttatataatatttaggttcaaaattctgagtgtgtacgtacgtagcaggtccctctgtataattgttgtaggctccactattttaattttgttgaaagcttagatttttaaaaataaataaataaataatgtagcataattaacttaggatatggaaccataccctctctaccaggtttgtgtctcacaaagcaaggcgatattgctttcagctaaagtgttacatacaaaaaataaatataaataaaatgaaacatccgttaagtatattttaggattagtcaattgttctcaacgttttgcatagatattttgggctcaggtggtggtgttattttgatttctctggtgtgatagaaacttagctgaacattgaaaagactcggtagtcaataacttataacttctttttgatgctgaatcctagcatcaaaattggcatgcaatcacaaggttagattcctccttaactatgacatgttcgataatttaatgcatagatggactttgtaactgacccacagttatgaacctccacccccacggccccaccgtaaaaaaaatgttggaaatctaatgcaacaacccagaaagaccataaacggtaccacttagttgcaatatcccttggacgacactgggatagcattgacttgtcttctccttaatgaaatatggttaataagaaaagctgttaaagtcatttgagacgatattttgcaagtggtttaaaaagaaaatattcaaagcaaatttacaaaacgaaagtcacctttcacatctttgatttacacgagtgaaccccaccatctattaaaaagattcaaaccatccatacccctcctactcaatttaaaaccatcttgttatattatcccctacgatataattccattcaataatcattaacactaaagcaaaatgattcaatgaccaataaaatttacaggaaactgaataaatgaatccgattacttctttttccccttctctatcatacatattctcgtaaaatcagagttctatgttacaaatcaaaattgtggtggagttgcaaagaccacattcacttgcaaattctcattctcaattaaaagagcagctcagctctcagcaaaaaagaaaaacaagttgcaaaatcttgtacctctcccctccccctctccacaacctgtacaaattctctgttgtctaaatgaattactatgatgcacaaggtgagagctgcacccccaatctggcagtaccaagcatgcaacttgtgacagatgttccctttccaatcagtaaaaaatcaagacaatcagttgcagcacgagtcaccatccaaacagtttaagatcaaggcaaccaatgagtcactcattatttgctgccagtgtgcaagcaacaaaagaatgcatcaagaaatttggaaacattttccggtccatgcttcagttcctcccacacggagtgtcaaaggagggttccttgtgcacacatcataattgtttgaagagcatcgtgtgacaattaaataatcaatcagtacggaatgacatatggaagagcaaaaacatctgctggctctatgtgcagagcttctgcccatacctgaggtgtctccccaacctctgaagatttcaccacagattttctttcttgcgaaacattgctgccaaatagccacgcttgatcgtcaaaatcagaccactgctccaccttaggtactgaatatacctggcctaggtacttggtatctggatgtggtggctttgcagttgcttcagttaccaaatcagctggcacattggcagtgtgagtcttgtttgaagaagctgcaaatggctgactttcaatgatgccattcatcttgctttctttctttactaccttaacactggtggcttctcgtggcctatctgaagcatttggaatggaaacttggcaaggttccaatacccttccgttttcagtgagtggatgagaggaagacgatttcggaaactttttgggcaaactgtcattgactgtaacaaaattaaaaaaaaaaattataacctgtctattcaacagcaaaaaaatgcgtacaaacttgagaaaacttgtcaatatgactgaaaaataccaataattgaaatatcaatataagcatgtgacatcagggaaaacccaccgttatctcacaggacgtagtatctggtattagcttattaggtcagcaatatactagtccaaatccagtaagagaaacatcttattcttttttaaatacaacttaacaggatcattgagtagaaatgagaacaagactcatcataagtaacactcaccatgtggaactccatttgactcaatgtccttccgcttcttgagattttctccactgacagcgttcccatggctgttcctaaaaggctgtgtgaaagaatttgaatttataagtccaactttgttgctttcttttaatttattttgctctgttgttttaagttcactatgctccttagctttctcctcctttttcttctctttgtccctgtctttgtccttcccatgccctttcttctccttctctctatctttccttttatctcttcgtttatcatcttttttttctttaacctttttctttccttcatctttcttttccttaaccttcctttcttctgtcttttccttggccttttctttttcatctttcttttccttaaccttttctttaccttcaacagttgcttccatattcctttcaaaatactttcccaaaagtttgggtattccaccaactccaggatgaaaatttccaacatgattctgaactggtggtgcatttccaattggccggacctcatcctgtattcctcgcccatcaatcttcttaacatgaagacccatatccttgagtttttcattaccatcagaccttgtgccacctggacctttagccaccaacctaacagtcccctcatcttttctatggtttgtattggtaaatttatgaacccattgattgtcagctcctccatcatcatccctaatcctccggtccaactccaggaggaactttgaatccttgctctcttcagccagatgatttttctctcttgccttctccccattgttaccagcatactggttggtgagactgttctcaaacaagatacccttcttatcatcttgcttaatttccttttgatggggtttacctccgttgagaccctcagcttgtcttgggaaccctttgtcatcagcagaactgcttttacttttatctctatctttgctcttgtccttgtctttatccttatctttctttttctctctgtgtttttcctttttgtccttcttttccttatgctttccatctcttccttctttctctctcttttccttgctctccctcttctctttgtccttcttatctttcttatgttttttttctttctgcttttcctgcaagtcatatggtgagaagagattttaagaataataatcaaataaggaataaaccaaaatggcttcaaaatctcttcacccaggagcaaccaaagagaaaaaaagaatatcaatagtaaaacatgcaaaaaagaaaaaaaaggctcctgtctccttggcaatcatatatatccaaggaagaagccgcaacaataacaacaggatcaaagtccatcaatacacattgtctaccgacaaagtattctagattctaggagagcacatttcagccaactataaccatactaagagggaaaagacaaatccataaaagtcaaaaataaaagtatagcaattcaatttgatgccttattaaacattcccaatgattagattctttaaacccaacagaaacaatttcattcttatactgccggccattcagatccctattttctttcttttatggcttttggcacatattacaaataagatatgctacgacacttttaacggaagttctgtattctacgcctcacattgaaataaaaagatcaaaaaagtgcaactgacatgttttattaaggactagaaacaagaaactccacaaaataaaatatgcatgtccagttataacccatagatgaacaaccaggaaacttcaatgataccaaggaaaatacccttctatgttcctgtagttgaatcaaaatgaatgcaaaatagaacaaaccttgatcattttattcctgaaaaaaaatgaaggcaaagaacaaacaacaaagccactgcttttgatcttctaattaacaagaagtaatccaatacatcatagtcaatacaatagtataccaaacaggaccaaagtcataactatactgagctccattaggatactccttgtagaggagcatccaaagcaaaacagatgagactctaggatcttcctcttgtgtgaaattatccccatttagtttttgaacacccattacaatgcagtgtcatgaaatgtttgaataaacagacgggattgatcacttgaactgatctgaccatgaaccaactatgtctgtaattcaaacactttcaaaaccttattaataagattttatacttaattaaagtttattttcttagaaattataattcatctaagatttttattatctttggttataagtgccctttagttgacttaacgttattttgaccttatgcatcattgtaatatagacacttcctgtcactagaacatatgaaattctagtaaggacttagaagtactctgatgactcctctaaagagagaaagcaagagtctgtccacccttgatttgaaatggataattcaaatcaagagtggatacacattaactttctcattttacacctcactttaaaggagttaaaccccggctcatcactctacacagagtactctaggcttattaatctacaccaggtctcagtagctcaacctccaatttgattttaaaaacattgacatgattcaagaatatgctctagaggccaacccctacatggtggatttgatgaacttaatattagcaacaaactgctaatcaacatcaacatcaaaagcacctttaatccaaattaattgggatcgatggtagatgaacccaataataaatacgagaaggttgaaaaaacaaagacggtaaaagtaaagaaggggaaaagaaggaaaggggagatgaagaacaaaggactaaaaagggataatctagaacatagagataacaacggatctaaccctccaccaagcttataacttttctccatttttcctaagacacaccgttcgccaatctatatcacatttcattaaatcttgtttaactacctttttctagataagttacaatctacctctacctctctttgcgtcgagctcttggtaacaaacttctgttcttacaggagcatccaagggcgtctcattatgtgtctcaatctatgttcattcatcttttcactcaccaatactactgttacctttcgtcgaatatcttcatttcttatcttatccatcttcgtataaccacacattcaccttaatatcctcatttctgctatccttattttatgttcatgttgcctatatgctggccaacattcagttctatataacattgtcagtcatatagttgttctatagaattttccttttagcataaaggaaattttacacaataactcagatgcactccgccatttcatctaccatgctctaattttatgatttacatcctcatcaatctctccacctttgtgcaaaattgatctcaagtatctaaaaacatctttcttggatacctcttgaccaagtagatgcagggatcttgatcatcatctcttaccagtgaaaactcacatttcatatactcagtcttggtccagcttaacgtgagtcctttagactctaaagtgtttctccacaattcaagttttctattaacaccatcttagatctcatcagtaagcacaatatcatctgcaaaaagcatacaccacgacactttctcttgaatatattttgttagttcattcatcactaagaaaaagagataaggactaaaagtcgaaccttggtgtacacctaccgtgataagaaaataactttaaatttcagtacaagctttcacacacatgatagccccatcatatatatccttaattgcatttacatattttaacagtacttttttcttctcaagagcccacataaaacttttattgagactctaccatatgctttctcaagatctataaacactatatgtaagtctttcttcttttctcgatatctttccattaattgttgcatcaagaaaataacttttatggtacatcttcctgacataaatcaaaattaatttacaaaaaccttggtctctctcctcaagtgatgttcaataactctctcccacaacttcatatatgactcataaacttaatgtctttataattagaacaattatgaataatcttccttatttttataaatagacacaagcataattttcctccaagcatcagatagaatcttatttgtttgaagaacttattaaatagattggttagccattttattgccacatcccccaggcctctccacacttcaggacgtcatcagatctcaaagctttattatttttcattctctttaaagtcttgttaacttcatatgtattaattttatgcacaaatcttctattcagatcatcataagcgtcatccaaatccacctcacttttattgtcatccacattaaaaagtttgttaaaatagttcatccatattccatttacatcttcatctgttaccaaaaaattttgattttcatccttaatgcatctaatttgtgtgaggtctttactcttcttatccctcatttttgcaagtttgtatataactttttcaccattcttgctcccaagatttttatacaaatcggcaaaaaccttgcctctaacttcccacactgctttctttgcatttttcctcgctaatctaaacctttgcaagttctcatcattggaacttttatgcaaagatctaaagcattcctttttctgtttaattgtctcctgcacctctccattccaccaccatgtttcctttgtaagaaatttgtttcctttgcttctcccgtcaccttccttcccacattttggatacatttaaccatcttatttcatatttcatttgctccccccataggctcctacagtccttcacacaacatgtttttcttgaactctatttgtttttcctcctttagcttccaccatcttatctttggggtttgaaccatcttcctcatattaagtactttattgaaccgaacctctagaactatcagcttatgttgcctagcggcacagtctacagtgtagaccttgtagtcgatacaagaatttctatcttatcgtctaaccataaagaaatcaatttggctacaattttggttactatgataggtgataaaatgagactcctttttttggaaaaaggtgtcgcaagcatcaaattgtaggctagtgcaacgttcaagatatcttcttcagtctcacttcttgtcccatagtcaaaacctccacttcttttaccaacatgaccatttaggtcttctcctaggaaaattttctcctctcatggtatccctctcaaaacctccttcaagtcttcccaaaattagttcttatcatttgattgcagtccaatttgggttgcatacacactgaggatatttaaaattaaatcacccactacaagcttaatcagaataatcttgttgcctttccttttgacgtcaacgactttatctctgaaacttctatcgatcataatttcaataccatttcgactcttgtttatacctgtgtaccacaacttgaaactggtgtcatccactttcttggccttttctccaacccacttaatttcttgcaagcaaacaatattcactttccttctggcaaaaacatcagctaactctttcagtttacccattaaggttcctatatttcagcttcccaattgcatccataacccttgggcggtattcacctaccaccctcgcccatctgcatgttgggaccctgaccaacttatcaccaaatccgggttgaagacttgacgccttgccttgagacaaggaccctagctcacttatcactgcatcccgggaccgatgcagcgccttgccttgcggcaagggctctagcacattttcgctacacccgggatccgatgtaacgcgtcactatgaagggtacactccaacaaaatatcattatgggtcatctcataaaaatagatatttttttatggtcgattcgcaacacctgataccaactctcttcctttatcctggcttgggacaagccatgcattcaaaaataattataatgcttagtaaaaggagagactttagaaaaagtaataggaaagactaaataaaactattgaaatgtaatcatttaaataaggaatgggttgcaactaaatgcagtcatgatctcccacatgcaaaatgtttaaaacttcattaaatccactttttgtatccattaaacaatcaattttatcaccaaaaatttttatataagcattaaatcgatattgaaacaggatctgaacaaaatgggaacaaagcatagcaggtttggtctttgtaaatgaggagaaacttgcaattctccaaatattagaacgataaggaaaatatttgtaaaaagtgaaacactttaacctccataatccattctatttcaaaatgcatacaaatgtccctgcaatgtacacataccaacttgaaaactgcccacattatcttccctggattttcctcacttttttttcacaaacttcctatttacaatggtggttggttgaggtttcaataacaaaatgaagaaattacaaaaattagaaaaatagaggaccaattatcaaaccaaaatgctaaagtaattattatcatgcaataccttagtcatgcagtaattattatcatgcaattcatattatgtagttcaagttagttcctatcacgcaacaccttaaaggcttaatcatacttaaaactcccatcaactaaaaatataagctaacagcctgctccacaaaagtaaatctactgcataatgtactccctttaatgaatcatccaatgcaataaatctagctgatctacataacttcaacctctatactcaaacatccttatccaacataacagatgttgctttattattttctctttctcctcaaaattttcaaattccaaattccatcttataggaaagctcagctatctataagagatgctactggtaacggaatccaattaaaagttgaaacaaagaaatggtctaatagaaagaaacaaataaaaaattatcagaaaaagagatatggccactagccagtctctctagatagtcaaatatcaatgggttggtggaagtccagtccagcaaggaaaagagaggcattatgggggaacaggagaaaaagcatggaccaaagagacagtcactacccatgaagaggcccagaggtcgctgctgaacacagagaagcatcacagacaaaaaaataaaaaaggggacaaggggagaagggagaaggggggatcacatcaatacacaatcagaaattttagggtacccattgtctttttatatagtaccacttcataaaacttgcaatacaatagtagagaagaagtatcttgagagcactgtagctagctcactataaaaaactatgatcctgaattgacaagacaggataatcaataatgttatgacatggtaaaaacatacaccatatcaaccaaaaagaaaagctacactaacaattttgaatgtcacctaacaagaagaatgatacaagggaaagagttgactagcatcattgctagtcaaattgagaatttaatgcatatacttgacaaaacattaattagttcatttctttctaatataaaatcaacctgaagtagttgattgccatccataacttattatatgattatttcattagcaaatcatagttggccctgaaaatatataacttattaatctaatcaaggtaaacataacacgaactcaaggggcacataaattgatgtaaccagaagaatttatacaagaacattatacaaaatctcccaccttgatcaccacattgtagcaacctctagtttcaccacaaaataaacttgaacacttttacatgtttggggaaaataaactagcacaatttcactgaacttatagcggaaaatctgctaccattcaataaatggttcatgattgagtaaaatccattaaaatcacaggagaaaaaaggcaaaaaaaaaaaaaaaaaactaatgttgagtaatagaatattttttccctttttctctttcttctttgaacagaaagaatgagaagtctactgaattgtgcagatagacagcttaaaacaaaagatttgaataaaaacagtataaaggagctcaaaaaaaggggaacaaaactcatgtttgattcaagaagtcatggtagccaataaaccagagattaaacagttaatatattttagatatatcaaaccctcaaaatttcctataagatcatctaagaagaatacaaccacaaaagccttttcccaatagttggaatctgctacaagaatcaaaccatgccattgtactacgtcaaaaacccagcttttgccaaggctatttttagatcatggtattttgtaatggttttacttaaattttccttggtaatcacaacaaagtatgttcaggtagaaaagccaaaacaagaaactaaaatagtcagaattatttatacaaaaccatacacccaactatttacaatcaaatcaatgtgaattcttggtcttcatcttctcagtcgagtcagtcccacttgtgtaaaatcaattggttgggttgggccaagaatatctagaaccaattttcaccagtgtaattaacttaagagtatgcatctgattcccattgagtatacaagcataatatatttaaccctggactgtccttattcttcacagctattatttcaacaaagacatagaactagcaatttcccacaacttgcttaagtcaatttgaaccccaaaaatgattataattcctataaccttactctaaatccattttagatgaggtgaaatgctttgttctatgactgacaagatcaaggatattcaaagatgttgcttccaaaaaaaaaaatcagtaagtattacaacgaatattagaagaatctccaaaacccaaatataaatggacaatctctactaatactaactttttgcttcaatacctaaggtgccaaggcataccatcaagcacaaagttcatcattttacaacaaaaggactcgtaaaaaaataatattgccaacaacaggcatagaacaagcagagcatatacacttttaatcatcataatatcccttcctcatcaccagcagtgttgttaaatagcggccatggagaaatggcgtggcagatttttgccaactgccatattcaatttgtgaagggacgcccgccatggcagaccataaggcacaatggcgtgtttatatggcggaattatggcctcccaccatctgccattgataacactgatcacaccagtaatgacattatttctccactcaatcctcttgaaacttatatattcaggagtacatatcataacagtccaaaaatcaaaattttggacacaccacaggaaacctaacatcttatagacatataagacagataaactccagcaaatcaagtgaaccaacttccatcaacaaagtgcagaacccctactaataactgtaggccaaaacagatactgtaatgtaaatatgtaagcctccaatcatcttcaattgcacccatacagaataatatctgatactttcatgacttgtgatagttcaaaagatgccgattaaaatgtttcaagcaagaattttacaatgaacttcaaacaaattgaatttatattattaagaagaaacagatgaaaaattaaggagtacaaaattaattcaaacatgaatgaattcagcactttatatgttccattcagaaaatgacgtctatcaatatacatttaacgttatgcaattcacaaaaaactccattttgcatcacagttaaatctatgtcaaattatatgtacaatgtgagtgtaggaaaagtgtattaaccttttttaataagtccacttcatctgttatagccttctttctatatcctggtggtggaaatggaaaacagcgcgacattgcacaaaatccaaatacgcctagtgtaaaattcttctaaatttgagagtgcttgaattagtttccagtagccctgttccagaaagggaacgaaccagcaactatgctcctgtccatgcaccatgtcactgcattcatttccagctttaatattcctccataagcctcttactacaaacacaaattgtggaaaccaccaaggtttactacccttcaccaaaatattcaaacagctcaaactatactactaaaaactgatgcaaaatcaacgcacagcacagcaaccacttgttctaactacttaaagtcggcaaatggttcaacacaattccaatcagtatatgtttcctacactagtgttaagctcagactaattatatcaattcaaagggctgcttcagaaactaaaaaggaccactgaaatcagatactctagtttccttgtgagccaactaagaatcaacagctttttctttgtgtcaaatccctaaaccaaaatgatccccaacaaagacaaaaagacagagaagaaaaacaccaaaaatgaagacccagaaggcccagctttttgtagtgtgtccagaaacggttatccaaatcctgatcactgattcactgttattaatatagacaatcttcttccatgttcaaagaagcaatgttaaacaccatcttaagcaatctccaagtgcaaatgctcaaccaccgtaactctaaatccaaaatatgaacccctgaaaagaccagagaccatgcccatttcacgcaaccccacgcagagaatgaacaagcacagtcttcctttcaatcacaccctccgatcaaaaccctaatcactcaggaaatttgcaatttggacaagtgcccccggttacgatccaatgaaaccctaaaaaaaacacaaacaagctgagtacacatacccggaaaatacccacaaagaatgaaaaccctaatcccaattccgaaaatttgttgattaaacacccaaaaaagagagagcataaagcagcaaaattgaagaggataaagagaatcaaacactttttgaaacctaagcaataatgggtatcgatcaaaagggggaaaagaagctctgattcgaagcgttgacgggaaaaaaaagtgaaacatcgattgatgaaggagagcccaagtgaaatttgttgcataagatcacctaatctgctacaaagcgaccatagtaggaggacaagatctctctctctctctctcatgaataaacagaagaaagagagaacaacaatctcatctcaatatacacaaaaatatgaatatgtatatctatatgtacatataataatataatatatggttttgggggaagtactttttctttgtgtgttctgtgtgttgttgttgttgttgctatggtatgctattcacaaagctagagccgttattgctctctagattctgggttttgtttctctttgtttaccactctgcttcttttcttttcttctatttctttctctctctggttatgcgtatttgtttgcctttctgtgcttaagttgtgtgttgtccctaatatatatctcatcattattggtcatgtgtttctttttcattattttttatttttattttctcactttctctgttctttctctatattcctaagtaagggggctcatgtgctgtttttccgttcggaagtcacacgcgaggctgaaaaataattgaaaacccaaatgccgaaaccagaacaaaaaggaagggcaacaatggaatgccaagcaaagccacgtgtttattgtccatcacacttgatgtatagttgtgaaatctgatttgattattgacttgaaataatgaatcagtaatttaatcggtggattaataattgatccaatttgatcaggaacatattaaacattcaaaattatatatattatataaatatataactaacattatttgagtaagaaaaattcatttatatttcaaaattcgatttttttaaaaaaatcaaaattttatataaaaaattgtaaaattagtcaggtcgaaccgattcaaccaagatcaataaactaactgatcgagtttgaccagatcaactacataatcaatccaataatgaaatcggtccggttagaccaccggatcttggtccaacatgtccaaccgacctgatcggatcgaatttcacaacactgaatgtatgtactagtgtatttaacatgtcaagtggataaggattccaatctcaagtccatttgtatgaatattatttgtttgagatataatttcttaaatgaatattttttaatatagtaattagaactttttatttctcaattggatctgatatatttttacaagttttgattttttgagtcaattataggactaatcctagatgaaggatttagtcacacttaaaattcattatttccaagatgtatataatgtgaaaattgaatataaatcctcctcttgttgttaattgagttatattgattggatttatatgaaacttttaagagcacatttgctataagaattttttaaaaatttctaagaatttgaacttggagatgtttaatttttgtgtttggtttactatttaaaaaataacattttcaataaacattgttttccaatgatgtttctacacaggttttccataaaattattttcatgggaaagttagaaaattaagggtatgtttggtttgagaaaatattttctttttttattttctttttattttatgaaaattattttcattttcaaattttcatcatttagaaaaatatgtttgttggttttctttttcattttcattttcattttctgattttcttcaataattgttttccactcattacttagaaaatttatccaatggcattcactagatgggagagattgcaagttttgagtgcacggtcatgttattgttgactgttactaggttccaagagaaagaaagtatgatgcaaatgaaaagaagatctaaaaaatttcatgagtgtcatgcatgattagtgaaaatgcagaaaatgaatttttttcgttttcggaattttctaaaatactgaatttgttttctaaaattgaaaatgaaaacatctaaccaaacatattttttcaattattttttattttcattgaaaatgaaaacaaaaaataataaaaacaaacagaccctaagtttcctatgctgaaaaaataattattgtgataaaaatatcatattatttttattatatcgtgataaataattaaagtttataaatttctattaaaaattaacgtgaaaatcttttgctcttaagaaatatatataaatattatataaaaaagaatctcaatcaaacatatttttcttatttttaagaattatgattctcataaattatatcaaacacaccctaagagattaagtgctaactctaatatgcgataccttgcattaaaaaaatgtcaagtaatagataatttttcatttatttgcctagtttataaattcgttagacaaaaatttacggttatatttggataaaagttgaaaacatgattttgatgattctaatgcacatttttacagttcaggtcacaaaataagaaaagaagaaaatgtcttttcggaaataaaagtatttttgagttctccaactaatatccagacatgtactataactataatttattctcttgttttttatttatattttattgagagtggattttgtttcgaggatttgtaagtttgatttgtatttcgatttcaaatctctatttatttccttcaaattcaaatgatagtacgtgaactaatagtcaaatcctcttcatagctctcgtaagctagcaacatttaattagctttagtgaacaatttgtgtacagtacggtgatgaactctgtgtatactcaacagcatagcttaaacaagagcttggtatataattagactagctagtattctccatgcagacacatgtcccatgttcgtgcacgtctaggcacaatctccacaatgaaaaacaggatcattcagcaaaggatggttaatgggaagaagtaacttctctctccctcaatacatatccaagaaacaaaaaggaaattacgtattcccttatccaaaacatataaatatcttcaacttaactgatttgattgttgaagtccttttaataggtattttattgcacaccaaagaaaaagataagagattatatcaataatattagacaaccgagaagatcagatttgttaacaagtgaacttgataagaataatatgtattatatataagtcaaaatattatattttttattcgattaagaccataattttttttcataagaattgaatataaataatgaaagtttatcacaaatcttgtaccttactcaactagctaataaacaagaatgaataaccaaatttgatttgattattagacaattaattttataaaattaataaaaataactttgaaggatcttgaataagtataaacttaccagccaaacatttattcaatttatcctgaaatcaaatttgagatcaacttagtcaatttgacaaatgtatacatttaaaaattgactttttactatgactttaaaagtttttaacggtgatatgttactattatctttaaagtcgccgttataaaagttaatatttttggactaggggtgttcacgggtacgggtcacccgtgaatccgaactgatccgaaccgatttgaacagtttgggttgggtcatttatatatttgggtcaaaaccgaatcgaaccgatcaaaaccgttcatgtacgggttgggtcaagggtttagatttacagatccgttgatccgatgacccgatctgtgaacccgtaataataatataaattttattatttatatgtatatattaaaaatttaaaataatttgataataaaaaaaggtatgatattgtaaatgtttaagattacattcaaaaataagataagatattttttaatattgcattaaaaagtaggataaaatatttttaagattgcattgcataatataatagaatatctttaagattgcattggataatatgataggatatatttaggattgcattcaaaaattggttaaaatcatatctttaaattagtataaatagaaacatattttggtgttcatgtatgcattccattccaaataatattagagtattagagagtttatgtctgcatcattaagagaattgttgtgagatcatatagaagcgtttgacaagtttgattcttcaactctcaatcaggatttaaaggtacctatttgcttaaggaatataagcgtagatgtactattttattgtattctttttcttgactttggaaaaaaggtcgcagttgggaactaggataccaattttgtctgtattcttgatgaattgagacatgcaacttatggctgggaaactaggataccaatttggttgggaaacaaggatatcagtgtatctctattcttggtaaattgagactagagctttttgatgggaaacaaggataccaaatgggataattgttgtgtaagggtagattaggaaactaggatactaagaactcttgtacacaaaattatcatagtggagttatccattggattgattatccaatttggaagtcgtgattttttacccaattgggtttttcacgttaaaattgattgtgtcttctttatctcttatttcaatattattgcttctgctgttcaaatgaacaaggtccatgttacttcatttatatttttgtttatttgtttgattcagcaaatatggttgcaacaaaattggttataacaaagcttggtttgtaagaaataattatgattcagactattatagtaaatattgttcacaaatcttttgttttaatttatattataagtctattttataatattatgttgatggtattaaatgaatcaattttactacttttatacatttgataatattgtattaattgtatgagatatttgaaacaatcgtgatataaaataatagttataaaattaaattaaatgggtaacctggtgatccgaaccgaaccgaactattcatgaacgggttgggttgagttgggtttcaaacttttttttctgaaaattgaaccgaatcgaaccgatcaaatttgattgggttgggtcctaaatttggccaaaaccgatccgaaccgacccgcgaacacccatattttggacgacgatttttaaactattagaagggtataatttttaagacagttttatcatgaaatcatcttagaaagtgttcttaaaaaaaggtatttataagacggttgttacaaaaaatcatctttaaaagtctacattttaagacgattttttatgagaattatcttataaattgttatctaaaaaaggatggatgcttctaagactatttatgggagaaatcgtcttagaagatccaatttctaaaacgattttctcgaaaaattgtctcagaacattttcatatttatgaaaatgaaaaatacattttagtcattttttatcaaaattatcaatgcacatgcttgtcaatgtcaaaaaatatttaaacaacatttagaaaatttgtataaatttaaaaaataaaagagaggcatgtgcaatttccttaatattatgtttggatgagggattttcaaattctaaagaatttgaaataccatatatttgaattgctcttatttaaaattatttaattttgtatatgatttgtttggataaatcaattcaaatttttaattatgatgaaataattcaataccttcatatgtaacaatttatttttaaatttataatttttcaagaatatgaagataaatacaaatttattttcttaaatagtgacaaaatggagatttactttttactatattcatcgatcaaaatgaaaatcatatattttttaaaataagttttcataatagtttttcaaaaataaaaaaaataataaaaaattttgataacctttctttcttggttcctccttccttataacctacaccaactcaccaatcaaaatcgtcatcactgactaccttcacgctgccacctccaatcagcattgccactgtcgcgtcccgccaccgacatcaccgtcattctttctctcctccgcgcgacatcactatttccctctcctctgtgtgcaacatacccatcgatctctctctccttcgcgtgtgacagtattgttgctgttctctattgttctcttttgtgtgtgataccactgtaactttcgttctctctctccaccgtgtgtgacatcactatcagcatcgttctctctctctctcccaaatgtggagtcactagacagagggtgagagttgagttagagtatctctggaaaaaatttcaaactctattttttgggagtattttaatgttgactgatttaatataattaaattgttagataaaaatacgcatttgaatttgcttttaaatgttttatacaaacaagtcaattccctcaaaagaatttaaattccctttacaaaatgaattatccgatttaaatatatcatccaaacacatattaaatttcatgaaaaatatgtataagttttgtaaaaagaaaaaatatgtattatattctcttatgagagagatgtataatttattttaattaaaataaattataaacatgaattaattttaaattcttgtccaacataaaattaaatatataaaaaatcatctaaatataattttagactcgaaataaattattatcagattaaactaatcacactcccagagccagtaaagttagtctaacgtgaaaacacgcgccaagtgaacaagtgtattacagagttaagaagaaaaatgggcaaaaatttaaaaataatacaatttaattatttaattagcaaaagggggcagtttaaaaattatttagcaaaatggggttgtcaaacacgcccagctggggcgtgtttaaacacgcccagatggggcgtgtttcaccagatggcgccacgtggcaggctgaaacagtgtcctagggttttcgcggtgttttcgtaaattacggaaggtcgtaacttttgactgggacgtccgattggcgcgaaaccggtggccacgcgctcgaaattgagaggagaaggcctgggcaagttctcgaagggtttatgttttagggtttcagattttggattttgggtatcgaatttagggtttgggatctagggtttagggtttagggtttcagatttaggttgatgggtttcagattaggttaggggtttacgttgtgattagggtttcagattttggattttgggtatcgaatttagggtttgggatctagggtttagggtttagggtatcagatttaggttgatgggtttcagattaggtcaggggtttacgttgtgattagggtttcagattttggattttgggtatcgaatttagggtttgggatctagggtttagggtttagggtatcagatttaggttgatgggtttcagattaggttaggggtttacgttgtgattagggtttcagattttggattttgggtatcgaatttagggtttaggatctagggtttagggtttcagatttaggttgatggatttcagattagttagggtttacgttgtgattagggtttcatattttggattttggtatcgaatttagggtttaggatctagggtttagggtttagggtttcagatttaggttgatggatttcagtttaggttaggggtttacgttgtgattagggtttcatattttggattttgggtatcgaatttagggtttaggatctagggtttatggtttagggtttcagatttagggtttaggatctagggtttagggtttagggttgactatttagggtgtatggtgtagggtttagggtttagggtttagggtgtagggtgtagggtgtagggcttattgtttaggatttagagtttattcaatcctaaatcctaaaccctaaatcctaaacaataaaccctacaccctaaatcgtaaacccaaaaccccaccctcaaggaaagagctgagaaaacagaagcaaagtgaagagataaaatcaaagaaaattgcagttaaggaagtgcttgccaaggcaaaacttgaattggaaaactaattactcaatattagtgaagtgtatgtaacactcattaggttattcactggcataaaccctaaatcgagatccataacccctaagtgtgtaaccgaagaactaaaccccaatcacaacatcaaacctaaccctaaaccagaatctataaaccttaggtctgtaacccaagctctatacactaatcaaaacattagacctaaaccctagaccggaatccatacaccctaagtcccctaagtctgtaaccgatgacctaaaccctaatcacaacatcggacctaaaccctaaaccctaggtctgaaaccctaaaccctaaaccctagatcctaaaccctaaattcgatacccaaaatccaaaatctgaaaccctaatcacaacgtaaacccctgacctaatctgaaacccatcaacctaaatctgataccctaaaccctaaaccctagatcccaaaccctaaattcgatacccaaaatccaaaatctgaaaccctaatcacaacgtaaacccctaacctaatctgaaacccatcaacctaaatctgaaaccctaaaccctaaaccctagatcccaaaccctaaattcgatacccaaaatccaaaatctgaaaccctaaaacataaacccttcgagaacttgcccaggccttctcctctcaatttcgagcgcgtggccaccggtttcgcgccaatcggacgtcccagtcaaaagttacgaccttccgtaatttacgaaaacaccgcgaaaaccctaggacactgtttcagcctgccacgtggcgccatctggtgaaacacgccccatctgggcgtgtttaaacacgccccagctgggcgtgtttgacaaccccattttgctaaataatttttaaactgcccccttttgctaattaaataattaaattgtattatttttaaatttttgccaagaaaaatgcatgaaaagccaagtcatgtgcattggttggttcccattaccactgcgacaattccaggtggcgttaccccagcttgtcactactgctacctatccacatacgtgtcaaatttctagtgagacacggtttgtaaaatatttatattttattttattttattatcatttttcagtacttcacataacattataaattcaaaattttgtttcatcgttaattgttacatattctaaaagaaaacgtatctgttaatatttttaatttggattttttgtcttttcattaggacctgtgaatccaacacttggacttatcaatggaggaagctgattgagcggttgtttgtgtggacttacaagtgaaattttctcgagatgtcaatttttaacttctattatacagttgtatctgatcatcatcattttaatatctgaaatgaaaaccattattaattgaatctaaccgtggtttcaactttcaattaattaacggtgttaaactaatataatactacatgtttaagtgttgccttcaatacccatgatgtcctacactagtcagtttttagtcatatgaaattactccgctgatgccaaaattattgacaatgtagtttttttattacaaaattattgatggttttcaaattataaatactatttttatttttgaaatcatggaaaaatattttgagacctcgtgctttgtgctcaaatgggtagtttagccaacttgttatgaaatcatcccgttaagacattcctcatgtagaactagctaactgtataaatcttcaaaagtcaagaatctctccatctcacgatcggaaagctcaagctgcatgcagtatctattgtgttcatcatgtcctaaaccattgaagaattatgttttaggttgttcatctcagtcaaaggatggtaacctctcataaggaaaatgaacatgaaaaacgtacgttgtcataaagcagctatatatatacaattaatcgttgtcactgaagcaactatatacatgtaacattcacacaccccctctcttttatatatgaggcaaaaaagcatgtaatgctataacccattgcagctcccatgttcaaaaaatccaacttagcttaaccagtggtagaagcccatcaattaattttcttgtccatttaagttactacaaatagttagaggaagcttccaaagttgaatcccaaaagggagtgttaatatagcttgcacgcattctcttgttcctgtatgaacaatcaaataaatccattcaaaagataaatgaatttaagataggtgggttggattgtacgaggccctaaccttaaccttgtagtacactaggatgagatgacttttttttagtggacaagagtcttgcacgtcctccataatttatccaacatttaaccatttatgttgatatactataggataaaggcataaagcacatataatcactttttggaaattatgattggattgaattaaaatctaacggggacgtacgccatgacccatgagaagttaatgggtagtggtgaacattctcattattcaagcacgacaattttgttcttttgtgtgcacgggtgtgtatatattcattttatatgcttagtttgttttatagtgatttcaactttcaagccactaaagctttgaaataaatgagaatggatttccttttaataaaattgcatgaggccaccgttggttcaaggaagaggttaccaaaagatgctgttggcctcctcttttttgcagggcctttattaatttttcgatcttactttccggtactgattatgaatttaaaaggaaattttttattaaaaattatatgaaaactcatttaaaatttgtaggaaaatatatttctaggtatcctaataagaaaatccttttatctttttctttaggtcactggttaatatttatcttatttttttagtttaatatctctctcccctttctcaatatattcatgatacatcaagttaattaaatgagtagtgcttgtattctataagagagtaaaagagtaaattaaaaatatacaattatacatcaatgattaatattaaaaatttaataattacggcaccacttaaaataaaataacataacttttatttttttagttgtaatatttcatgatttgatttaatggtcaagatttttgttctcactcagttataataaaattccatgtcgatctctagataatattaaaatatttatattaaatatttataatgattattcttttttaataaaaataatttagaatttattagtttttaattagtagatagtaacatataaattacattttagatttatgataaataattcatattatgatataaaaaatttcttcaacggtttattaatattgtcttatctctttcaatccgttatttttatctttatttttaaattgaatttcaatatttttagaataaattattaatattaaaaataacattttattatcatttatcataaacttataatataatctatatgcttgaaaatatactagtaataaatttgtaatgtaactaattataatcaatgtaatttgtctaatctttacataattaagaggattaatgaaagaaagaacattttgatttttgttagaggtaagggtgtgaatcgatttttataacacttatttataatgtttaataaggattttctatttcggaaagtttctatcaagtcttttattttttaaaatgccataacacgattctttgtttatttatttattttaatgtgattctttcggttcaatttagcatgaaggcattaagtgaaaatttcaatagttttaatcaaattaaactataaaaaacagccactttatttcttattttgaaaaataaaactaaaccagcaccaacgacaccagacaagtgttttaagggtcaatacttcatctatggtatatgatttatgatggaacataattaacatttgagaggtgaatgtttttatgaataaacaagtgtttgctaaggcatttacatctagatgcgaaaattgtttgcgagtaaattcaatagggagtgaaacttctttttactcttttccttaacaagcatatgtagatgcaaatatttttaatttccgcctctctgattttcttgattttgacatgcaaatctacaattttagtataattttttatttttttaaaacatgataaatataatgccgattaaatattcatacattaaaactcatcaaaaattgtaacttaacatctcatcctgaattgaaccataagaataatataaaagtatttttaaataataaaatatcacattgagacatcatttaaaaaaataaagaacttaacggaggcttttgaaaataaaatggcttaattaagcattctaaataattgatcatttattgcttatttaaataagtaaatttattaagataaacctttttttatctttgaataagcaatttgaaagacaaaaaatgataaaaagttcaactgaatatcaaattatattggaaatgataagattttcatagtaaaggttttcaactgaatatcaaattaaaaaaatttcaactgaatatcaaatttcaactgactttcaactgaatatcaaattgaaaaaaattattaagtttgcatattaaattcaaaaaagttttaaaatgataagattttcataggaaatattttcaaattcaaagaagatttataatttatttattattttggaaagcttcaatcgtcctttattttttaaaatgccataacacaattctttaattttaaatttttttttttttaaagaaccgccactttgcgccgccaaattttcaaagaaaccagcgtcagggcgttgaataagaagcccgtgtcaacgaaaagaaaggcattgacttgaaagtttgaaacttcaactctgaaaacgaaagaagaaaacaatgtctgggtttgatgactacactcgcttatttgatttcgagaccgagccgtggcagaccctctatgactggtcgacgcggaaccttgctactccggttcctcccatgtcgctggcggaggacacccaacaccacgtgaactagactgtctcggctccggtcgagttgcccagccacccagttgaggcgctggtgcataacggtggtggtggttccatgatgcagaatgctgcaggttcatcggttcggcgcaagagagggagaggggaggcatggactgaagaagaacacatgtagacttttaacgttgtattattttaatgcagtaaatgaatgaaaacttatcaaattctcatctcatatttgtttttttaatggcaggtcttttttagttggactccaaaaatatgggaagggacaatggacaaaaatttcaagccttgtgaaaacaaaatctcctattcaaatcgctagtcacgctcaaaaatactttcttcgccaaaatgcctcactcacacagaaaaaaagaaagagcattcatgacatatccttacattataaaattggagttccttacatcattgatttacaaaattcaatttctcttcctgaaattcgacaagttcacgaaatgcaacaaaaacaacaaatgttgccgctgaatccacaaaacagcttgactcatcaaatgaggggatttgaaaattctgatagtgcatatcaacaagttcatggaatgcaaaaaattcaagaacaggtgaatgaaatacaacaacagctgaaattgattctgcagcaattttcaggggatccatcaaacaacacgactccttagaaatgagtggatttgaatattgtgatgacgagacattgtataaaacaattttctttggttgagtttagatgctaatgttatgggagattaatcttatttatatctttgtattttaaatttgtttgttatgtattttaaatataggcaagttgttagtttgttacacttaatcttatctagttgttttggtttcatcttatctagtttgttatactttgtaacctattagttcaaagttttattatcaataatatcaattcacacattcttctgtaaaatattttcttaacctatcttcttaatagctaatgctttattaaagatatttcttgacataatacaaagttgttttgccgccattctatttttggaatttcatcatggatatgattctttaatggtagcagatattgtagtctgttttaatgtgcaagagtcatgattttttttttctttctcgaggtcataatgtataatttgagttgtgattggttcatatcacttgtttttagaggcagcattttgaagtgggatataagcattaaaagatgtgagatctcatgtttgtccttaacggaagttgtggtctgttttaatatgaggagtcattaattttctttcttgaggtcatgatgtataatttgagcctgtgtatccaagtgactggttcatttctcttgtttttagaggcagaattttgaagtgtgctaagcattaaaagatgtgagatctcatgcctgtccttaaccgaagttgtggtcctattttaatagtatgaacatattcgtttggtttggttatgttgtatagaaactgttatccatgatcgggttaccggcaatgagaagcatgcaagttcaacacaagaaaggaacattaggagagaaagggatgtgagaaatgtaaaaatgaaaatgttaaagttgcatgtgcctacacaagaaagaatattatattgccacatattatatgaaatgtgaaagttgggctggtctgtacggtggagttcggagaatgggctttcattattgagcccatagacggaactggaggaggcccaaacgatggagggatggggattggagtttttggaagcttctagaagggagacgaagccgaggattgggggttctgcatggcgtagcggacgcccgcttgtgctgcgaggtggaggacgtgggagagaaacgacgtcgaagagcttggcgagcaacggcgcgtcgagagcaggttcatgtttcctcacatttttgtttttggtttgctaggtgttaattaccctttctttaatcattgatatatatatatatatatatatatatatatatatatatatatatttattttgttttaatttgatcaggtgcgggagggcatgcatatatatatgaaccttggaagtggtttggaatgatctctagtgtgtgatttttaaaaattattttggttctgcatttactaaattataatatatcatgtagcattttacctgcaaaacacatttgacaaggcctaatcataagctacctatttttatttaaaggggatttcttgtgaccaattgtattgcatgtttgatctaattcatctttaattatctgtttgtatttattgtattacttcatgatatatggttttttctgttgtgttgaaaaggcgtctcatttgttgtctttatcagctaatttgacattttacaattaggattataatggagggtgaaaaaagataaagtgatgcagaataatttctatcacatttcaagtctagtggactaccaaaaattcttgaacccaactgatttaagtttaattcttctaagacaaaattatttttattacttttaattttaagttctactactttgacaatgtttcctttgactttggattcaaatgtcttagtacatacatataaatttcatagatataaattttgtgctacatataaatttcatagagcaaattttcaattaactcttagtaatctgtaactataaataactaatttgctaatgtccccgacaatcttatgaaaatttcatcaactaattctatatgtatgctttcatttttgtagtgattgttggagaagtagccaattttgcagcttatgcatttgctcctgcactacttgtaactcctttgggagctttaagtatcattttcaggtaaggaacatgctattcttcataacattaattattaggatgtttctgctttctttgacacaaatgtggatgcacatcttcatccattaaattttaatttggatgcggcttgcattttggaaagttacaaactaatatcatgatgcagtgcaatattagctcactttatcttaaagagaggttgcacatatttgatgtgctctttgtatggtgggatctacaaatattgtgttgcatgctccccatgtaagagttattgactctgttaaagaagtgtggcaacttgctacagaaccaggtaattttcaattcctgattgtttggtttcaacatatcttttaccattgaatcttgtaaaaaatcaaagtaggaggatacaagatgagtgggatgcatattaagatcttaatagattcaaggcattcatttatggttaatgaaactgacattgagttctttccttcatcaacaggctttctaatctacatgtgtatagttgtggttggtttgcatccttattttctattgtgttctcgatatgggccaacctatctggttatatatgtcggaatatgctctctcacaggctcaattacggtatatcgattatgtgttcagtgctcatatgtgtcatgtaggtcacaataaaactaccctctataaacctaatgttgttccttgttgcataggtcgtgagtgttaaagcagtgtcaatagctatgaagttaacatttgaaggcaacaaccaattcatttactttcagacctggttctttatgattattgtaataggatgtttgtcttttgcagattaactacttgaacaaggtaaactttgacttacttatattagtacatttactgttggcagtcattgtaatttgtcttccaaagtacaacttaaaataattatgtcaaagttaaatatatttttaattttttttattggttattggagtgctaatgttgaaaacagtattttgatttttctgaccttagtgattaggtggtaatttgtaatgctcaagaaatttaactatgcttttgcaatctttgagacttctatcattatctaaatgaccatgtttgcatttctaatctagttcgtggcatttggaaaagttataaacaaaagattttgtattgcttttcttaattggcattgagctatttcatttcctttcctttgccgttatacatgagtaatacgtaacatgcaatatttcagaaatggcatgccatattttttacagtagggatttccaactaacttacaattgaacttcattttagtattggtttttagactttctttaataaataaaaccaataatgttagaatcattcaaataagtgtgccgggttagttgtttaagacaatatgcttatcacctaccaattatattgtaatgctattttatttattttggaatcatgtttcaggctttggacacctttaaaactgcagttgtatcaccaatttactatgtcatgtttacatcattcaccatctttgccagcataatcatgtttaaggtaactaattgccttctatgattccatatatatatatatatatatatatatatatatatatatacttttgtttaaaatgtacctgatgatgctactaaattatgcaatcatatagtagtttaaaacaataacaacaacaaaagcccgtttccactaggtggaatcagttacatgaatcaaaagatatcatcgtgttttgtcaaaaaaccaattcttcaaaaatgctatttaggatctaaatcgtttttcatatatttttacttgaagtttttattagtattcctctacatagttttaactattggcgatcacttatcttatcaactcttcatatagacatatggttgtttatggaaataaaacacaaactaccttttttgaagaacttggacacctaagatctattaaatcagacaaactgaatttaagattatatcatataattttggcatattattgaaaacatattccttaaaatgtcctcaatgtgtaatttcatattttgttttaaaagcatgcatgtttgtttggtagtacttagtacttgaaaattctaacacatagagtttattttgtttatttgttatcgttctattttattatttcaaggaattttttttcccaaaaagtacgttgcacacctaaaagtacttttgctgttgattttcactttcaaaatctgcatcgatggtaacgatagtcagtcacttttccatattcaaacaatttccaccgaaaaaatcaaatagttttgtcattttagagcagcattatattacgtactattatataattaaagtgaaagtctattctcattaatttcataaataaatgtaaaattatctaaataatatatcgtgcttcaccagttcagtgccgcaacccccactaacacaccatgtgattggattataaagatacatatatagcattgttgttattcttttcatttgccagtacctcaaagaatgaggaacataacataatttgataattatgtaatttgcatcagatgcgagggcaaactattctcatttctcaatttgctgtgagagaaaatcgggtcgctgtcctccaattttttccccacattcctgccattttctgctttaacccaagaaattaaaagcgaaagagagtgaatcaccaataaataaataaattaactaacaaaaaaaatatatttgtccatagtccctaccgacataacagaactcaaaaaacggcgttaaacttttaattacaatagttggtttctacttaggtttcagacaaatagattgttttcaaaagacagagaaagttacgtgatatactttggtgcaactcgtgcatagattctttacaaaatctcttttttgttacttataggcatgaatttcttaaacttaacaatacatgcatctagtgaatacagagaaatttatggtggtgataaacaagttctcttaattataaatcaataaacaatacttagtatagattaaataacaatctaatagtagtaaaaattcaaagatagttactaaaaaacgtagcacgcatcatataattaagaatgagttgaattaaattgctatcttgttaattaaactcaatttatatgtaaatgatataaaaaaatccatagatcacatataaacccgacaagaataaaataaaattacagtacctcataattttgtgatctaaaaatatccctatggctaaaagctatatcatacagaaatagggatggatatttgtcactttcttctttttggaaattattttattccatctcaagttttggcaggagtttccagtgcgtaataaatattgtgacagaaatcttgatacataaataagtgtgttttagtttagatatcataataaattattaaaatgatttactttaatttaatttttgaaatatgaaatgaaataaagtagaatttatttttatctagtaataaataaaaacaagcaaatatgataaaataaaatatagctaaattaaaagttattttttgacataatttccatggaaataattattaaaattaaataatgctcctaagaaagttaaataattattaaagtcaattagttatagacaatagaagatacatatacaacatagaaagtgagtcgttgataaggaatggaggataatgataattaagagacttgtgagacacatattgtcattgtaattaatatcattaattttaattaaattagttttagtaactgaggattattcagagatcataattaattacatctatcatgcataaaggaagtacaaccgggaaggggatgatgcaaaggtggggctataataatggacccaaccatgtggtgtggtatgtatatatatactgtatcattgctcttttacagtagtcgaagatcccgggaagggaaatgcacaagaagttccctatcccatagcccataggcatagggtgcctttacaaaaggagattgtggttgttgatatgtccctcctttgtaatagttatttataatttagatatatacagtaaattataatagtagtaacaaagtgttcaagtagatgatatgaattaagataagaaaaacaaatataacagagagatctcaacacagttttattatttgagataaacgtttataaatgaatatggaaataagaagaaaaaaacagaaagaaattttttaatattttatggacttatattagtttatttggttttatgaataaagtaaaaaagttaattaagttgagacgttatatttatatatatgatctatttattaataaaaaaaatattactacgtaagcttctccattgaactaattcttgactatatgcattggtgatcgctcatatatagatgactaaacttttagcaaaacctaaataatctattttttttaagtttatatgtgtgttcttctattttctttgatcttaatttttctaggacgctacctgtattcagcccttgtattgagataaacaaaaagtatatttccaaacaaatagatcgacttctaaactataaagataatttgtaataatcttattcttgagaaattattagataatttaggatcatcatttaattagttcataatcatgattaatttctatatgacacttaattaaatattactgattattttttcttaaattcgaaaaattaaatacatgttatatgaatataaatattgattgagaccataaataaataataatttaaaattatctaataatttttctcacatatgcgctgcacacaacaatttgaaaatttaactggataatcaacatgtgtcattctcgaacgacttagcttaaatttatatatatgtcagaatatcaagcattttcttgctatacagtgggttgaatttatagaatttagaatatgtgattttgaagcatgctagagcttactagctattaattcacacataaatatttttctttttccttctggcatattaaaaggtccatatacaagaaacttagatttgaatcctctataattgaactctttaaagatattaaaaaacaatcaattttcaaacttcacctaactgctttaattggtagaggagattaatttgttccttggacgcatgtgttgtttaaagacaacatgtgattctaatccttctttttatttgtcacatgtgagttgtgctgagaaattatatttatacaataaattaacttatgcaacttttatttataaataagagagaaataagaaatgaagagacaataaaaaaatgagataagtgatagagagaaaagaaaacgttgtataattttttacctttggcggctgataataaaaaattatttagttttcttgtatgaatacaatttttcactggactttcatacaattcaactatagatgatcaagatcttacaaacaacatgtcactttaggaaaaacagtgtaaactaacgtgtttgaaaatgaataatttcacgaaggattttttttttaaaatctcatgaaattgacaaaaaaaatggttatttttaaaataaatcaagctaaatatgtaaaaaaaatatgaaaagattgacaagaagagaaaaaaatggaccaattaagtaaagtttaccacgagctcattgtcattagaaacagttagtttaccacctcaagctttaatttggggaagaaaacaggaattcaagtaatgcataaagatgttaaaaattagatactcatgaattagaataataattctttatttatttataatttcattcattcactttatacttattttatctcttaaataaagtatatttatacaaataatattaacaatatgttgatatttaagatattgattttaatgtcaaatatttaattcttcgagataagatcctgaaagctagaataaattaaagcccaaaaatcaaccaaagtgggatgcgttttgttctttagttgacaatatgttccacaattagtggggtaaagtttatatacaagtcaaaccaaaataaggaaagtttatgcaaactgaggaccagaggaataaaacattgaagctagagaaaacaattccttttcgtcctctttcttctttcacaacatacccgaaatggaaatgaaaacattactcaaaatcatattgaaatgaaagacaaatgtggcatttccatcgtgaagaatatcatttccctcacagacacctcatgtataggttgcagcatgcaatgaaatatggatgaaaacaacaagtacgtgtgtgagttgaacttgaactagggttgttatttactcgtcatgcacaagcaaaactgaaaatcccacgtaatgttatattaatcaataaataccttacaacggtggggtaggctaggttgctttctaattttgcatataaccattattcacatttgctttttcaaaatctagggctagcaaggaataaagatatggtcgttgctcggtagatccatgagaattgactttactacccatttgagactaagacagaagaagacatatggttctcctcacaactacgtcgtcctcttcatacacatatctatataattaatatatttcaaacaacatgcatgcctttctttcagagcaacaaagtcatacttttggcctttcaccatccagtggccaatggggtttagtactaccgacaatccacacactatgaatgttctgcttggcccttcatgcatttgctcacatcatgtttaatcaattctttttctggtgcaaaatttctgtagggaccactttattgcaaataataatatacttcctctatattttatacatatgtttaactgttgtagcaaaattatttcctactataatttcaaaataattgtatatccttgtctttatagggtgtgatatttggagttaagtgtgtgtttgggatttcgagggaaagaaataggaagagatcaaggggaaaatatgggtaagaaaatgaagaataaaactggaatataatcaattagttaataaagaaaataaaatgaagaattaattgagttataaaatacgtaacaataatatcttttttaaaaaggactaacaataatttattggtcggttatatgttaaatgggcaaagccgaaaaccaaggctcatatgtacccataacccatgccacctctaaaatcaaccaaaagctgacaatcattttataaagatggataggtatatataatttaagcaagaaaaaaaaatcaagatgatgttgattaatatgccaaactttatgaagaattaattttgttggaaatttttatttatctatttatatattataaattagaatacacaacttaatgagtgatattttttttccattctcttaattagacattttcaatatttcctctattcttcggtctaaatgtgcattccacactctactcctacattttgttaagaaaatctctcaatcatctcaaattatattattttatccttatttgtatgttttatatttttttgttattttctatccttttaattacacttcttattatttaatatagtattttattgattttttataagaaaatactagtttgttttaacctatttcatttattagacttttgattattcaatgtgattaacttgtatttattatatgttgtagtgatttagtgattaaacatcattgaaattgcaaggaataaaacaattcaaaaaaaatgggtaagatcttttttaaaaattagaaatgaagcaatgaacagtgtttgaaaatgtatatgatggttaaacttgtattttagaatagttttaggttgaatttatattataaacatgacaaatgttgaatttttttgtttaatgtaattaattaattggataatgtggtatcattttatttggtatttgaatttattgtttttgatcgataataatttgaatataattatatatgtttgttataaactgtctgagtttggttatgtttgaaattacaaattggatttgttgtcaaaacaaaaccaacattggaaaaagttgcacaaattacatgggttgccaaaaaatcgatgtagatctctatatccagaataattttctacaaaattgtctttataaagtgcattttttacattagttttaagcaaaattatcgtgaaaagagacattttacattgatttttctcaaaattatttttgaaaatgttgatattagatatttcttatacgatttttataatgattttggaaaaccatcatcaaaagccaatgacaattgtttaaacattgattgaaaaatcgtcattgaagtccttctaaaatcgttgttaaacttttttataatattgtattctaacatcttttatctttatgtcttgattaaatttcaatagattgtttttaacaaaattgtcaatggttattcattataaatctaagatataatttatatatatttcaaggtattcatttattataaatttaatcatgtaatgaatttaaaacaaacacttatcctaagcaacacacaaattaaaatgcttgctaaatattaagtataatgggattaacaaattctttctaccaaatttattcgtactcacttagactggatttgtttttttgcgtaaaagggatgaaaacccagtgcttacgaagtctaagctaagcccataaaatcagagaagaaacggcaacaaagcaacaaaagacagagaactgggctaatctgccagcagaagggagctgttagaatcggaccggtcatcgaagacattaattcaaggattaataattcaatcaaaatcaaattaggatcaaatagattttaatataataacttaataattttgaaaaaataataataaaagtaaatttcatttaaaatgtcataagttataattttttaaaaaaatgtcattttgaaagtttttattttaaaaaaaagtttaagtgaaacagattaatctatcgggttttataggttattactagttttttattggttcaacagtttgcaccaatttaaaggagacaccaatttttaggaagttaaatcggacatgtgacttttaacgtcttgcaagtatgattgaaaatgctggtcaactttaaaataataccaaggatatgtatctgagttaattgaggagcatatgagaatgttataaatcttaatataattttctatttttatggataaaaaaaatactaatttagagagtgaagagaaaaagaagattacaataagaaatatggcatgtgaagacggaggataaacataaataccatcctcttgtcgttgctactcttcagctttttgtgattttttatttataactcccataactttgtgtttatagggaccaaaattaaaatatatatatatatatataaagttatatagactatagataaattaaatatcttacaagaattaaaatagaaaatgtctaagttattagatctgaaattagaaaaatgaatttaaagaaacaaaatagattattaatagatataaaaatatctgaaaagttataagagataaataaattataaataattacaatttacaaatagattatatctgtccgccggaggttttcgcaggcagcagtggccttttgccatccttttcgaagcataaatatggttatggctggcaacagtataccatatgctattttgattgcgatggaatctcatcacagcattatatacttatcgtcttctttcaataatgctttcatttttcttaattggttcttggttaaattgataatcacagttaaaaataattacacgaggccatttctgaagagtaattgatgttaaccttgacgtcccaacccaatgtgattattaagggtaacatacgccttgaacttacctgtttagtaactttttttatgatgtattatttcttaaaagaaatacatatactaagggacacgaatgatttaccttttttatagtttatttgttgtaaaatttgtataattattcatcaatatgctatctttatctttggcataagtttgaaaaacttatttctaagcattgatgaattacagtgaaatacgtttttatatttagctcgcaggaaaggacaaatatatgaattttatataaaaaatacaaattatatcaatccaatttttaaaattctatttctattttcacttcttttataattaaaattttaaaaatattaaattccagtcgaacctatttttaaatttaacgataaattcatagtagtcataatttttataactaattttattaatatttctacttcaattaactaaatacctttctgttagtaactttcagttacaatttttttttttggatagaaattacatttttttgtacttaaagctaacttgtcaattttttgccaattacctatttcctcaatcctcgccttaattaattaacttgctacacactcactcggaataaataaacagtgcatttgttatttttcacaaacccgcaatagtccaaaagtgttatttctgtatggggtccaatttatataaagccaccttgttaatattatatttggtaattattagctgtcacgttggtgatttctcggatgtgcttagtttgagagagttttgatggctctctttatttaatcaaatgaaattataactaatgtatatttttattatttaaatataatggtaatgcaatatctctattttaaacactttaatgagagtgtgcttgtgtataatatttttaaggctaagaatataacattataaactctattattagtcagatacaaaaacagattaataccatgtaaaatttataaataaataaaaacttagctctgaagtacagtacaaattttttaaaaaaagtattaaaaccacttagtgaactgaatctgatatggcaaacatagtacattaaatataatttcaacctaaggagcaaaggtgcaatgactatattttacaaggctgttattacctataaaaccaaaggttgtgtttctgttacattcaaaacaaggcaaaagcaaaggaggacttcaaagagaggaaaagcaatgaggccaccaagttcttccatccactttctcctccaaattcttcttgtctttctactgcacagacccagctttgcagtgaaaaaggtgagctattgcaatttgcaatcttgaaaaagataaataaaactgtggaaaaagatctaatgcttgcactgaaccatttaaattgtagtcatatgtggtgtacttgggagcccactcacacaagccagaattatcctcagttgacttcaatcaagtgacacagtcccaccatgagtttctgggatctttcttaggaaggtattaaaaaaaaatgcaattataacatcttaactcacatatggtacaatttattacctattgaaattgtttgagtttgcttattttttgtagttctaatacaaccaaggactccatcttttactcatacacaaggcacatcaatggttttgctgcaactttggaagaagaagtagctgctgagatatcaagtaagaaccaagaaccttatcctctgcttagttcctctgttttctcttctctgtgcttccttcatctcattgtgtacttatacccttttgtccatactgcttctagagcaccccaaagtgttgtcagtgttcgagaaccgtgggagaaagctacacaccactcgatcatgggatttcatggggctagagcataatggggtgatccaatccaactcaatctggaataaagccagatttggcgagggagtcatcattggaaacctggataccggtaagttttcctgatttatgtgtttaaaaactcttgctattcttttcaaagtggtcagcaacatcttggaattaacggggtttgattattattattattattattattattattattattattattattattattattattattatggtttaatctagatcgttgacttatacacacatgtggaacatactcaaagttatctcatcgtatctctatcccccaccaccaatctgtttccagagtttgatcgtttcaaaaaagttgatttcataacattagtttattattaatttgaatcttgccgtcaatgggttgttagactagttttttccacacccaaagtatgaatgttcacgaaccatcttaaagaaatagactaattgcattattctcttgtgattagctataactacacttacatcatttttatatagtaattatactcaaagcataattaacactaaaatgaaatggacaaacatgacatgattaagtaaaataattttatcccttaaaaatatgatcaaaatcatatatgagaagaagtcaacttcttaaatgaattttaatattttaaaagattaattttcgattgagtgatatcttagatcatccaaaaaaatattatcatcaaaataaaataagatgaaagtaattatttataaagaaattgaaaaacttcttatggtaaaattagtatgtatagaaaatgtttggtgataatggagtagtcgactttcagaatggaccacctttagaaaggcgacatgggcaattaggcatcttgtcatttgtctgttatatatattaggattagaattttgttacaattattggtttatactacaccattagatgttcattattttaaataatttaaaagttataaatatatgttttcagtctatgcatatgttgtgatgcagaaggttggtcataaatcatacttagattgagacaaaactataagttgtgacttctgttcattacgataggactaaaataaataaataaataaaaagggtgggcttataatgtgaggtggggctaagaatggtgccaaggtggggatagtccaaggaagtcataataagctcaccaataagaaaatcgataagtgcattacatgagcttcattttgaaaatgctcccaaactgtaagcatgaaaagtgggtgggggcaatgaaaactaaaaacaggaccatcatgatgctagcttttagccaatttggatgagattgagggagaaggggtagaaggaagtagaatctccgttttacaatatgcttatcttattttgaccacactcttctctcttttgctcccaccgcattaccgctaggtgtttggcctgaatcaaagagctttagtgaggaaggattgggaccaattccttcaaagtggagaggaatctgtgataacggaattgatcatacttttcactgcaacaggtaccatcttcctttgagtttgttgggatatttataaaaagaaacttcgaattaaagtatttaatattggatctcgttaacaagtctcctcagaatatattttttaaagaaaatatagttttaattcatcaaactattatttttattttaaaatatttattcaatgctaaatatattttgtaattataaagactttttaaaaaatcaaacgaaccaacattgaaaatttatggagatggataaattgaatgtaaacctggtcattatattcctgtcattttatatccaaggttttctttaaaaaaactcttaatctgaattcctctctccgtgtctagaacgatatggccttgttagaaaagaagaatattttgaaaaatattaataataaattattttcaacacattatttattatttattaaaaatcatcaatttttctgaatctcacctctcattcagtattctctttcctaatttaataaattttaattaatatcatattgaatataagaagaaaaaaattccttatgtgtcaatatcaaatataaataaatctcagttattttatttaataagaatattaagaatgatttagaaacaaatattttaaataaaatttatataattaaatgatgtcgattaatttttttattagaataatgttttctccttatatttaagattagattaaagaaagtaaaagaaggtgttataagaaaaagttatattagaaaatatgttattaacccttttctaaccatgaagtacaacaatctttggttgaatttaggatttatcttatttagtcaaccacttattgagggccactcttcatgaaaggattatgacattaacttcaaatgtgtacacactattcttgtttttttctccttatctacgttccttccattcatacacactctgaaggtcagcatttcccatataacatgaggggccactcattcctcactcaagacaaacgccattaacaccaatttgaacacactaaacaatgcaggaaactaataggggcaaggtacttcaacaaggggtacgcctcagtggcgggtcccctgaactcctcctttgactcgccacgtgacaacgagggccacgggacccacaccctatccacagctgccgggaacatggtcgcacgtgtcagcgtcttcggccagggccacggaacagccaagggtggctcaccaatggcacgtgtggcagcctacaaggtctgctggccccccgtcgccggcgacgagtgcttcgacgccgatatcttggcagccttcgacttcgccatccacgacggcgtcgatgtcctctccgtctcgctcggtggctctacctccacgcttttcaaggatagtgttgccattggttccttccatgccgccaaacatggcattgtggtggtttgctccgctggcaacactgggcctgcggatgccactgcggaaaatcttgcaccctggcatgttacggtagctgccagcaccatggatcgacagttccccacttacgttgtcctcggtaacaatatcaccttcaaggtttgtctctttcccacacacattttcttttatggaaattttgaaagagtttaactttatccaccgtgagtgtaatttttattttttacaatgtagttctatagtcccttaaatgtttataatacactaagttagtccttatttcactttatcatatcaagataatttgatgatatgtggcattgtaagagatttcatgtaaaataaaatgggcacttgtcatgtcagtcaaaattaatattattattgcaaaaaatgatggaaaaaactaatatgatctaggagacactcttaatatataaaacattatcacctgactcaatattcttgtacattgcttgatttgaagggcgaaagcctatcagctacaatattggcacgcaagttctacccaattattaaagctacagatgctaaattggcgagtgcaagagctggagatgcgtaagtataaaaaaaaaattgaaattcgttatagtcgtcagttgttgagtgatcatttggcataattaacatagtactagatatggtaaataaaatttatgtgcatgcagggtgctgtgccagaatgggaccctggatcccaacaaggtgaagggaaagatcgtggtatgtctccgaggaataaatgcaagagtggacaagggagagcaagcttttcttgctggtgctgtgggaatggtccttgctaatgacaagactactgggaatgaaattatagctgatcctcatgtccttcctgcttctcatatcaattttactgatggcagtgatgtctttaattacatcaactcaaccaagtaagatacttaccagtctagtcgaccacttattaatactaattcatgctatgccttaaagttatgcctactttggagtttgcactatactattgttattatgcttacagtttatggtcaaatggattgctattatacttacagtttatggtcaaataagtaaaggaagcaattctagtttttttgtgattgttattgtttgagctatataaagatcccgaaaggataatcatgaatttcagtttttcaacttgactacttgaaatttatatattgctaggttcccagtggcatatattacacatccaaagactcagttggatactaagccagccccgtttatggcagccttttcatcaaaaggaccaaatactatcgtgccagagatcctaaaggtgacattactcactagtgtaatttggcttgtaattttttgtaatgtgttagatatctaacaactcttaatttgtcccatatattcagcctgatatcactgcaccaggggtgtcagttatagcggcctatactgaagcccaaggaccaaccaatcaagtgttcgacaagcgcaggattccatttaactcagtttcaggcacatcaatgtcatgccctcacgtttctggcattgtgggactattgagagccttatatcctacgtggagtcctgctgctattaaatcagcaatcatgaccacgggtgagtgagatgttcttcaagtttctcacgcttcaaatcctttttcttaagccaatctacaacaaaatgtcccagaaatataaagcttagatatatacatatagaaagtaacttagatatagtttttttaattcttctagtgttaataaaggttttcattaaaagattgtgcaaggtgaaactctaattcgaattagaaaacagcgattacagtacctaagaaactatatgtaagattatgaggggaggtgaaactccaattctaattggagaacgacaccaatagtatctaaggaactgtatctaagtttttgtccatacatatatagaaagcaactttgattggtgaggttaaagtggctatcaaaagttgatgatttgtcctctgcaactttcagctacaacactagacaatgaggtggaaccactactgaatgctactaatggcaaggcaacaccattcagttacggggcaggacatgttcaaccaaacagagcaatggatcccgggctagtttatgacacaacaattgatgattacctcaacttcttatgtgctttaggttacaatgcgacacagatctcagtgttcacagaaggtccatatcaatgccgcaagaaatttagtctcctcaacctgaactatccctcaatcacagtccccaaactctctgggtcagtgacagttacaaggagattgaaaaatgttggttctccagggacgtacattgctcatgttcaaaacccgcatggaatcaccatttctgtgaagccaagcatcttgaagttcaaaaatgttggtgaagagaagagctttaaagtaaccttcaaggccatgcaaggaaaggccacaaataactacgtgtttggaaaactgatatggtcagatggcaagcattacgtcaagagtccaatagttgtgaaggccttcttaactagaaattgaagtaattgatgcaatttagctcatttgcatttctaattgattggtagcctattctaaattgtatgatatatcttccaaactagggcttctttgagagttatctctgacattgattgataacaaagaaaccagcaagtggctttctttgggtgtacttttactatgattccaaggagaaataaaacctaacacgtgcattctccttctagttataaaatctgggaagtttcttactctaatcatatttcaagccttactcgttggcattaagtttcttacatgacatgttaaaacctcatgttgtagtctatgatgtaagaatattgattcttatttcaatttgtattgagaatattgtacacataaagttttgactttgtagtaacgaagtgaggaactatgatatgaaatatttagtatgtaaaacgttgaatatatgatttgcgattgatttagatttgtttaaatgtgataatgtgtgggttgaacatgttgagtcaaattcctgagtacaatttgttttcaatgacaacaaacccctcaacaagataaaaaaattgcaaactttcttaacctgattattttgctaagcgagcagtatagtacagaaagacaaaccacctacggtgaaaatgcatcgagggccttctgggtctgtagaagttcaattcaatctaattgattacatttactggactgatcctcctttttttcttcccagaactttttggttccttaaatgatattttagtttttaattgtaattctggcaatgatagaaatcattagagataagatgtgtgttttaggacgctgattgagcaaacaaatcctacgcctctaatgagaggagaaacgagccctttagtggctgattcagattgcatcaagtaaattagttcaacaaccacaatgcaatagctgctcacttcattcctatgtacattttaatggcttttagcaggctttcttgcattggatccattggcaatgagtacatgagcaaaaataagaaactagaagcagcagatatgggattgggaaaatttacacaacgatgttggaagtatgttgaaaagtcacgctgtataattattaatgaatgtcttattaattttttgcttctaccgattaactcttgatgcataatctctttccaataggagcgtgtggaacttactacagcaagaagacgttgaagtgatgcatcaagaattgattcagtaattagacaatgaaaacaccacaataagaatttgagtttaagttacaaaagtctatctacaataggttacaggattacgttaacttcataatctgccagaggggtattatcggtttatcacaattagacacggagcattttggttttcaagggaggggggggaggcattgaacattgaggcataagaaagacgatagatttatttggataatttttattttttttgcttaactcaactaaaactcatggttgttaagaattaagatgttctgttgagcaatattttgaagatgaaatcatgaaacatactactactagcttgcgaggaaaataaagaaagcaggtgtattatttcaattttgatatgaaaaaaatatgatatcaatcaggctaacaaattaaacatgaaatcaaagacaaagaaacttcaaactattgaattgaaacaccatcacgataaaccctactactcccagaaaggaagacacttatttcctttttctccatttctgccctttgcgccgaactttgagtaacataattcagtagagagcggtatgattgaacctaatccttgtacttcatttcagataccaggaagccaggcatgtcaaatgtggcagagaacttctcaacatcagctttgagatcttcaatggccttgttgttgacgaggcccttgttgaaatccttgagaagtttgccatgctccttctggatctccagtgtgagagtcacagcacggtgaaggaactcaccaatctgctcaaagtccttttcaaccaaacccctagaagtcatggcaggggcacctgttcacacaaactccagtcaggcactcacccatgataaacaaagcacagtcacacatttcactaacatcagagaaaaatacagaaacaggggcaataaaaaaaaagcatttttgtaattaatacatcaagataattcatttttagggataaatattaaaaacaaataacaaaaaaacatattagtttatagtaattgatttggcaatcatattgcacaatcaaacaactagaaactcattaataatggcagtctgcaagcttagcccgatctaatacaccattgttaaagcactagaaattaaaaacacatcctcaatgaaatttcttccaatactaatctacaacttaccaagataccttgtacaaatgcattaaaatatgcacaaaacttagatacaatcactttgtgttttaagcattgttctccaatcaaaattaaaatttcacttcgatatatcccagggctcaaccctggacaggtggtggaatatgctagcctttaatagaaacattattacttacattccaattctgataagaaaacagtacaaaatttcgtaagaaacttcattaagttctgtgataaaaaaaaaaaaaaaaattgaggatatagtcctagccttaggaaatcattatttgatcttaagaatgagatcttgttttgaattgagttagtaaagcaagatctgtattctagcacataaaagagaaataagttggttaccaattcgcactccaccgggggccaaggcactgctatcaccaaaaactgcgttcttattaacagtaatgttgcagagatcacagagtttctccaccttattccctgcaaagcaataaacacaagaaacgagtcagattcagattcagatacattggcaacaaatcgaaatcaaaatgcagcggtccaatcctatatatattaccagtcaatccaagaggtctgagatcccacaagacaagatggttctccgtgcctccagtgacaagactgtaccctttccccatcaagtaattcccaagcgcaacggcgttggccttaacctgcttggcgtaggccttaaacccgggcgacgaggcctgttttagcgccacggcaagagccccgatctggtggttgtggggcccaccctgcagagaagggaacaccgcaaagttaatcttgtcctcgaaatcataaaccgcgttctccggctgccctttcttcggcggcttcgggcccttccggtaaaagatcatccccgcccgtggaccccgcaagctcttatgcgtggtggtggtcacaatgtcgcaatactcgaaggggctgttcacttcctgcgcggccacaaggccgctagtgtgcgccatgtcgcagagaagcaatgccccgcacttatccgcaatttccctgaagcgtttgtagtcccaatcgcgagggtaagcgctgccaccgcagattatcaattttggcctgaagtctagggctttttcctccaagcggtcgtagtcgatgtagccggtggtggagtttactttgtaagggaggctctcgaagtaaatggaggtggcggagatcttcttgccgccggaggtgtagtagccgtgggtgaggtggccgccggaggggagatccagccccatgatgcggtcgtgggggttgaggacggcggtgtaggcggcgaagttggccggggagccggagtagggctgcacattgacgccccaggattgggcgtcgaggtggaaggcctggagggcgcgtgagcggcagaggttttcgatctggtcgatgaattcgttgccgccgtagtagcggttgccgggcatgccctcggagtatttgttggtgagggcgctgccgagggcctcgatgactgcgaaggaggtgaagttctcggaggcgatgagctcaatgccgcggcattggcggtgcttctccttctcgatgaggtcgtggatctcgggatccaccgtcgccaagggcgtgttaccccacacgctcactggatccatgaatgttgaagatgaaatgagtgaagagagtgttgttgtgttggtctaagcctttgagctggaaggcgaatgtgagtgcccagtgcctatgtgtgcgtttttaaaagctttgcgaccgcctgtgaattgaccgttgtaccctgtgcttccggttggttaaattgtctccacttgttcgcctgctgctcgttacagacagagtagcttcttcctcttcctaaacttttgccgtgcctttttttagtaacttttttcccacttattacttaattgccttataatattatattcatttatagtatgtttgaaaacatgcttcacaaccaataaatcacgtctttaatgtggaaaacgtaaaagcaaaaattacgaatatttatttttggtgtaaaaatttatgtcctagcttgttccaaacaggatattagagtgtcggttggacattagagactccaacgtgtgtcaatttcaaagcatgaagtacttgcttccacgtcattcacattttttaggtaaatttgcttgtagatgtgaataaaatcatgtcattattcgtaatgttctggtttttaatttaataacaacacatgaaacaacagagcagtttttaacaggacaagaacaaaacttattaatttatttataaggaaaaaaacagaaaagaacaccgatctcgaatagtgttattagtgggattctctttctgttgattaaaaagacaaacagtggctagtatttaaaaggtgtgctgcttgcactcacactcgtagatttagaagtctatctgttatcaaaccagttagcttgattagctgatcaatcaagcatgggacgagttaaatttggaaaatgcttacattaaaatatatatcaaaggcttttcattcaaaaacaagcatcagcttcacttcttaaacttcaacttaagttaaagcaagctaagaaatccaattgttcaacatttgactggaaacctgaaggtgatgccctcgtagcatatgtacattgtacgtcactgcaagatttggttttaggtttcattctcaattctgtgtaacgttggtagcaccgtggtaggtgggggcaatatagccaatttattcccaccaaaatcaccaaccctctctactgcactgatgcagacgctttccttccccgacaccttgcttcactaacatggggattgttaatttttaggtttctgaatatgactaggaactacgaaatattgtattttttcccccatccaataaattttgattgatgaaattgagtactacaataggtctatgggattaattttgatttaacaatgaagtcaatgttcagcaggcatgcatattatgttgtgcatggtggctgattatcgcacgcgcagggggtaaattgacggatttgcattcaggaaagcctgcttagtttaagttcatggacataagtctttcatctcttgttaaatattttaatagtttatatcacaaaataatatataaaccaatgagtcaaaagtatactaattaatgtaaaattttgtcttttgtattacctatcataatacaacatattcagccaaaatcacatcacaacaacaacctcttgtgtcttcaccccccataagtcaaaagatatttaattaagagcatcattagagataaaccagtggtaacttttactctgcaccctctaatgcacctttaacatgacttgatgtaacaagctttttatcctttaactttaattaatttagtttttatcttttattatatatatatatatatatatctttattattagcattttagttcacgtttccattttcacattttatacatgagctattttaaaatcctaccagcttctatcaaaacatttattattgtacactttacaggcataccagtttactaatattcaattcaatgtggtgaaattatttttaaaatgaagccttttaagccaccctactcagttctataatcatgagaaatctcgtagcatcgtcaagagatattgatatgttatcaataaaaaaataaattccaggatgaggaaaaaatctgcctgccaaaccacttgaacaaatgtacatttgtagattaagctgaaccactccaccaagtttgaattcccccaaactctaccaacatggccaagaaagtcgtaattcaaaatttctcatataaatgagatgcaactagttcactgactaggaagcattttagtttcttacttcataattccagaggttgatgtggtggttgacttaaatcgcccattggccattgtcaaagccatttgtaaagagtctttaaatcacgtatgttatttgcggttggcacgtcccaacttctaagtcctcaattacccacctgcagtttttaatttatgacttactttattatattcaataatgctctcataataattccgtgatatttttatttaattacaacgcaggacaaactgcatctacatctaggctatattaatataagcgtattaattgaggaaatacctaattttacgatctactcaagctatgccaaaaggttgttgatatactgtatttgttttaacttttaacattaatttggtcattgaattgttttacttcaataattacaaattagtaataatagttggaacggccatttgcatgtaaaaaagagagagagaagggcgagctatctgagttctatgatttgatttcttttttctcttaaaaaatgtccctttttataaatagagaagccaaataaaaattaaataaatttctaacaataatttatacaattatcatagtaaaaagttgccaatatattttttgaagaaaaaatagtttgatgcatgtcgtcattatgaagtaactattatgatcatttgaaaaaggtcatcacatctcagatagaggacacagaagcacatgatatttctttcttggatgcatgggtttttttttgttactggtcatattcttttaaattttaatatatgaacatgttcatgtttccagcagtactgtactttactttttaaaaagaattattaattattataattcgcaaatcttttagtcgtatattaattaatttcccgggatcgctcactcttttcctaagaatgcgaatgtaatggaagggcactttttttctttttgttattttttattctcttttctttaaacaggaaccaaccgacacagttttttccaggtcttgacctgtacttgtgtggcaagctggtaacgcaaagctaatataaaaatgtccttaaaaaaagtaatataaaatggcttttaagatagttgaaaattaattaacaaagatattttttaactaattatgataatttcgtcattaaaaaaaattgaaatcccatttagaaataaagatacaaaagtgaagattaaacacattaattttttattggaatcaattctatttgagacgaacatgatttttatgggcgaaaaaactcttcataagtatcaaaacaatcgcattgttattacttgaattcaagattattggttaatttaaaataactctacatcagtttatctatacggtcaaaggtacaaggagatagtaagtgtaacattcaaatcgaattacaccacaatgagagggatgcaaaaattgtgcatgtatgagaatgtatgactgataataacttaaatgaattaattgatactacctctatcaacaagatacatatacttttcaatagttcattacttaagaacttcatagttaagtgtttggcttagagtagttataagatgagtaatattttggaagcttccctgaaagcatatgagtgaggacaaaacatgctgaaaaatcttgtgttgatttgtgggatcagtcattgatcctgaaaacaggcagaatgatagtcaaagtctcaaaaatggctacctacagagagttctgattagtggaagattttgaccaacaaagatattgaatgaaatgtcgtagtgtgagagccgccaagaaattgaaaatcaaagatattatagtacgcgtaagaggacgtcgaagagagaaagggagagacaagcaccctaaggctcataagcttcacaagcaccctccttagctcaacccaaccattaacgtttcttgagccatgcagctgatatctattaatataaaatgtcctcaaactagtcttgccatgtgtcccctcattattggttttaggggggacatgcacatgcgtatgtgatattgtcggttttataccaagtatgaaggtgtataaatgtatcattgcaactaggaataaaaataggttaagttaagctagactttgacaggtttgaacctagtctgcatcattatcattaagcttaagcttgatttattacatgttaaatataagttattaagacctaagtgtaacatgcataaaggtctgtcctagcctaaaaacctatatacaaagtctgattaaataaaaacaaataattaaaagtaaaaaataacataatagatatgtttctcttataagttataaattatcaaatataatcttataaattataatttatatagacacaatgttcagatttaattgatttttttgaaagcctataacctaacctttttaattaaaaaggtttttaaaaagctcaaatttaaacgttttaataaataagttaagccaaacaaaaccttaactaaactagattgtagatccctgaaagactttctagtctatttctactcctaatttacaactttttgatatgtcacgaaacgtaagttcctgacatgagaccagatcctaatgatttagggaccatattaattgatagtatcatgttagtataaacataatcataagagatatttatatcatgaaaaccttctcactcgggtaaactagaagccagccccctctgtcatgcctctcccatcctcctttcaacacaaatatcactcaagtttgatgtacatagttggttggatgtaccaatgacaaatttaaagtatgtaaaattttaacaatttttttataaacaaaataaattagtctaagagtacctcgtatcaatgtatattttaattaaaatttgtaaacttaagtttaaattaaacttaaatttgtaaagtgtgtttgaaaaaatatcataagttttatttctttaaaacagtttttaaccaaattttactctaaaaacatattttccatgaatattttaatggaaaactaataatttccttagtaggtgaaaaagaatactatagaagatcaatgtgcagttgagttttataaaagctagggtgagtacagggcgagaccaacagttgcattttggtgcgattgcaacacgccgagtcgtgccaagattcggtaaaaatatcttctcaataattgtgattgtgcggtgccaatatttttggttaatggttggttccaaggccacatctaattaatctccataaccggggaccacagcttgattatttatgtatgctggtttttttcttttattttatcagaatgttttcagacatgcacattcactttccttgtgtcttccatttacgattcctagttttctttcattttcaaataatttacaagcaaatcaccgacgacagacaccgacacacgtatatatattcagggcgctggcggagggtgttgcttcagcttcactgatattatgatttggcaatccacaacgtagttaataggtcatacaccaatgaaaaatagcaattcagatacaactatggtgaccccatctcccttataatagtacattattaataccaagattttaggagttgactcttgcaatcatctttcatgcatcacatatattttttttttcgtattttaagtgattagtgattttaatataattatttgaattgtttgaacatgtcttttaaatcgtaataaaagagatatatgaagttatttataataattgatttgtatttaaaataattcattattatggataaagtaagaaaataaagttaactaatatataataaattcgatcatttttaattataagattcaaaattttatttatataataaaaaattgccataaaaatagttttcatcaccttcataaatttttgcagcatactttttttcggagaaaaagatggtgaaattgataaagatgtaaatcatagaatcagggtagggtgaataaaatgatggaacacatatgaatttttgtgtgaccgcaaaattttccttaagttaaaaggaaaattctagagaacaactgtaagaccgacaatgttatatggagcgaagtattgactagcacagtggcggacccatgatttttaatttatgttcgcacaattattggtggggttcgggggcaacgttcccgaaaaaaaaattgtaaaaaaaaattaaatcaacattttatgtacaagattataaacccgctcaaaatatagtatgtgtaagatcaaaatatttgaaagtaacaacccctaagtaataaaatgagccaaagatgaaagtcaaatataattaccaacaatattgatagtttaatcatgtgaagagtaaaaaatattgcgacaaactattaacaaagtaatttaggctatacccaagatttatatatcatgaagataaacagagcataaataatcaacttttgtatattgaactttacttcaagagaatgaatcagaagagatcctaatccctttatataagcttctactgtaatgagaataattggtacttgctagtaatacctaagttaaacacatatatcacagcttttatataaattcattcccgcttcttgctaatagaagtgtccatcctttgctagtaatattttttgtaattaaaaataaaaacatgaaatgttttctcaaaccaccctacccctaaagtgccattatcttatcttactctgagataagagctttaaacccactacccaagctcacaaatctacacaacatgattcttaatttcgtaatccacaccccaccactcctgaatcacaacaattccacgagcatcctcttttccaaccacatatgcgtcaaatgtctgctcagtagaaaatattataaaaaaaaatacaaaatatttgtgtctgcacatgcggacaggaaaacaagtgtgggtccaccattggactagcacataggtaacatgagcacaaaataggggtagcagaaatgaggatgttaaggtgaatgtgtggttatacgaagatgaataatataagaaatgaaaatattcgacgaaaggtaagtagtttgatgtatgaaaagattatgagggagtatcgattgagatggtttgggcatgttgtgagacgatcactatatgctctcgttagaacaagagtttgttaacaaaagttcgacacaaagaaagataaaggtggattgaaactcacttggggaaaggttgttaaacaagatataatagagtgtgatatagattgacgaacggtgtgtcttagaacaaagtggagaaaaattataaatttggtggaggattaaacccattagtatatttatattctagtcttcccatgttctagtcttcattttttagttcttttcacctttcttttattttagcttatttttcgtttcttttgtcttatttttcctttttcttttcatctctctttctcttttttgtctttttttatctattattggatttatttattatcgatcctaattaatttagattaaaggtgatgttgatgttaattttttcgaagcagcttttatcttagtgagcaaatagttttatgcaaaattgtataattttattataaaaattaattgataattttaccggaataacgtacgttataattactttttactaacatattcaattataaaacttatttatataataattaactaattgttaaacctatattttgcacggggtgtttgtaaataataaaaatgtcattttttaccatattagttattatacaaaggatatcaaatgagaaaaaaaggtttttaacctaaccaataaaacaaaatttacactttattaattccattataaaatatttcaacaaggaaattaaaaatttatgataatagtctatctattgaaatgtagagtttttatattattattccgtcacaaacaactatatataataaatttattaattttgacaataattatgttaaaagtcatacctatcatatttttaattagttaatacttaatagtataaaataattacacttttttatatgtgtaaaactttttatactgattgtgcataaaaattaactcaatttttcttttacttatgtgtcattttatattttacacatcattgaacatatgaacagagcataataatcaaatttttaacaaataatttatctctatctaataaacattttgtaacatagattttgatacctattgctgctgctatgatatcctttaaatatttataatgtgaaataaatacattgaagattgaaatatagtatattgtgttttataattttagagaaacttggttgatataaaatatatatacaagacaaaaataatgtcaaatgagttttaaaagactaaatgaataatttaaactaaaaaaatttgtccaacatatttaaaaaaatttacttatttactaaacgtgttaaactatattaaaaaataaattttcttattaattatttactaaatgatgcaaataacagggcacagggcaaaaaaaaaaacagatctagtccacctcaccaactccctctccctccccctcccaaacccttatttatacacacactctcacattctttcttcacctcttcactctctttctctactctttctttcttcttccccggctcgtaaaccatggctttgttggtggagaaaaccacgagcgggcgcgaatacaaggtcaaggacctttcccaggccgacttcggccgcctcgagatcgagctggccgaggtcgagatgccgggcctcatggcttgccggactgagttcggcccatctcagcccttcaagggggcccgcatcacgggctccctccacatgaccatccagaccgccgtcctcatcgagaccctcaccgccctcggcgccgaggtccgctggtgctcctgcaacatcttctccacccaggaccacgccgctgccgccatcgcccgcgacagcgccgccgtcttcgcctggaagggtgagaccctccaggagtactggtggtgcaccgagcgcgccctcgactggggccccggcggcggccccgacctcatcgtcgacgacggcggcgacgccaccctcctcatccacgagggcgtcaaggccgaggagctctatgagaagaccggggaactccccgaccctaactccactgacaacgctgagttccagatcgtgcttaccatcatcagagatgggttgaagaccgatcccaccaggtaccgcaagatgaaggggcgtctcgttggggtttctgaggaaaccactactggtgttaagaggctctatcagatgcaggcgaatgggactcttctcttccctgctattaatgtcaatgactctgtcaccaagagcaaggtaatgtctcttcttttcccagatctggtgctttttatgtgtttaaatgtagggttgagttcagatctgttgttcttggatgggttttgtggcattggtgatatgaggttttgaatctgttaactgtttgactaatgccgtctgagaagtctggatcggtattaggtgttattttagtgtgttgaaacttgaaacgtcagaacgttagtaagtagcttactaattagactctaggacaatgatcacatgtttgattccgcaaaataaggatttattccgagtaaacattttttatttgaagctacattagataacttttgaattttactactgattttgatttaggattagaaaaacattcaaacataaagcatgtcgtttcaaaattaattttgcaaacatggatccaaactgagtttttcgtgatgagttgtttatggattagggtcttgaaaccaataagtgggtcattgggttttgtggatctagtggattatgaattgattttgctttattgctcgtgttattttttattaaccttttgatctgtggttgtgacagtttgacaacttgtacgggtgccgtcactctctccctgatggtctgatgagggctactgatgtgatgattgctggaaaggtggctgttgtggctggatatggtgatgttggcaagggttgtgctgctgcattgaagcaggctggtgctcgtgtcatcgtgactgagattgatcccatttgtgcccttcaggctctcatggaaggccttcaggttctgaccttggaggacgttgtttctgaggctgatatctttgtcaccaccaccggtaacaaggacatcatcatggttgaccacatgaggaaaatgaagaacaatgccattgtttgcaacattggtcactttgacaatgagatcgacatgctggggctggagaactaccccggtgtgaagcgcatcaccatcaagccccaaaccgacagatgggtcttccctgagaccaactccggcatcattgtcttggccgagggtcgtttgatgaacttgggatgcgccacaggacaccccagttttgtgatgtcctgctccttcaccaaccaggtcattgcccagcttgagttgtggaaggagaagagtactggcaagtacgagaagaaggtttacgttttgcccaagcaccttgatgagaaggtggctgcacttcaccttggcaaacttggagctaagcttaccaagcttagccaggcccaggctgattacatcagtgtgcctgttgagggtccatacaagcctgctcactacaggtactaagtgattgagatgatcaacggaaagtgagggaaagacaaaatcggttttataaatcggattgattgcttaattttccttttttttgaatttttggtgttagactttcagatttgaggtagaagaattttagcttcttttttctttttttaatttccgtagaatttgtgttcgagtgggtgggacgggtaaggaggaagacatactgttggtttctgtgatatgaaaccaatttggattgaataaggattgttttgtctgggggatgtgtgcattttgctttattaaatactaaaatgtgtttctgtccaccatttcaatatatcaaaattaatcaagagagaaaaaaattcctaccatgtatccagtttcataacacattgacacatcgtgtattatttggtgcttctgcattatttttttaaaaaaggctatcagggtaattaagtaattttattatgtaaactcttttttttatggaagttcattcgagtttttctctttttttatttgaaaaaataatgatagcactggatttgcatcgtttatattacgagttcctattttctttgcatatttttagagccttataagttccaattaattcgattttagctatatggtgaattaacttaaggggtaaagctctctcataagtcataagtagaatcaagcttaagggaaatcaagttctttgttaattgaatttacacagattggtgagttagaattcaattttctcaattgttaatttgatttgatgggtgtttacactgtcgtttaaaacctacagttttaccttaataacaaaaatggcttaaaaaatcaaacattttaaaactagtcaagggaaaaattgataaatattaatatctttaactagtcaattgttcattctcaaaatcaagagagattcctttatattactatcaaactgataataacgtaggataataacaaaggtccaaataacctatgatatcgtttgctttgatttctttagtttttgttacaatgataaaaacaaatttagacctcgcccaaattataaaaaatctgatttgttttcatgggtgcttagaaaaagaaagaaaaaagacaaagtatctttagtgatagatctcaaattaggatcttagatcatttttcggtaaattttatagtgtcacgtaggattgaagatctttcaagatttctcccattttgttctttaatggtagatttcattttgaaatcttagagaaagagaaaaagaaaaaaaaatatttttttttgaataatatgtatatcttaagggtttttctataagaactcattttttcatgttggaaatttctttatctcttttattgaaaaatttaataaaaataagattttgaacttaaaatctttaatcaagattttacattaaagttgttctggaataaaatattccctacctattctgcaaaatgactctaaattttaggcagtaatccaatttaggctcagagaaatcttgtttcacatcaatttttgcaagattccgtgttagatggttctctgtttttacgtgaaaaaaatgagtacaacagcttctcagtgacgcattgaagaatttgaatttgaatatcctaacgtaacgtcttggatgctgttggtaaagagtggtaaaaaaaaaaatttctttgctagaacataggcgctctcgttgtgtcaactattattactgtgtcacccctcttcgatgctagtcttgcattgccattaattacagtaaatttaagtacctgtcaaagtcagattcaatacaacccttgtctgtgccataagggcctgaacttctcaatattggtctggaaaaggaccagaggccaattacacaatctgcaattttgcatgtccgatacgccaattgtatttttatacgcagcctcaaagttcaggagtcaaagtatggggggtttgaagacaggaataacaaaaaaaccaagtatattgagagtggtagtaaaggttgattgagagtaacaagtcacaagcgactattgagatattgctaaaaacgtcataaacaaataaaaaaattaacggttcatttgtcaatacacaatactctaaatttgtttaaagtttcactatgtttttttttttaacttaaatatgtttttagattatcttatttttaatcctccaaatttgaagatactttctttagtttctggaattcatataatatttttttaaatcattctttactgtattaactaaacgtaaaataagatattcataatttatgaaatttttttacaattagaattgattttctactttatatgtataattttttggcaattaaaaattatcatcatcaagtcaataaaaaaaataaaaaaacccattaattattttaaaatttgctttaaattttttcattgatttaattttaatagttttaaactatcataaattgtattttaaaatataaaatagaaaattattttttgagtgtaaaaaattgtccttattctccattggatcacactggtaaaaagagcattactcgactttcaaaaaaaaaaaaaaaaaactttaaatttaaagaactaaaaatgaaatgatccaaaattgaaaaattaaaaacatatttaaatctgttttcactaatacttttattaagaatctcgaataagctaatgtgaggtgtgaaaataagcatgaagaacatggatattaataatgatttgctatacaatgaaaagacaaaaacagacacacacaaaggaatgagaagtggatctagaaaagtaaaaaagggtcgtatcttgcttagtcctcaatcctcaataaataataacagaaaggacaaaacatagtaggttatcaaacccattactatacaagtcccctatttggtgggttgcgtgttcgacaaatcttaaaactacgatctcagttcccttctgtcgaaggagtggcctcacataaataatctttgtgtagtattaataaataataaatttatgcgaaagtgatgttgttatggcattattttagttcaagacagaaaacatgaaatgtggagtatctgacatttggctcgctctaattattgtttgagatagtgtttttcatggaatcatcattcagttggattcacatgatgcctttagttaaggaaatataacgcatgacactcaatcactatggagaagcactaagcaagttgtttgtatcatatcatatcctatgggagcgtaagcaaccaatagaaaatttatattttagtttaggcattaaatttgcaagtttgttaaatatcatttcacggacaagagtttcaaatactagctcatctcatcttgtggtaggtttggttggattataataatttcaaatacttgattcattttatattattttatatttttttcttctaaatcttaaactcataagttttttagggatttaacattcaataaccaaaaattactttaagattcaattaatctttacgcaagcacgaaacattttacgtggaatttttttctcatgtttattatttttcgttcacaacattcaaacttagaactctatataagtaaatcaattattttacaacttgaaagagacgttagtttaaagaaatttatcgtgtaagtgattttttttttcttaacctgaatcaattttgaataacattttttttactactttttactacaataggaagaaagagtagaacttattcgggtaataaaacatcaccaagtaactacattaaaactatataaaagagctagtttgtgataaggaaaagattgttagaagatcttgaaagattaccagtacataaatttatggatatttattcgtgtgcttgggtttcataattttataaatttatttagcctttaaatacaagtttaaatacgttacacttttataatcaccgtggaatctgaaggctaaatcatcacttacatcattagagaggaatatatagtaccctcttctagggaatttattagctttgattgtaaagaaaagagaaaattcgaaaataccaattgttagatgctgaaaagtcacaaaggtttagactctaggctttttagaggtttccggcccataaaggtgaatgttttcaaactgggcttctcaataataggagacttactattattttcagaatcaaagttttacaaaagtaatgtaaatacaaaatgatgactaattgagatattcaactaaatacaaatacttgattattttataaattcatatattgcttatagaataaaattaaaaatttcatagtaagttagtaactattgtttagcaaaaataatattttcaaaattaactataaaaataattaataataacattaaagttcacactaaaaacattaaaattacatattatactaaaaaatacaatttagttcctaagtcttagttttaagatttttcaattgaattttacgcattatttgaattaaaatatatagtaatatagtatttatttaaaaatatgtataagtaaaataaatttgaaaaaagtgtgctgggattttctgatcttgacggagatggaattggaattttttttttattctttcctctattaaacatttaaacctgactccaaactaattcctaaaccgcctttttaccatccctacttaaataccatcatgttttatctgtcatcttaggcccaaaagctttcattccaaaagcctcacagccctttgccttgcctgccgaagcagtgaaacatttgttagatagtagccagtgtagaaaatagtttatcacctcattacctgtcagaggagcactggcttatagatagtagcaatagatttgtatcaattaagataagttttgaaatatcacaaattttacttaagggtttatataacatgaacaaaaaaagattatttggctgtcattcaactacttaaaatgctgtgtcacagaaagggaaatttatgtttcttgtagggaatagaccaaaggtaactcttataatagaaaagagtgcttatttatatatatatatatatatatatatatattaaatgtaaattcagataggaaaagtgaattagttaatgcagatgtgatcacattttccaatataaatgatagaataaaaatcttcatttaattaaataaaaatgacaaaaaagaaatgagtaaagagatgaaaataacttatttcccctctctttatttgattgtttctttgcaggcgattttattttaacaactatgatttatcttctttttggtggttgttgaaaaagaatgaggtggggtgggtaggtaaattgggtcctctttccaaactaacactataaaagatgagggccacaagtgctcgagtatggagtgtggatcccctaggggcaccaatgcataaatgctcacttggatagttgttgttgttgttgaaagtggcctaccattacctataggctatagcatagcatgcttggatatatctagtgttaataaaacatcaacattgccatcacaggccattttgtcaagcttcacaaatctccagccaagcatagctcagttttttgagtttgacattggcatttggcacatggctagtggctattgactaactttgcaatgtgaaggctttgccaagagaaacataactgaaaccatgtggtctaattagtgctagtaatctcttgttaattattatatctgatctgttgctaattcaattatttttcctgtgcttatcttccattagtgcaatgcagcacacaatgaaacattttagcatatgccaacccgggttgttgtcccaagtgcttcattgttcatttgttcagcacatttcactatcatattatgatattattcctaaccaactccccccttcccacgcacatcattactataataccatagtatcacaggaaatatcttcatgcaaatacaactctgtctttgtgattgctatggaggataagaacacattatatgcgatacgttagttccatgccatgaagatttcataatctttttgtgaatagaagtagagaagttgctcctaaactagtattttaccatagctttcagctacgagaatactttgttttcgacaaaaacaagaaaagacttagatcttatgcaaactatccaaatcccccacactaagccgatcctaaggaatttgacgagatcccataaacttattaagagaataaccaaacataaggaagagagagttcataaaaagtgaataattcctagaacttgctgaaaatggctcccacttttgaactttgacacgagaaactattatttctggcagacttttactaacataaaatggaaactacgttcctcttttcataactaatctaagaataagatcgttggagaatgtgttactagcactcttttctatggaaactatgtgtttaaaaactaagatgagatttgttttaaactcggtttgcattttgtatttttcttcttcttatttcctattttctccataccaaatgtgaagaaatcagcttcttttccctgaaatctcgatatagccacgaaggtgcagaaggggattggactcgatgtgaggagcctcattttaaataaaatttagacccattacatattaaataagatacgaatgctcaggttgattgctctgtatgaataatttcctgttaaattttgcaacttgaaaagaagcttgggagaaccacaccataaaaactaaccactatgggtagagtcaagactttataaaccccacactagattccatctttccaatgtgggactgaagtcccacaccttgcaattgataactaaactctacaataaatagattttgtaacagataggcatcaaaatcgcagagagtatgtcaagttgcagtggtatgttctcaagaacaaaagttagatattttcataattaagctagtcataccatatgttacaaggaaagaactaaataaaaagcatttgaaaagtataaaaacaatgaccataataactacacaggaaagctcataaatgaaacaaacaagattagatggaaaaggaaattaagaataataacatacatgatacagccacttgggacactttcctagcttccttcatccattcaatggaccataactgtatcaagttttgatgccttgaacacctcttgcacatccagtaatgacctcacagcccctattataaggatttgctggtcttgcatgacaattgtagtaagaagctcctgctctatcacatggaaccatgtccctcttgagtgtctcatagctaatgtactttatgtgctgaacaccttccagaactctcctgttgctctctgagtccatttctggctctgccaagcactctccaatgcttttggtgcaaacccttttggtcatcacggcagtttcactcaaattgaggtccacaactaataggccattgcagattgggagaagggtgtgaagcagaagaacaagtgccaaacatgggaaagtcatgacaatgaatctgggttgggacactgttctgtgttgttttcagtttgttgttaaggttgtgaaagtgaatgtgagagccttagtgggtggatagtcataaattggagactctgtgtacaactatctctccagttttcgtgcaaaaggtaaaataaaaaatgaaaattgtttttagaagtgaataaataaaactatatttatctttaaatttaaatatgttaagactactatatataggagtatttcaaattaaataaataataaggaatttatttctcaatccccttttaaaagtttttattgcacaaagtttacgattagacaaccagttaattatgttaaaggtatcatgcgatgaaataaatatataagtggagaagtagggtggaattatattcttttcgacacatcctttaatttatttattattattaagaaatttttatgtaagtttcattagatggcttgggtttatattttatttagtaaaattgccatgaaaagacaaacgtgataggaaatgagaagttaaaaagtaaattgaaacaaaaaaaaaaaaaaagttacaggattaaatcaaaaccaataataatgtacatatgaagcgtaaatattaatttttcctcaagtatatatgtataaagcgtataaattgtatttatgtctaaagtagacaaacaataatgtgcttgcttctgatttaatttaaaacaggttgtgttttcaaccaaagaaattctaatataaatgactaagtgaaattataaggttaatttaatgataaagagaaaaaaggagggagagagagatcctggaattgatttttctattaataaaaactaataatcaacaactaatatttatggatagaaaaaaaaatctttcaaatacaaattcactttgaaagattcttggatcgataaaaaaataaaaaataaaataaaatgaatttgataatgaaaatgagtttgatgaaaattaaatgtgttctattttagagaagaacaatgtctagctggataattagtgagttatttttggatcaataactcttgaggtatatatggaagaaatatcctgaaatggagacgacattgagcgtattttttatttataagagtgttacctttaagtccatcgttgattgttttgtcatttttgtccctaacaattaacaactaatatttatgaatagaaaaaaaccttcaaatacaaattcactttaaaagattcttggatcgataaaaaaataaaaatgaatctgataattaaaacgagtttgatgatgattgaatgcattgttaaatatgatgatacatattcttaaataatgaaagtaatgatgaaaagtaatgctacggctaattttgccattattttttatttttctgctaaacggcttctaatctcgtcgtacatattaatttgacaaacaagaaattatcaatcattcatgtattatattgtattaatcacgttaatctttgattttagaaattcttcactttagtctccaattttgtaaaaatcattcatttcagatattttccactatcattttatacagaataagattaaagtgaatatcattttataaaatctaaaactaaaaatgaaatttttgtgaaattagagagtaaactgactgacaattacaatttcaaaaactaaaagtagggttactcagaaatagacacatttctagtttagagtgtatttggtaatttctaaaattcaaataagtaggtaaaatggaataagttttaaaatcacgagtgaatcatgtgacccacggtgaaattttagctaggggagatttggcttcttaaaatattcaaccagcaaaagttatgaaactaacatgatttgaagacaacatatgattcctgcaagggaagataaaccgttgtaattcgtgcggtgtatgtagcgagagaaaatatcgttgtcaatgtgcgttctgaacaaatgttttcatgctgtgttagatggaattccatcatgtaatggaaagtaaagctgatctatccagcaaatacttactgcacagctctctgcgcaaacatgaagaaaaactccataatcaagactttttaagtttatagtaatacgtttgaaagccaaacagaacttgaatatttacaacactgtcaaccagttaattaacattgtatccatcagtcccccaaagctggtaaggattttggatttttcccaagataaatcaggcagtaagccagaataactcaaagtgtgagttgatccatgttcttaatgtttctagagattccatgagctgaccgcccttcatcttgttcatcatacgggtttgctcggtagttggatattgcctcttcattgtcagaacagcctggcctttcggtaagaaactgttcccagaaaacatcattcaccctgtctggaggagctgggttaacttggttgttacttggatcctcctgggatgaagctaaattggcctcagcagctacatttaggtttgaggaaacaccactatcagattctttaccattggcaaaaaatcttgattctgccaattttccaatttcttggcagtcaatttggggtgatctggccgagtatgaatttctgttgacttgcaatggacaagatgccagagttaagtttagttggcaggataaactatcaccttcttcactacttggctccaaagagatcagttttgagctctcagcagttgttgctcttcgcgataaacatgaatccatcttaaaagtaaaagaagccccagtatctgcaagctctaatgtttcaggtgcaaatgtaagagctgttcttgtctgcactccttttggttctacttcagacagctttttctgtgggctttccccatcttcatttgaactctgtgtgctacgtgataccaagttcatatctgaaacagcgggtgacaactccagtctaagtttattcgagaaatcttgatggaaaaaatttccaaattccattctaaaattgctatgactgtccaccaagctactttcggcaactggttgcacgtgatcaacctgaggcaatcgccttttcttatatgcagataaatccatggactcgattttgcgtgaaagatgttcaacaaaagtaggattctgaagagccttctcaaagaagttcagcaattgtttctgcctcttctcaataccatctaatcgctgcagaaaatcttctagcttaggctttgctgttgactgatgttgtttgaagttataaatattggattcaagagaagttttctcacgggaaagtttgtctatttcttcctcaaatgctgccctttctggatctacaagagaacctggaggatgactatgactgtggataggtttcctgcgatgtatattcttaagaagatgcttctgatctttcagaaactcatcattagcaaattcccatcgctctggatgtatttttcgaaatccctgataatagagcaatatcaatagaccaaaacaaataaaaccaaataatggttttattaaatgctcgaaaatatgtattaagaaaaagaaaaaaaatgatcacaaacaataatttttttttcaagcaacaagaactacaattttctttgaataatttaccattaaatccttacaggtatatactctttacaagaaagaaacccaccctctggaaagcaaaagtaggcagtgtttgagttgtgggaaagtaatattaaagaactgaaattatggtcagggtttatagtaaatggaaaaattttgaggactaaagatccaaggcaacccatgaataaaaaaaaaaaccagtaacacaaaagtactaatagcctcacaggctcacacaaatagggatctaggaaataggaagcaattctagcaagagaaagcaacaaactttctagagtttgattgcactcaaagttgaaattaattactgtctgtaatagtacagagctatagaatatgcatgggtgataggtctcaaaatgcaacctgaatgggcctacacagtaatcatagccaacaacatttcccaaagacagaaaattaaagcccaaatatccttttatgactcaatatccataaaagaaactaaggcattagcatttaactacaagcacaaaaatagcacctatcaagaaacaagtaatcagtacctctgtggtggcatgagctttgatgacaatcttggtttatagcaagggttggggagctcaaataaggtacatgagagaagtattgggtgatttaaaagaaaatgaattagttgcaaataaaaataaatgtcaatttgggagaaaatttgttgagtatcttgggcatattatctcaaggaaaagggttcctagttggctacagacacaaaaatgatcaagagtgttagaatggcctatatcaagaattctaaaggggcttcaagggttcttgggtttaacaagaaattaccaaattttgtaaaaggataatggcaagatggccaaacctttaactgatttgaccaagaaataaggttatcatgaagcttgaaagatgtgacaataacagccccaatattaaggtgacaacatttttcaaaggaatttgtgattgagtgtgatgcctttcgggagggtcctagggttagtgaatagtgacaaaacccatccaaacctgcttacgagaaggaactaataggtttggctttagttatctaacattggcagccttaccttttggggagtcattttttggtctattaaaaccaaagaagtctaaaagaattgttacagtagtgagtaacaaccccagatcagcagcgttgttggtcagtcaaaatgttaaggtaccagtttaagatgagatacaaactggttatgagaatacaaaaatataacggttacaaagtaaccatgtctactggagctcttttcctttcctttgttagtaattatatcttcactttcaaactcagttcattttaatatcagatcagcacaaaaagatcattataacacctatttcaaccaagaagttaaggaaaatgtattataaaatcgagcatttttatcaattgatcaaataaagtgccagggaatatgtgctttagactgaaaataaagaactgtgagtgtaaaccatcaagtgcataaacactcaacagttcaatagcacagcccaagaagagtatttacgtattattaggcatctattttgtgttaagacctactaatagacatatgcacctccatcagccatcttttttctggataaagaaaaacatttatggtggaggaagacagtttaaaggtaaagtaacaaatcctattcatgaaaacaaccgaaaatgctctagcatgaatttttcatcaagtttggtaattttatcatacaatattctccagtgatcctagaattcccaatggtttccaaaacacaacattaaaaagtaccactctgcgaaacgacaatataagaaaattgccaaattgtcatgctaatgtctaatgacacctgaaacttaggtggtattaaattcgcttttggagaaccaagggaaaagcatatataagtttttagaaactgctttatactttttactattagacgttgactggtattaaacgcataagaagaatccaaaaaagacagaaagagaaattattgagatctaatgatctatattgacatttgttatagataccaaccactatttctaagataggtcaagtattaatgtacaacaaccctcgctagcagcctactaagattgctaacattgtaagactcataaaaactaagaatcttaatattctaattctgataattattcaacatgcatcccttgtcaataatagaatagcagaaaccaggattaaaaactttggaacacatttggtgatttggtaattcatgagtacgtgatatatatcaaggggttgcagaagatcgataaaccttctctgatgaatgctaagtcctatactaccagattcttattaccttctgctgagtgcctaaattttctggtactttacttgagcaaggaataccacaaggcacagcataagattattctgatcaccttcctcaatgacttctgaatcctatatcccaattcacattccaaaaaaagaaacctatgtttcaaccttgtcaatatctttaactttaagtaacatatatcttcagatagactctatgagatccattgaaggtctctctatctcactatgcattctctccatctcacatcatcatcattaacatttcatttcagctcagtgctaatatccaacaacaacaattacaaaaaattagtaaaatccggcgatcatttcaagacatgcaaacaactaaatgaaagacagaaatccgaagaacgaattagaatcgaataaaaacgaagggagcgcatgaaccgcagcgaaacaaaggaatcgaagaaacgtacgtaggtattgagctggcggatgaagctggagaagttgttgtgcttgaaataggtcgggagaaggaggcgagcgaactcgggagggttccagacaacgaagctgttgttggtagagctccacgaaacgatgtcgttggtggaggcatcgtccaccatgtcgtaggtcttcagaaggaacggcgccggacctccggcaccggcggattgtggcgcaccgtccatttaggaatggatctttctagaacctctgagagagagaaagagagatcatgggtaaaagcaaggctaaaggaagaaaaccaggaatttgcaactacgctgacgctatgcagtttagagagagaaagcgagaaagagcggttttgtttgacttcaacgccgtctctaccgtagcctgctgcaggttgttgggggattgctacccaccttggaatattggaaaatatatttttgtttttctttttaatttcttctctctcttatgtattactatcatatagactctttcaaactcactatattagagatactcaaatatttaagaaaattttacatataataaaagtaaataatttttaaaaaaataaatcattctcacatataaatataataaaattttacttatttgggtcaattatttggatttaatatattgataaattcaagtatgacgaattaggagtgcaaaaatatcactaattttgaagagaaagcaagaaaatttaattttttatagcactttgaggattttcaaaaaaaaaatctttaacatactcagttttattatttattaaaaattataaaagatatttattaaattaattatgtgacctataagatttcaatttttttaataaattttaacatatagaagaaagtatgttcaatataatgtgttgataatatttttcttaaacttaaccttgatttaaataatgtttagttgatttttatatgaaatttataataatatataaacgaaatatctcattttaattgaacgtttttgttctgaattatattttattttcattttgatggtctaaagttaattattcgttctctctcttttcttttttttttaatactttgttcaactactaacgatagaagaagagcaacggtggtgaaatgacagtgctgaaatggtgttaggcgaagttgaaaatcaagcaaaacatctattcatcataccaatgacatgcaagaggaggaaatatcagcatatagcatcactatcgtagaagaataatcagagtttttttttttttttacttttccaaaaacattttgcatactctagatggttttattctgactaaattatttctacatacttctcattcgtatcttctgcacattaggatgaagaaattgagagagttcaatctacatgaaatctttttgcttcctcccagtcttgacaaacagtctttattttgaatattgccttctatacttatgtatcatccttatctctgaaatttacaggtgaagacgacaaaattttcttgcattttatacagtattttgtaagatccaatggaattacttttcttgatacatgtatttctttttcattgtattttttttatagtcttatttttacatgttacttttttatgtggttttttataggtggataagagaagaaaaattaacgagttttatatatttactcattgatccaaactgatcaatccattttttattgaatgattcaatacaaatagacttgattcaaagatttaatatgtaataatttgatacaataaaaaccagacagataaacaaaacaacgcttatgttttcattagtaatatataatgacgttaattgtttagttgcaaataactgttttggatgttttaagattttttagaagtgagtttaatttaattgcaaataactgttttgcaaatagtttctttacaacatttgctgctctaactaattgttccctctttctagtgtgatttctatgttatatattactatgcttagagcatatcaacaatatactatattaaataagttgctagtaattagatgtttgaatgtataaatatatttgttgagtcaatgatttgtatgtcttctttttaacctatttatttatctatccatctatatatacatgtcaagaattaatattttaagatattgaaaagatcaatatttaattacttcactttaaaaactttgtatgcaacatttgtaaatcatatactattcataaaagatataataattatttaaaattttataagtcttaaaaaattcttattaatatagtatttaatactttttcacaccataagaagggataaaaatacattttagttttagaataactaacaaatgatatgttgttattaacaattttttttcatgagacatttaatcacaaagattatgttatcattatttctcaatttcaaatgatttaataaaatctctttctcttcgatattttatacactaaattctttcctagaggtttagtcaaatgattgtcaaatccatttttgaatacacttaaaagtaaaaaaaaataaaaatgctagcaaatatacctccacacactaataagtaaaatactactcttgtatcccataatcacatatgtcatagactagaaaaatattcaagtatttattttatcgttgacatattgaaagagcactaaatctctaggttttttcaaagggttgtctaaatccatttttgaatacaccgaaaagaatgcatgcaaatacacctccaccgcactaataagtaaaatactacttctatatcccataatcacatatgtcttaggaaaataatattttaatattttagactataaaaatattcaagtatttattttattgcttaggtattgaaagaatatagaatccttaggttttcccaattagatttaatggttataaaacttgattacttaaaagaaaaaatatgttaatctttaaaaaaaaataaaacttaaaactcaaacatattgacatagtctttctctcgctctactcaaatcaaagcattttaataggtctttttttatcaaattctctaaacacctaaattttagtcacacaatgttccacatcctaacacacatttaatcacacgaagttgccacaaagttttacacaacacaatgacaactctaaaatcatgttcaaaacctctaaaataatttaaaaaacgctgaaaatggaacaacaacaatcccatagtcactaatttgacattcattatcattgagcaaataaaaaaaagattggggaaaaaattaattaataaattaatggattttaaagtggtcgggattaggatcctaccttaagttcttaaaattgttgttgtagtagaccaaaatcatcaatcttgaagcaatcacaaactcaattagtgcatgtttgaaaatgtggtagaaagccccaaacataggtttgccaacgcatcaaagtattacttctccgttgaaccgtttgatatatcttaaaatatgtattataagaaaaaatgacaaatcaaacgtgctcttaatcacaaataaaatagtctaaggtgagtgatatcgtattgttttaaagacttatcaacgtagtgcataagccctttaagatttaacatatcctctaaacatttgttgaaacaaaactaacaagatttttgtaagtaaaatcctgggactcacaaagggaagactcaagagggagagaaagagaggtttatgaagaaagcgttgaacgattgagagtgaagattttggcaaatttactattcagggtatttaattttttaaattattgattggggactgtttttaaaaaaattatagtgataaagtcataaaaaatattacaacttttgaaaatcgaagtcgtaatactttttacaaatgtttgttattttttattttcctgagtcaaagccgtaattaatcattcgacttttgtgtaaaactttttaaaagtgataaaattgtgcacaatgttacgactttattaattgcttttaaaaaaaaatgtttgagttgaagtcgtacattgtggtatgatcattctattgtttttttttttattatttgaagtagtaagttagtgtacttcttcctttctttctatttttttttaaaaaatctattttattatgtttttattttataaaaacttatgtttattttttaatttatagtttcttaatttatgtaaaaaataagattttttaatataaaattaacaaattaaaatatttattatttttttgtgattttatattttgtatatattatttaaatattttaatttaatgtataatatttgtttatgtaatataaatatgattttttatatggtttaatggtattttgtatatttaattttggctatatgattttattaaaaaatatttatatttattaataatgttaagatatgtatttgataaataactattgcattatttttttaataatatttaaaaatatttatatgtataatattttgcattattctttttatgatatttaaatagctattacaaaaaattaacgtactagtatttgagatatttaattttcttaatcataattataaattaatgaacaaaatcaaaatataattaaaaattatttgatatattataagttaatataaaaaatatttaaatattttcctttaaatttaattttatcaaagacatatcttaacattactagtaaatataaataatttttaataaaatcatatagccaacattaaatatacaaaataccatcaaaccatataaaaaatcataatgatattacataaaaaatattatatattaaattaaaacatttaactaagatatacaaaatacaaaatcacaaaaaaatacatattttaatttgttaattttatattaaaaatattatttttaacataaattaagaaactataaattaaaaataaacataaatttttataaaataaaaaacataataaaacagaatttaaaaaaagaagaagaaaggaaatagtacaccaacttactacttcaaatagaaaaaacaatagaatggtcataacacaatgtaccacttcaacacaatttttttttaaaaaagtaattaacaaaaaggcttaacgttgtgcacaattttatcacttaaaaaaaatttatactaactatttacaactttgacgcaagaaaataaaaaataacagaagtcgtaaaaaatattatgacttactcttttttttgataaatttttaaaaatggtccccaataagtaatttaaaaaattaaatactccttaatagcaaatttatcagaaaaagaatatgatgagttttttaaatgtaaaagtagggagtaggtaggcatgacaacttcacccgtccccacccgcattggcccgcacccgtcccgattttaacggaaaaaaatcgagtttatcagtttctggttcggattcgatttttctctgcatgctgaattcaggggcagggacggttttggtaatgttgacatccgcctcgcccccgtcccgcacctatttgtcctatagtaacacaaataataatgatattcgtttaaacctttgttactatttattatgcataataataatttagttaaattttaatttaatttgattgttttaacaatataatttttttaaacttatcatttatatatatcgagtctgataatttgattaactatcataataaagaacttaaaatatataaaatttaaggataattttaattagttgaaatctataaaattttatattaattaaatgtatataaaattttatattaattaaatgtatataaaaattaaactcttaatttttgttcttttaacttctgttgggggaaggaatttgtgtttgtaggcatgcattttgtattgttattcaattatttcatatcaagaacgataatgtttaatatgagaatttagccaaaataatcgagaagaaaaaaacaaaataatgaaaaagatttaataaagaagtaaaattattttatactattatatattcaatagtgtaattaatgatatatcatattatttatattttgtttcaaacttcacgtaaattctattgaggataattatgttcaaatatttaacaaatctatatatctgaaaatcaaacttaagactgttattaagttttcatattaattaatttatacgtttaatgatacatatcaatattaatataaaatatcaaactttttgtataacaaattaattattatatattaattctaaaattacacgtaacatgaaatacttatatttgattttatttatatatatatatatattattttgttggttcgggatgaattcagtatttctggtggttacttattttttctatgatgaatccatacaaatatagacgaagtagaagaaacaaactagagaaagtaagatgggcggaggcggggaaattgatccccgtcaggggcgggggacaaatttctgacccttcgattttcgtgggtgagggcgagggtggggttttaggggcggggtcggtataagcaaaaatcgcccccgaccacccccgttgccatgcctagaagtaggtacgataagatttttctagaaagattaaataaaaaatcatattattcatataaatataaatttaaaataattaataagatttaatattttaaaatgtcttacaaatgacacaacattataacgacattcatatacagtaaactaggaagtgggctcgtgcgagataaacgaataaaggtaaatggagaatagataaaaagaaataaaggggttgtcctgaatggttattaaattattatagattaaaaaaattcatattacctactgcttaatccttccttttaaatgaaccatgaatacacatggaaaaaaaacataaaaatgacatattccgaaaattttagtgatagaaagattttttttataaatatgattcatttattattttaaaaagataaaagtccatatcagttgatatctgtaagaacatatttcatatcatttagttaaattgattttccaaaactaatctaatttaaaaataattgaaactttattctattactgcattttaacacgaataaaaatattactttattttaatatataatatatgaataaatggtatatgcattattagtacagaacatttttacactgatgtgtaataaccagtagcataaacttaattctattttaaattaaaaaaaattaagtaacacctaattttttttactacccacattggtctcattttgtcgtctcaagactctattttcttaattttgtctggctatccatctctgtcacattccttcatctcaaaacttcatctcccatttcttctaacaacttttcttaatttcttatctttttcaattttattgttaatattttttaaaattgaatttttatattttgttaaaagaagttatcaattgttaaaaataactttttcacaatataaatcatttagtgtaaatctaaaacataattatatgtttagaagtatttatttattaattttttaattatgatataatttttatattcaaaagtttttattccttataagttttagttatataaaataatgagtaacttatacattgtacaaactaaaatactagttataagtatgttattattttcaaaataaatcttaatttattttaaattctatgaaatactatttttttaaaatttaaagtaaattaaaatatttgtatatattaatttgatttattaaaatacatgttaaagtgatttaatttatataattaaataattatatttatctcgtatatttgtaggattttaaaaaatatgatattttcctcattttcaaacaattttttcaaaataaaaaataaaaatattttcatgagacacgagaattatgtttaagtctttaaattttcattcatcgtcttacacacgtggggattatttcagtagcgtgaaacttccagaataactctaaatcagttctcttcagcctgcgctctttcgcttcttgaaaatctttctgaggtaggttctttcttccttttcaaatatttcaagtttactcctttgattttcgttttatcttattatttggtttctctctacctatcttcagaatcgagtcacagagtagagcgaaatcggcatagtggtcgcatcattggttttttgccctaattttatttatatggtttaatgttgcagcttagggttttcttcaaaattagtttcacgtatttgatgtgaaattcaatcaaatttggtttaggagtgttcctatctacattttcatgaataactatagcctgcccagtgaattaagccattcgttttgtttttcacagtttgtgaattgtgactgagtttctcttcccctcgttcatggcttcgtgccctagcctcgcaatgttatttatatggttgaatgctgtggcttagggttttcttcaaaattaatttcaccttttttatgtgaaatttcaaccaagtcaaggcatagagtgttctgttttgctcagttatccaatatctgcatcaatagcgcactatagcagtgcaaagtggccactgtaaagttttgaatagccctgtagtggctgcaatcacggccaaaatagtggctctagcggtgataagtggcgctagattgatgcttctttctaaacccatttttgcccacaaaacagcgtagtttttcggttaagggtgtgttcttagtgcacagttgagatttgcctccccttctttagaatttaaaaatccctaattggatatagtttctctcgcttttatctaccgtgtgacactcactatttgactaacttcggtgcatctctggcagtatttctgccaacactcaccttccatatttttctcctttgaactctgaacctctgttcttttatctgtgcaacacccaccctcactttttattgaatgtttaagatgccttgtatttgaaatatgaacgtgcctttcaattttgtttgtttccttgacttgtattgtatgttttgcttaaaacctatgaccttttattattaatgaatatatcatgaatgttgatgtttgtcatttaaactttgagcgttaaatgtatattgtacagataaattatttaatctatatataaaaattcagaatattgcccatctcactatgataaccatgcttacttgataacgtgtaccaaataatatgtaccattatattgcttgggagaatgtatggaaattgactctttgatgccatgtattccttgaacagatacaaaaatgccgaaagtaaagacaaatcgtgttaaatacccagagggctgggaattaattgagcctacactccgtgaacttcaagcaaagatgagggaaggttggaattttacatcatgtgcttagtagattttattacgttcttgctgaaatcaatgaaatcaatagttttatatcctttatgtggcagctgagaatgatccacatgatggcaaaagaaaatgcgagacgttatggcctatatttaagattgcacaccagaagagccgctacatatttgacctctaccatcggaggaaggaaatttctaaagaactgtatgaattctgtttagatcaaggatatgcggaccgcaatctaattgcaaaatggaagaaggtatctaaaattagttattttattctacttttgaaactggttttgtttttccatttcttttaacgtaggaggaagttctcaaaaaatctgctagttaccaaaaaataaaagaaattctccaaaacaaataagactaattcaataaaatgagccaaaagctgcgtgaaaggtctattgtgaatttgcaacaaatcatttgcattaatcatgttaagtaccactgtcctaacaaaggacatggcttttgaagacaggtttgaattttaaaatggatttatcaagtagaaactaggttagggtgtgtatgaaattgaaagaaagctctgcaggagaaaatactggaagagtccatgatccaaactcttctatctaacttagttgagggagaaagagactcaagtaaaaagtttaaaaccaaaagggattgtagttcactatatcacccatattcaaatctcttaagtaaattaaagtccctatgtaaataatgatcttggattcttagccttaattagaaatggctaatgagcaaagtagatagttgaaacatgcaggaaaagtctctgaaataggagcactccccatctcaacttcctctcaaaacttgacaaagataccattataccataccatcacccaaacattagaagtgtattcctggaaaataatcttccaattccaaaatctaatatgagcagtgttgcttacttggtcagcatcccacctgttctggtgggggttgtacttgctcttatatgcttggtgagttgttgcctcttttggcattagtctccaaaggaaagtgccaaagtcatttaacctctgaaagcaatgtttctgtgttaagatgccaaattatcaacccctaacccccttcattttaggcctatgacaaacctcccaagtcccaaaaagaatgttctcttctctgtttacccacagctgatcaatgttttgtgtctttgggtcaatctgaactcacattgtctgtctgatattgagtactggtgaaattagaaagtatgttatttctgtactcatttgtgccttctccgagatgttaattgttgtaaggttattgttacttggtagctaaaaacgttaaagaaataggtattgttttacagtcactaagattttatttgatttgtgcattctgtgttttcttggattttgagtacttaaatcattatgtttttggtctgaattgcagcctggttatgaacgtctttgctgcctgaggtgcatgcagccacgtgatcacaattttgccactacttgtgtttgcagagttcccaagcaacttagggaggagaaggtcatagagtgtgttcactgcggatgcaagggttgtgcaagtggggactgattgaataccgattctagttttagttgccaatggagggtttcttagaattactttctttgtgcttttagctttctgttgtctgaaatcctcaccatgggaccccacttctccgggttgtattactgtactaaatgagtgctatttatattgggaatattggtttcatattagtcatctgcctagttcaaaatctgactggagctttgtacctttacattgattagcctaatatggtgtacttttgcttgatactttacagcttaaacaatgggattaaaatactcgaaggttagtgtaaatttttaaagctgctttggttaagattggagtcaagctaaatattgtaaaagttattttttatttaaagaaaacaattttgtgagggaaagattgtaaaaggcaaagcattattatgagataaatatatttttgtgtcatccatctcccagtcaattcatttgatgagtaaatcttgaaatacacaaaatgaaaataactggtgatatatagtctaactagttgagagtaaatactatagacggtgttgtttccttgaataattttagtagtggtgtaaattcttgtaatcgtgttgaacgattgttttgttaaacataaaagtttggagggttgtttcaatttaagattaataatttgcttattttgcagtcaatttctttagcagttcttgaaaacaattttaaaaaaattatctttcagaatgtgatttaacgtagatgtttatttcaaagtgtaattaattatattttgaagaatattcttgaaaacattctgatgaaaaatgtgattaccgagtaaactaaaaatgtaattagtatagtatttaaaagtggatcaaatggggggaaatttcctctgaagtgctggaaaagagctgaacccatcaaatggaggatagttcaattaaaaggagcagggggacaaaagaaaatattaggggaacccattaaaaaaggctacgctctatattgttttactgaaaataaggatattgctagagccctatagtgcacttgatccatgtagacaatttcaccgaatagagtaagggtgtgttcggtagagtggaaaaaaaaagtaaattaaaattaaaattttgaattaaagtaagatttaaaagtgtgaatttcaccttattttagtgttcatttatttttctttttcgttctttatttcctcaaatgaacgggcctaggagttggttgttttacaaaaaccattaccccacacatattgtattgttcactaagaatcagtcaaatggaggcagggacaataggatataaccaaaacatcaatataaggcagctcatttatcatatatgtctatcatgatttgtgtgcagtattatgttaatctcaatgctgattaaatgcatagcatacactttttcaacagacaacgtgatgcataaccaatgcgtacgcaaacatatccacaacacaattcatattaaaagaaatcaagtgtctgtgcagacccgtgtatcagtacagtaaatgtacctagtatgggtacaccaaccatgcaggagtggccatgtaccttacccaacatctgcttagatgtttcaatagatatcattataaccaagtcataatattaagcattttgatgcatatcaagttgagaatgcaaagtgctttttgattgccaaatcatttgccaaaaacaattttgtcgtccaaatatacctctaattttgaggcactaatgttccagtcgaatagatccatccacatataatctatggcaagtggcaactaataaaatgttcagaaaacaagattaaaagctgaaaaaatgtttcacaaaaccagatattgttgaaatctcatttaaatgctaaaccactaaaaccagtgtcatctcactgtcaaggactactgttccttggcacatttgaaccatttttagctttacattgaagcaaaatatgaagcattgggcacaaggctgcaacccaataaaatttacaaattacccctcacttaatatgacaagtgcccaacatattgaatattttggttatagacaaaagaacgacatgaaagaactttcaagaagacatgatcacaacttcattctatcactaaaccattcggcagaatcagcatttacgtctcaaaacccagtaaccaatctaatgagcatcattgcttgatgagcaaaccatctagtcgcccccataaaacattcaactgagagtttgtgacttacctgtgtaatgataacctagtctgcagccatagaaagaaaaaaagaagtgaatttataacttaaagagatgaatattcaaagtttcaaacaaaactacttatggtaaagaaattcgaattacaaaaaaaatgttgtgcagatattacaaagaagaaatgtttgactaaccttccatgatccatcgctgaattatttgtggtcctccctcgtacataagatatagcaaaacgagtgcataaagtgatttcaatctgcaaatcaagaaccatgaagtcaaactgttattttaaaaggggggaaaactgtcaaaagtaaataaaaatttgtttgcagagaggacagctagcatcgctaaattagatcttagatttttgttttctaacaggtaataaatatggaaaatttttcccatcacaaacaatgaactaggagagaaaggagtacagtgcagaagtatcaggaatcctcctgaaacagaaaagtaaaatacacaagaaaggaaacaaaatataaaataacattggctccaaagagatatctatgataaaaggaagctactgaacactagctcacactacagtatttttgagtgaggagtttctatgaaacagaaaattcttgggtgctccccagaagttccccttctatacggtatatcagaccagaagatgagatcttttccatttaacttaataaggtgtaccttcatagttgaaatttattaattttaataccagtagctggaaaaggattaagttttaaaaccagcttatgatcttattaaatgtttttacattaatggaatccatttgataaatgtataaaactaagcaataagcaattacatgatttcttgggtatattgaatttgccctggcagaatttatgctgacaattatcatttcctagcaatattgattgacttatccctaatgttatggggaaacaaaatatcctaatgtaacttgcttcatcattaaacttacttgaaggcaaatatataattggtaaaaaattactcagttccataaaagtgcaaggatatggcacaatttctaagttgtatataggactattttttctaagctattttaataacttgaggttttatcaaaataaatgtgcaagcagaggtgaaaatacttaccactaaaaatgtcaaggaacaattctcttgacagcttaagctgtttggtggagctaagaaagatttatatctaacacccccttaaacagagctttttgagtttgaagtgtggacaatgcacaaacccactttaccttggggctcaaatacaagttaattatgaagaagagaatcaacaaggatcaatctcataatttcttatttatgaggcttgtgataccatgttaaggaccaactctcctaatcacacaaattgtcaggtggaagcacttaatggtaatggttttatatatttaacaaatggtaagttctgaagcctatgccagttctctctatggggtcctataggattgtggaacatggacaaattgagagtcaggatttgaataaatgtcctagtgaaactcttggcatttgctatctttctggaaacaaaaattctcgaattctggtgtctccttcattagtagataagtagttgataataatttctgtggtagcagcatctactgaaaaccctttgtctctcattattgtaaggtattttattgaccttgcaatctccttttttgtcagcaagccttggacaaagacattgtaagtgcagttatttggctggcagccattcacttccatatttatcagtaagtcttcagctttatccaacgagccttgtttacagagacccttaatcataatggtataagtataaacgttaatttgcaaacctttaccaggcaaaccagaaaagagttcccatgcagcattcatttttccagcactgcacattccgtcaagcaaaatactataaattacaatattaagatccaaattactcttctccattgcctcagccaatgacacggcctcagaaagaagattttctttacataggccatccaatataacagcacaagtctggagattggggacttgaccatatttgtgcatattaaaaaacagttcttttgcagctaatggtctacctgcttgacaaaaaccacctataagagtggtccaagtgacaacatcaggaacaaatcccatcttactcatttcctccaacagatgcatagccttattaatgtttttgtccttacaccatccatggataagtgaagtaaaaaccacaatgtccggtaaacggcccctgctaaccattaaatgaaatactctcatggcctcattcattttattttgcaaacaatatatatgaatcaatgaattataggtgaagacatccggcccttccccagtcagaatcataaaaccaatcacacttttagcctgcatcacttttccttctttgcagaaagcatcaactaaaatattgagcgtttgcaaatccggcctcattcccattttcatcatctcatccagcagagaacccaccgctttccatcttccaaaattgcaaagaccttgaatcaagcaagcgtaagtgaccaaattaggtcgaacaccttttccattcatttctgagcacaaattcaacgcctcagataataatccatccttgcacaaaccatccataattgtgctgtaaaccaccacattaggtttccaattcctttcatccatctcccttagccaacctaccgccgccaaagtgtctcccgtcttacacaacccattaatcaacgccccatatgtgtaaacatccaatggataccccattttctccatatgatcagccagtcccacagcctgagccacattgccctgcacacaaagcccgttaatgagagtggtgagagtcatcacagtgggctccaaaccaagtttgaacatagtccccaacacagagaacccaaaagcaaccaacttcaaacggcaaagacaattgatcactacattaagagtaatggtatcagcttctatgcctagagaagaaaacatgtgcttaactaaagagatggcagtggtgtaatgcttcaacctcacaataacacccaacaacaaagtaaagtccttcacagaaggcaaaggcttcattctagacatgccgtggaacaagtccaaagcttcatcaatattcttcaatttatctgacctgcataggtttctcatggaaatcaagaactgggttccgttgctatggctctcagtgtcatcagtgtttgtggagcaatgacagtgctttgaaaaagacagagaagaagaaggagagtggatggaaatggaatgagagaaagtacccatcatgtgatgaagaagacgaaaacgagagaaagagggtactcttcgaagcattaaaaactcactcttttgcttccgaacaccatcagtgtcggaaacaacttgctgcaaccgttgttggttgcagaatctggcaagggtttaggtttttttgtcaggaggctggtttaggattttgaaccgttaataaggtacaatattaatattattgttgttattattattattagtagtagtataaaacgaaaatcaaataaaatgcggacaaattgtgttttgtttttaataagaaattaaaacttagtaattatgcttatgttcaaataaacaaaaagctgaaaaaagatagattggtcattgacgtattttttcaaaatacactgcttagtgaatatttttttactcctaaataaaaataataaggattatattttaactatacaaaaataatatttatcttgtatgataaacaaatgaatatatattagttaataatatgctaaaatttaaaaatattaatttaactaataaactaaccctttaggttaggaaatggggaaagttaaatgtattttatgttatatcttatatacaattccaaaatataaaatttaaataaatatgatattccttcaatatttttaatagctttagagtttatatatttaattttaaaaaatattattattatcagttaacagttaataaaaacataatattcgtataaacatgtcatttacatagtataaaataaaaatatttaagtagcaaacatattaaagcaaacaaataaaaatttgcagatttaataaaataaatttgataggagaagctgggtttgggcgacgcgagggttccttccggtcgctgtaatcgtaagtccttcaaacttctctcgtccctttcttctattcaactgttagtcttttgaacccaaacccttcgaatgtttcgcatatcgaattttatcattcaccattgatctttctgtgtttcttcattcatttatttatttattttgcttttcatttaatctgaaatcatctgttgctgtgttgtgtaaaatagggtttggcattgaagggaatcgaaaatcaattgagtaagaacgatgtcggtgacagcgggtgttagtgatactgtgatagcagttagggataagctcagaggtaaaattggccaaactaaagttaagcgttattggcctggtaaagttcctgaatgggctgatgatgagaacgaagatgctgcccccgccgatattagaccttccagggaagctgccctggaaaaagcatttcctcgtcacgaagaagatgctgctattgtcagaaaagatgatcgtaggctccgccgtttggctgagagccggatagataaccgtgaggaggtccgagctgatcatcgccgcattcgccaggctgaaattgtttccaccattgaagaggaggccaggaggcaggaatggttggagtttgaagaagaagatgagaacgctctggcggaaagaaggaggctgattaaagagaagttgcttcaaagagagcaggaagaggcacttcctcaggaagaggaagaggaggaagaagaagaggaggaggaggaggaatctgagtacgagactgactccgatgaggaatatacgggagtggctatggtgaagcctgtgtttgttcccaagtccgagagagataccatcgcggagcgtgagcgtcttgaggctgaggagctggctctcgaggataaaaggaaaaggagattggaggaacggaggattgagacgaagcagattgttgttgaggagatccgaaaggatgaagaaatccagaaaaacttggaaatggaggccaacattgctgatgtggatactgatgatgaagtcaatgaggcagaagaatatgaagcttggaaagggagagagattggtaggatcaagagggatagggaagatcgggaggcaatgttgaaggaaaaggaagagattgagaaggtgagaaacatgacagaggaagagaggagggagtgggaaaggaggaatccaaaacctgctccaccaccaaagcagaagtggagatttatgcagaaatattatcacaaaggcgctttcttccagaatgaatctgatgaccgagctgccactgttggatctgatggtatttttgctcgtgatttctctgccccaactggggaggataaaatggacaagacaatattacccaaggttatgcaagtcaagcactttggtcgtagtggaagaaccaagtggacccatcttgtcaacgaggatactactgattggaataatccgtaagttcaatttctcctatgttctatatctttcaagaatagtggtagattgtttgttctattctttggtattagatctttgttgttttatcctgagaattttttttttggcatatctgttcatatttacttatgaagttcatctgctgtggcactggtccaaaatggtcttggacattacttttatgttcatggaatgaaattgagatgctcatgtcaaaatatttgctgctatttgtcgtcagaagaatgagatgagtatttttaagaagaacggttttgtgatggaggccccaaggcccaagatcactaaggtgtatgtaaggatagccaaaaggttcacatgatcaattttaggagagatataaccaactgccaaccctgtagctgagcatgggaggagggcatgtgggcttgttctaaggagagagagaatattagcctgagaagggtgtgtagaaggtaggctggaattaggcttgggctgggagagaccacacactctcgaaactgtctaggaatcttttttcattttgtaccattctacacagaagataccaggatctgaactccattgattaagacctgttactggaatacaaatatttgtatgcttaatttctttgttttagtctttctagcttgctggtacctatcattttgctttttaaggaatatgattgtgggtgagattgagaaagagggagagttgataggaaggaatatagttaaaagacatgtttcatttagagtaagcatagttatgccatctcacaaatcctattttatttttttggcattcattttgtagaaatatgtacttggcttgaagtttattgtttacaactttcttagtttctcaacttcacctgacaacctcaccttctatgtgaatttagctggacagtaagaagggattatattgcatgtcacaatttaaacgagttgcatattagcagcccttgatatggtttgagatcttgacacaagtgcatgctcatgagttatgcttatttgttttcatagtacttttgggtttcacttttgtcatttgcttgcttgtaatttgtgaagttgagaggataacataacatatagaagttatgattctattttaatttatagattaagttatattctctgttctgagaacatctgaaatactacttttatgattgattctgtttgtgttggatgttgatgtaacttgttaaattgattctgccattcttctgattttattacaacaaaagagtctacacaatttttttatcacacctggattttatcatgcattgtgggttgataggcttgcagtcatgctatcacatattgataatcatctttggaataatggggtttagtatgtttaggtagcattctctgcattatgaaagaaatttttgcattggctttctgcatcttacttttcttgtgtcggatctatctatctcccttgccaagaatttggagttcgttaatgcattgatgataggaattcaattttcttaatgtgcaactaaccccttcccctgaaaaaagggtttctttagtactactgcaatgagccttttatgcttatatattgactgctgcaatattatgctctgatgttcttgttattgttgaattgtaatgcaggtggacttacaatgatccacttcgtgcaaagtataatgacaaaatggcagcaatgaacgcacctatagtgaaacctaaaggaagcaggaaattaaaggattgggaatctcgatgaacttgaagttacaaaagtatgcatgaagatatcatcctttcagttattagactttggagaaataccagagtagatatgtccttgtcctatgtatgattgtgttctgtcttaaacagaacgtaaagtagttcatcacggctggagcgtgtatgttgtggaccatggaaggcaattgtgacaggaattcggcgctagtttatctggatattcttccccagttaatgaatcatagctgatttagagtcctgccagcccagcctaatgactatgacttcctttctttgttttgtcatcattttgacttttactggctggctatgaggatttaattgagattgctgcctatgttgatgctttaggagccactgtttttcaatctaagatcatttatatgtgcaacttcgatactgactggaactcccgagacgagagtgacactgaattgatggtgtcaattggtgtactagttcactagtaaatgtagcataaacttccatgtttggataatcttctagctgaacaaaggggcatattgaaagttatttattcaacccgctgcttgtttgtttataggagttttttgacaaattaaatcatatttatattaatccaaaaaatattagagtaatttttttgggctatatataatctaataagttaaatatgaggtccatccagaataattttttaaaagagcaaagttcaagagagaagggcgtattttatcgaatccgcatcataaatcaaagagtgaagggacaaattgaaataaattacactttggtctcttattattttcatttcttaaatctggtttccattttttcttgtcaatttgatcctacaatttaacttgtataatttcatccgttaatctgatatttgctgaagtggatgtgcagaagcgtcacattgatgtttttgctaattattgaatgtcaaattaatagataaattaaaattgcacaattaaaataattaaatgaccaaatttgtgaaaaaagaatgaggggaacaaatttgagaaatcacagcataaaagatccaaaatacatttgagccaaataagataagaagaggaacggaatatatcttccactggcttgaacactttttattcactgagttgcatgaggcaaataaataataaaaaaattggaaaataatatttaggtaaaaatataaatacatttttatcactcattttttacatcaaattttctcaagagagtgcgttgactgctgttgttgctgcgagtttgttcatgtgtctttctggaaaaggtgagttgctgaattattcatatatgtttagattcgttatattcgagcaccacttatcattatggtacatgctgcgtatggcttctgtaacatgtttcaatgttctgttagttatcagattcttgacaattactgaatcattttcgcattttatttgtaattaaaagcttcatattctattcacttatcatatatatatatatatatatattccacatattttttttaaggagtgtatattgcaattgatgggtgatgtctacgtttataacattacaaagtctattccgtatggcattgtagcttatggttgtcttataagcattaccccccccccccccccccccccctccccgaagtagaagaaaaatcaaattccatctagcataatggaacaaagaaagagttgggagataaaaagaaaaaagattattgatacaatcacagcagttgatctttcgctattgcacttaatattcacttattcagaattgattacctacggtcacagaataagaattcttcattcacagtattagttattagagaaccttttggaaattttcatataatttcaaattcaaaagtaaattcccatcaaatttaatggacaacttaaagattatgtgaacaggcatgattcatgaacaaccttaaaccttaaagatgtttgcatgaagatgcaatcaagagtcagacctacaacgataatacttagagcagcctctattttgaggatttgagggtggaggaagacaccctccagttttactataagcttcaccagagccaccaccattacaaactggtttatctctctgtaaagctccattggaaatgtatgatctcttctgctccaaaaaccttcggcttatttcggactccatcaacagctcatcttcttgattgcattcagctatggaaccattgcatgtgcttgcatgacttatcaatgagagcacagtgcagctgctgaaatgcataaagctgaagagcatgaagtagcagaaacaaagaagtctaacggtggatgattttgaggccattcttctgttgtctcttggatgtactcttccctccactctcccactaataagcactatatagataatattagatcatatgacaccacctttttgaaaaggtgcaagttgcattagtgataagctgttggagcgcacttcaccaaaccttttgttttggacaacatggaaattatgttatttgccatgtgctacagatgtttttctttctttcttttctgtgaagactattgatttactctgctaataagtgattgcatatgtatgagataactgagttgctctcggaagataaaattctaatatgtcccaagtattctgtatactataaatagactaattaaaaattccataccaaataatagtaccccaaaatgaaaaaatatttatagaaaacatgtggttggttttgtggcatttgaatatgatgatatttttttggttcctagttttgttccctgggtaaaatctattcataagaaaaaatttgcaaaagggaagccaaaataatgagataaggtgatatttgatttgagtgtttattttttagttttattttttcaaaatatttttttttcaaatttaccagatttagaaaatatgtatttgaaaaaaaaatactttaaagtgtcatcacattttcacttttttaaaagagactaaaaatattaatttgttgttttcagttttggattatttttaaaaatatttttagaaaaaatattttctaaattttaaacaaatatattttcacttattttttattttctttaaaaataaaaacaaaaaacactcaaatcaatcaattgccaccttaagtttcttatttgaaaatccttacacacatttaagaaagtataaatgaacaaatgtggagttaggtaaataggattataggaagggtgttatcatgacaaaagaaaaaggagagaacagaagctaaggtgtgtgttgatataatcatacatctaaaatatttggtacatattcctcgaagttgccccacctaaactctcagtcttctatcagacaatggacctcaacatacaattgtggtggggtccctatgggctatggatttcgggatttcctttgactctaataaaacgaggacaatgactttgagttcctttcacaccaatctcaaattattgcactcatggaaattgtaaagccaaggatggttccaagcatttacttaatttcttcctctattattttagtttaattacacaaagtggcacacactgcacaggtttgaatcttcacaccttgcatagcattcttggaagcatttcctatcaatagtatgaactagtttgtttcaaactgatactgtgtttggataagtactcctatttaatatcaagacaaatacaggcttcaatagttgcaagcaatttggacctggcaataattttttttcatatatttaacatgataaaaacaaaatgggggtagtgaagttttttttttttgcacgtaggacacaacaatttttgtttatggacccagtttgtatgcatttatcaggttcaaatgatcagagtttttttgtacagtgggccaaaggggtttgatgttggattcactacacttcataaaatagatgtagactatcgagttcacaaaataaatattacgaatatatgcaaaaattactccatgccacacaattgtgggacaacaaaagtagatacatgccataacaatttttcttagcttcaaagaaagatattgaacttcatgtcattatacagtttattatttgatcctgtattattgtcttgtgtttacaaagcagaagccaaaacaacacgcatggccaagaaagcactcatcatagtatatgatttccttattcttcccattggacggactgaagacttcaatttctgctgttgcctatcctggagcatcctctgttgtaaggatttgatgctggcggtaagcagtttttgctacatggtgctatgttgcgcttggtaacttccataataatgtacttgtttgcatttttagcatgattttaagactccatttcaacccttcacataagcttactgcttcattcctcacaaatcattacattttctggtactgattttggagttaagtctgtccatttatagtgctaaaacttgaaaaatgagaaatgagaaccattggtggtggtcacggaataaggcataaggaataggttcaccttcaactaatttttgcacagaacttttctctagaaactagaaagttgattctataataatgttgttcaatctcatttattttaactttggcgtttaagtgatggtattgttgacataactgttataagcttatagatgattccacttattagcaaacagaggttcttttcaaaagtcaatccaaatgagccagtcattttcaaaataggtggagtcctaattagaatgaatcattacagtctacaaaaacacataaatgaccaaggcgccctacaagttaccatctgacaatcacaattcacaacgaaatgatttggttgggttgtgatttcaaatgcattcaaatgggaacaagcaacgtagaaggtgcagcacattcatgatttgaatgaaaatcatagaatcccaagtaaggccattaatctagaatattactctaatagatttactcgatcaggagacccaagttttggaggtgagcaagatttattttacagagaattctgtttaggaagatgtaaatgagaaagtactgaaaactacatgaaaatataactttattacaatgcaagcatcatacatatgcaactattatttatttataacattagcccacctctattcattcttggactaaggaatttattcacatggatattgcttgtagcctggcctcaagtggcatagctatcacatccatatatctgaagtgcagtcaccaccaggatatctcatctcatgtgcaaggcagggaccttgaggctcagctccaaagtcaacaaagaagttagggttaattttcagacctccattttcagtatcaatatcaatctgtaacatgtgggatcctttctctacaagctctggataaaattgtttatcccatgcactgaagagtgagtttgtaacatatagccgcttaccatccgaactcaacagaatcatctgagggccagctctcaacttatttccctgaaaattacaatttttgatctcttcaccttagaccacaaaaaggtcaaaattataagtgtaattatttaccacgtttaagcatcacataagataaaatacaaaagtgaccaaaaatttaaggcaccaatgtaatgcacgtctattatatctactacatctaagaaccaatcaactccaaacatgtgagatgcaagaagcataacactagaatcactaattcaaaagttaaactgcactaaccaggatgtctggaacatcagattgccaagtattaccatcttcagttatagctactatagggctttctttctgaagtagtcccccaacccatacttggccagtcagtacaggatttttagggccctcaatgttatattgtcttatatcaccatgaagccaattcacaaagtacagaaaccgatcattgagagatatcagaaaatcagttataagcccaggcatttctggaagaatccagttttgcactttcaatggtttcactgatattgcaacctgcaaagtcagtctagtctgtaagtattattgatcattatgcgttggttgaagctgcacaaacactaaccacacgactatacaaaatcagtatggatatctatgaatagagtagattatgaagaaaattatatagtctctattatttcatatgagcaccgatacaatatatagaaaaaatgaagaaaaaaaaaggaaatgataaataggatatttcaagaactaggaatcccaaaattacaggaatgaaataaaaatagaatagctgaatgtaaaccttccgattaatgagatgttgtgattctcctataatttagggattaattttttactatatactttttatgtgcctcatgactccatgattcatcctcagtcttgaaaaagcgtaccatgttacttgacaatgcacacccaacgaaacctgtatctttagaaggatcatgcagaaaccttacctgcatttaggacaagttgcttacaaattatctcacctttcacataatacttcacaagaacaagctagagagaaaaaatgtagcaaaggacaaacatatttatgattaaatcacaagtacattaacataatagcttcaattacagcaaaaaaaaaaaaaaaaaaaaaaaacataaagtgcattataactggtggaaataattccagatttatatattaaacaatgtacctcccagggtagaagccctgactcaccaaggtccaatgtttgtctcagttcaccccagtccagctgtatacatgtagatgcctcccataaagaccatcagagacatgctgtaaattaaaacccaagacgtgacacaaattccaatccgtaaaaaattaacacaccacatttgaattacaaattccaatccgtaaaatatagatttattatatagtatgtcgactgcctcgaagaaatactaattacgttaattatactaagattcaagtccagtaactcagtcgaatgtgaaacttcactaattcagagctttagaaaacctccaatttgtttaccacatagagtagtttcaaacattttctcaaatcaattgtatccacattggaataaaatcatcttttattttacttgtctctttttcactctcttcaattgaaaaatacacgtcgactaagaaaaaatagcagaagaaaaaaatattcttacttaaaagtgatatttacgcactaatatattattttttaattactgaaactgaaaataaaacaagtaaagaagacaaatgttttgaatcaatctatatgatactatgcaaattttaggagttcatttcagtactccctccaaagaagagagactcttacctttttttttttctttcttttggaatttaacattaattttataaattcagtaccccctccagagaagagagtctctaggcaccacaattaagtaggattgcaaactggacctagagaatattgtggtgttcatggattgtcgaccctccctctccattaaaaggattaatgtttgttgatgttacaggaccttccaatatcctacttctatggttgaatggtcgatttggtccaaaaaagtgtacagcagtttcaagttagtccttgaattcaaataaattgaaataaagcccttgaagatagcttgtcttttacatttgtcctttcaggactaaattgcattttaatgataacatgtaaatgcaaagacctatttgaaacgaaggatgaatgtgagagaggaaagctactttcgaagactttatttttagtttattaacatactaacttgaagccgtcatatacttttaagaaccaaattgactattctgcctacttctgattgaattcttagttttttggggcgttagcctttttttatctaaaaaaacttaaaagttaacgcatgatgttttttattttttattttcaaacggaaaatgcattttatcactttcaaaataaaaggcaaacattttcagttacaagcaatttaacttcaattttagtaaacaatcatcttagttcgagccaaattttctaaatacatcaacgtcaatgtattgttgagaacagtatcttccattctgtaagataacagaaaagaaaagaaaaaaaattgccaaccaaggattaggactttaaggtcactgtcttaatatacggtcaatgatctcttgtgtttgatgatgccattggcattcaataggttacatgtatagattgtctatttgctccctgtattgagccacaactctatcttttcgaattttcatgatgggtgtcattagaccattatcaatctgtcattggagaaaaggatttaccaaatatgtcagttttgtgatgtgaacaacatacaagatactactgctttgaattccaaatctaaccttgaagggttcatttacaagaaggattggtccaatttgaaatggagattctgatgtcctgcatgatgaatagttcaattatagaatacatttaatttgtttatcattcagtgactccaccataacagtgtccaaaactagtttactccctttaattgtcataaaatttaagtaaagctaattaaccaatagagtcaaacactgtccttcccccagaaacagaaaaacactagcacaccagagatatctgaacaaggcataaacttttttccggcattcattacaagaaacagaaatgaaataagtcttaccaggtcttcaattctttatatatcaggctcgtcactttttccttactgacatctgaactgttggaatctataattgacaacttccttgctaccttcaaaacttcttctttgttaggaacgattacagttcctagacgtcgcttatcctgtaagttacagttattaccaagaagtataatcactacattttgtactatctgaagtacattttatatataatgcttgagctagctatcagaaattgaaagaattcaagaattcacctggccaacaacaacaatttgttgaattatgctactcctcattgcagcttcttcaatttccaccggttcaacattttcaccttctcttattataacaagtggttaatactcaaggaacttctatgatttccaaaggtgagatcaaaccagcgtaaaaacaaggttgagcaaaactcaacaacttaataaacaaattcaagaacaggatcttgtcttactcgttcgtgttttaagaacaacttgtttgttactcatttataatattgtttatgattcattattgcatgtaacacatgttgaacaccgtagaattgtactttacatagtacgtgcaaatgcaatacaattatacaaagatacatatatacaatgtatacatacattaaaatgaaaatttgagacatattatgggttgggaaggagggataaatataggagatttacacttgtagtcatataagtgaattggacaccacatcttgacccaaaaccttaaagctcaaccttatgagtcttctactcacttatatagtgttaaatttttctatttctatccgaagtgagactttaactcagacttatactctaacatttatgaagtaaaatcaattgatacccttcacaatgtgctaaaaaactaattttattgaacattaaaaaagatatttaaaaagaaaaacgtggcaagtaggtggcgagggccagatgttttaagaatttttttattagtgtaaattataaagaacttttcttcaaataatagtagtatagggagctttcaaatttaacttgttcaggtaaacaccaggttccttttattggcagtgtcctttgtttcacatctctaatggatgaaaaatatagaaaacgtgcatacaccgacagatagatatacaaattttaagattccatgctaaacagattacattgaactcaatattctactatacctgttgtagatgtcgaagagaagtaaattctccaactgttagttactaaacgcagctttgtttggtggtacgtgggtggtaacgaccataaattggaccaatcattagaagatactatcacttgtgttaatctttgttagtatatatttaacatttgattattttattattaaaccatgcaatcatatgttactttagaaatctatatttaatcacataaaatgacaaatggggtaaatataagtatacaaataaatttaaaatttatagtcattgagtattatttaaagtatgattttgaattatttataactgaaatatccgtgataacttttttttattttaatttattttgttatgaatatgtagattttaatttaaagcttataaaattctcacaatggctataattccccatcagccccgaaacaaaagggaaaaaaaattgtagttgccttttatggactctggttttgttcagaagcatgagtcaaactgatcacagtatttgggaaggttgtagggaaaggtaatgttatgttcaaaattttgagtaaactattattttagtctttaaaatatgagacatcgttataatagttcataaaattttaaaaatattaaataaatcattcaaattaaaattattgtcattttaattaatctacgatatgtacaacttagtattattattataattcctaaattttatattctcctatcattatagtccatacttccataacaatgtcctaaaatttcaagaactaaaattgtaatttattcttaaaattttgcaagataagcttgtgggaaatgtttttattaaaaccaagtggtagttttttttccttctacgctttattctccctacaaatgtctaatttttgctacttttcatttcaactagtttgtggtgtgtgttttttttcagccccaaaccaagacgaatttattaaaagccatgatcaaagattcaaagagaacaatagcatcatcttccaacaaaggaatcgaaacaaaagcaggagtagagacaagaacacggtgaagttaaattgaaaatactataacataaaaactgaaaaaaaaaacatttatctgtaaataaatacaagttgtctctttggaaaaaaaaatgcaagtcattaaggtaaactacaataacaacactattaacattagcgtaacgtttgctaggagaagaatttttttcatattcaagaatgaataatatttgattgatattcaatatttttgtggatatttaaataagtttactgagaatcaaataattatgtaatgtttttatcaattactttaattatttacaataataaataatctaataaaagcaatattatatttttacactattcagagaaaattttaactcaagaaaataagattttcatagaaaactaactaacattttttggaaaatttctcccctactaaacactcataagggattagtcaagtaaaaatataaaattaatttaatggttgaaaatggagttttaagggtgaagggagaaaaaaaaggtacatttttaacaaaagtaacatttgctaataaaaaaatattaataaagtgaaataagatgaagctttgcttatgataggtagggatgaaaatggatataagtggtctttgacttgacctagtttgtttattataaaagctaaattaagattttttgaaaagtttgtttaaataaaaatgtcagacttaaactttaaaaaaagtctgttaaacctattaaactgacctatttataagacaatataattcaagggacccttgcattgctctttctctctatccgcattacttgtggttaggggtgggaaaagtctttttaattaaaaaggtcaagctataggttttatataagagaaacatatctattatgttattttttatttttaattatttatttttatttaatcaaaatttaaatttgtatacaagttttcaggtcagattagatctttatacaaactagattcagatcttaataacttatttttatcatgtaataagttagtcttaaacttaataatagtaatgcgagtcagactcatacctgtcaaagtctgacctgacctattttcacccctaatgatacgttacatgttcaaattttcaattgtttctttcaaatgagataaatataagttttttcaaatattctgataacttgaaaatttgttatgccatgaattatggttcattctaataacaatttaaacaatttagcccataataaaatagtgacatattaatatatcgtacttttttactttcgaaaattaaattcaaaagttcattaactgatttgatagtattactgtattacacagttttagggactatttaggctgtgtagatatgattcctctcaggtgagggactaaatagcaaatgtaagtgatttttacctagacctattaaaaatagtaaaacgccaccaggaaagtagtctcgccgccgcattgcatccctaggggcacgacaatagtaatcattgattgtagtttataaagatacacacgtgctttcattttatttccgtagcattttactctgcagcagcagccaccacccatggcgtcgttttctgccgccgtcgctcagttctcccgtgtttcacccactcacactctgctccactctcactctcacgataggctcttccattctccatgccgcccccctttcttcctctcgcgcccttcccattcactccggtacgttcctatcgactactaggtttcgcatatcaacgtcgtttcctcgatccttttcgcatttggttttagatcaaattacaccaatgcttttgtagctccatgtctcggattttctaactttgaccacacatacaacagctagtcactcgctattgtgttttacttgaacattccttattggatgatgcgactttactatttttaattcttttttgtttttgctcttaaaagaaaaagaataagcagagaagagagagcgaatctcagttatgaaacgtgatgtttgattattaagtttatcagctgaatgaggaatttgagggtatattccctcagtttgaataataagattataagagcaaattaacaaaagttataaacatcgtttgtttggcagatacgttctaaataagcttttaagtgattggttactccacacacagtatattctctactctccttttttttttttgtttatttatcctttgcagagcataaactgttttctcggaattttggcagtatatacgtgtttaaatgatattctccccatgaaattaattggatttttgtgttttgctatatactgattctcaggaagggtcttactttaccacgaggaagggaggcaccaagtacgacagtacgttcttcatttacaggttgcgacttacttttatgatagaacatgtcctttttgttttgaaatagacaaatatagtaacttatgtttttttctttatttgctagcagatgtttcacggagtgtgtccttggaggaaaaacaactacccaaaggagaaacttggtctgttcacaaatttggtggaacctgtgtaggaacctctcaaagaataaaaaatgttgctgacataattcttaaggatgattcggagaggaaattggtggttgtctctgcaatgtcaaaggtgacagatatgatgtatgaccttatccacaaggctcaatcacgtgatgagtcttatatagctgcattggatgctgttttggagaagcacagtgcaactgcacatgacatacttgatggagataatcttgctagtttcttgtctaaattgcatcatgatattagtaaccttaaggcaatgcttcgtgcaatatacataggttataagctcatcaactctctctttctctttgatactctgttctgttttctcttgttcagttatatctatttcttttataaatcctcttttgaacctaggatgtatcttcatgttgtccttgtttattataagtcggtatttatggctttcactttctggtgttgttttcacattgtaatagtattgatgttgatgtatattgcactagctatgtcttggttgctattttatattattgatcattgcttatgtcttggacactagtatgacaataataataatgtatggtactttttggtcattaatatcacatgacagattagatgtatttcatggaaaatactattagtcacatgatctgtacttctgtagtatacatgtattgatcgtatgacctgtagtatatatgctactggttagatgacctgtagtacacatgcaattagtcacatcacctgtattatgcatgtttcttcatgtgtcaaaaatcaaagtatatataaatgttcaccagctttgactttattttgtttggggttcaacatagatcttaacagaaactagtcactgcactatgcatcctcgttcagttaagatctttacaccaatcaagttttatttggttggtgaccaagagatatatacaagggagataaggagtgaaaatagtaaagttaaatttgctgaccacgttgtttccttggaaccatttatcagggttggaacacaagtttgaaatgggggcagagaggagttggcagctgaatgtgtttcttgagtaaattctagagttgaagataacccttagattaccaccatggtgcttttttgtcctgcatgcaatggtagtataagacctaaagtgacttgcgaaaaggattggtgtaataattacttgaagaattagagttgaaactgtgttcttatcaggaattagatgattcaataagatattagtttcattaaacttcatttatagtaagatttacgataaggacatcccttgtatccatatatttgcaatcagtcccgttctgtagaatcatggaaagaatttaattctaaacttaagctttgaagacaaactttggaataaaatggttttcacttgagtaggagcagaaaggaatatatatgcattgcaatttttgcaacaaaaggaaaatgatttagaagtgaaaattgtagaaatatcttaccacacatttctaagtttaagcatataggatcaatattacagaatgatgaggaagttaatgaacaagtcacacgcaagatataagctgggtggttaagattgagaaaggcttctgttgtagactgccttggcttaaatccaaattaagtcaaacaattccagtctcttctcttagtctatgctcaatcaccttttcccataatttcatagtgtgatctctgtaaacaccttttccacaacaaaaagtgatatttagttttccataaatattattgcttaaaatgaatttgggttaaggaattgcattttaagcctgactaacatttttaatatcttgcagctggtcatgcaacagagtcctttacagattttgttgtgggacatggagaattatggtctgctcagatgttgtctctagttattacgaaggtatggtgtgctgttttatttagaaagatatgctttttccccctttatatgaatttagctcattgcatcatgcttctgttccggttctacagaatggggctgattgcaaatggatggatacaagggatgtccttatagtaaatcctacaggttctaatcaagttgatcctaactatttggaatctgagcaaagacttgaaaaatggtactctttgaatccatgtaaggtaatcattgctactggattcattgcaagcacacctcaaaacattcctaccacactgaagagagatggaagtgacttctcagcagcaattatgggtgctctatttaaggctcgtcaggtcacaatttggacagatgttgatggtgtgtatagtgcagatcctagaaaaggtttgttatgctttgtactttgtgtctgagttaaacattgagtggactggatcatgagaattggtttttagtaaccagatggagttctagctctgacatattgatgatgcttttgtcttgtgtttgacttccgtaacatgaagttttgattaaatataaacaattatattttctgcagttagtgaggctgtgattttgaagacactgtcttatcaagaggcatgggaaatggtgagttagatgctggaaagcctcaatgctccttctgctcataaaaataaaggagattaacttccaaattgtctgttgtacagtcttattttggtgcaaatgtcttgcatccccgcacaattattcctgtgatgcgatatggcatacccattatgataaggaacattttcaacctttctgctcctggaacaaagatctgccatccttctgttaatgatcatgaagatatgcagaacctgcaaaattttgtcaaaggatttgcaaccatagacaacttggcacttataaatgttgaggggtgagtcatgaattgcagctgtgttacattatgaatagttggcattttttgctgcatgaggatttgtatttaatttaaggttttctttaaccaatattaattgtccaagttgtagattccaatgaatttttctctgatgcttttttgcagaactggaatggctggtgttccaggtactgccagtgctatttttggtgcagtaaaagatgtcggagctaatgttatcatgatatctcaggtgcacttataacttttttcaattttctagttgttcacgttgtaagaaatggcattaatcagtaacagtatttgtgtaggctagtagtgagcattctgtatgctttgctgtgcccgagaaagaggtaaaagcagttgctgaggcattgcaatctagatttcgtcaagctttggataatgggcgtctttctcaggtgctaaatccaattcttctaaaaccaaatgcatgtttctgttcaattgttaagatttgactcacttgagtgatatcagactgaagatttatcattccacattttgtggatttaaaactggatgaaacatttgagtgccatgcatggttttaaattgctgttgcgatgtggttgtcatgagtcaaaaaacttttatgttgcggctgcaattgtggtagcagaccgcaatttaaaaccatggtgccatgctcttaatttttttaagtgttgtattatcttttctatgtaatttgtcttcattgcgtaagtgttttaattttcatcttaatattaattaacaacaagggcatattagggttaaaataaatatgcaagctacagtccactcattatgatctagaacagtggaagcaaacatcattgatgcagatatcaacagttgggactaagactattatttttggcactagattgatataaaaatcaaggattactataaaatgtcaagcaaaaggatccattgggaacttctttaaagtgccaaagatgaaggctgaaggacatcaaataacactaaggcttgagccttgagtcttccaggaacaatagatcattatgcccgtagaagccatggttgaattgcattgagttatctttgctcgcttatcacaaaaagtttgggtgttacctttgaatttgttcaccaattgttgtatttgatgcttggatgtaaggatgttcataatataattcaataaaatactaactagggatttgctactttttgctctgaaaatatggcaataacgtatttgatacatcaacatcaacaacacctttaacccaagttaattgggatcggtggtagatgaacccaatgataaatcagaaataagacaaagaacgcgaaagggagaggggaagaaaaagtagaaaaaagacaaaagagaggaaaaataaactaaaataaaagaggagtgaaaggaggaggaaagaagagaaaaagaactaaaaaaggaaatgactggaacatagaactactaatgggtttaagtttgataatcaaaaggaaatgcagtctcttggaatatactcttgtcctcttcctcacaagatagttggatgtgaaagttgtgttaaatggaatgcttcttcttcgtcttctttttccccatcagtttgtgcttatttcttttgtttgttaactatcatgaagtagaaacttgagaaccgagtaatttcatttcttctgtttaaattagtatatgtgactgatgatgttaaaatttaaagcttgctatttaattacctttattgcattaaaaaaagttatgtataatctctcaggttgcagtcattccaaattgtagcattctggctgctgttggccagaaaatggcaagcactcctggtgttagtgcctcccttttcaatgcattggctaaggttaggaaattatgtttaagatattgcttaggttagaaatttttgcttatttgttatatattttcgcttgttttacgttccagtttgttttcataaacaggccaatataaatgtccgtgctatagcgcaaggttgttctgagtacaatattactgttgttgttaagcgagaggattgtataaaggctttacgagctgtccattccagattttatctctcaagaaccagcatagcaatgggcattattggacctggattaattgggagcacactacttgaccagctaaggatcaggtgcagtttctgtagacgattttgtatgcatgaatagtttttttggttttaccttgtttatgttttggtgtgtaatttggcttttattatccttgctgtgaaattgactatttttttcaaatttaaaattccacttcaaggaaataatgcctataattgaagaataatgtttattttaaatagcaggtaattttctttatgttgacgctgcaccagttgtaactgttttacggattaaaatacattttcaaaagaatttatttgtttgtcaatgtaagtaaaaaaggtgccaccacattagaaatgtgacattctactgtagtgtttatatacaagactttggggtctccaactacaatgactagtttttgttgtatggttcttccaaggttcttatctaattgatatcagatatttccactgtgtttctcaactacaaatgagtgacatgtgtgttgatgctggcattgtagtttttgctagggactagttaaaggttattgcgcagcctgcccatgtgggcacggggctgggaagcaagatggaatgttaggatccaattgcaaggtatgagacttgagtctcatatttgaagtttaggatgtataagactgttgactctccaaactacaatgactcgcttttgtggtgtaaatctcccaaggttcttatcattatacaagatagagaaaattcagatgattgctttcaaaacaagtaattgaaagaaaaagaatgagaaattgtaaactaggacttaaatagtaaagcacggttagaattggcttaactgaagtttagttagtcttcttaatggctgtagacagctgaaattcctattgtaagcttgcagaacaaggtagctctagtatataaacttatcttcaatcagatagtaataagtgattcattaatcaataacagaaaatagattcagactctctctatctctagaattttattaaatattaataggtttcttatatggggtatttacttgtctaactctaacattgttatgcataaaaactataaaaaaaaaactacgtacttcattgtccagaggctccctcactatgcgaaggtaaggggggggggatattgtacgcagctttacccttgcatatgcaaagagactgtttctggattcgaacctatgaccaataagtcaccaaggcacaactttccggattctaacattgttatgcatctgggagatattttttttatagagatttgatacctgtcaagctttttacatttctgtgttaaaatatgttcctggtatactatagtggggtaacttcattttatcatgttaacatactataattgaaatatgtggcaaattcacatgacaattcttttaatgcaggcctcaaccctgaaagaagaattcaacattgatttgcgtgtaatgggcatacttggttcaaagtcgatgcttcttagtgatgtgtaagttgaaccactctgactgaaatatgtctttgaatgataattaaatttcttgcttgtataactaagaggccttttatgtgagaaagcagacttcattttacacttcactccttttactgttttggaaagctttattgtttattatatatcatttatgtattgttatttggatgaaagaagattattatatttttaagtaagccataataacatgattaggtctcctagatagaatggactcaaaatgtaggcaatacctgattgcttttggggagccatgtttcttgatatggatggtttttggacttcctactttggtttgacaactctctcttgctaacaattatgaagttaatctgttggcaagaggaattcattggttaatacagtggtcctggagctacatcaacaaaattcatcctatgatttgttggttatatgtgcattcttgaagttggtttttgttcaatcattatatactattattgctccttgcaggggcattgacttagctagatggagagaacttcgagaggaaagaggagaagtggctaatatagaaaaatttgttcaacatgtacatggaaatcattttataccaaacacaacattagtggactgcacagctgactctgtcattgctggctattactatgactggttgcgcaaaggaatacatgtagtcactccaaataagaaggcaaattcaggaccacttgatcaggtaaagtaatccatattgttcttttgatgtataacatgtttgtgtttgttgttgacgtatctcatgtaatcaatgctataagatattttttctgcaagtactcggctgaaaatggaaatttccagacattaatttggattaatttattttctaatttttatttgtttttttttataaattaaagaataattcatttaaaggaaagggaaatacacatcatcacattatcaatattagggagtttggataggaagcttttactcttatttctatcatttacttcatacctctatccactggcagctgtctattttttccttttttcttttttaaaatcaaaatatcatcatgtgagtttctgtgtcatttttgcagctatcatatttgctagtaccagagtaattgtaattttattgtccagcagttatatggctgtcactaacctgtagttagctgcgtcagactcagcatagtattcagtttggctaaatttcaaagtgataagctggttattgaagtgcaagctaaagttcactatacaagactatggagccaacaaaattaatgattcaatgcatcatttcagttttaaacaattttctcactcttttctctgtttctctctctaaacccaggttcactggactctgttgactagtggtaccattgttctaacaggaatgatttataagtataagcttgttacatttaaatgttgatgtcaaccagtctgcaacttgttctcttgtcattccattttatttagcaatttggaaatttattgctttatacaccaagtgatgtttcatagtttagttattaacatctacgatcaaatttcatggttagcataaactggaacgctgaacaacagtaggcattggcttgggttcatgcttttctgatagaacaagtactttgaacttgaagacatgttttaataatatttttcataattttgaaagtgttttctttaagcttcagcagttgttgcttcttagtactcatgctagctttttcacatctatgctctctttatccagtatttgaagttaagagctcttcaaaggcaatcctatacacattacttctatgaagcaactgttggagctggtcttccaattgttagcactttacgtggcctccttgaaactggagacaaaatactgcaaattgaaggcatctttaggtttgctttgatgtgttatttctctttttttttggattgacactgtcaattctcagatcttgcattcagtctcctttgtccaccctcttgcaattttcccattctaaagccaaaaaaaaaaaaaatagaatgttattttgaggattattaatgactatatggcgattattcattaatctcgaccattcaccatgagtattgcctctgaatctgcagtgggactttgagttacatatttaataactttaaagatggccgggcttttagtgaggtagtttctgaagcaaaggaagcaggttatactgagccagatccaagagatgatctgtctggaacagatgttgccagaaaggtacaatttataatatggtatatgtttaccaaattttgttgtcaaatgttaataaagttcctttatgctgcagacatattttgaatttggatttcgtttaggatttatgagtaggctgtaatctaaatgatctaaaagactatatccaaattaaatatttatatgtttgaggctcatttgatcaaacattttgaagcttgaattcggtttcaggctagaatttaaatttgatatacatctacctatccagttatcaagtatttcgattcatgctcaaatttgatatttttaattgttgacatgctgaaagcatttaatgatttaaaaacacaaatcaaaagttgataatattattaatattcctcttttgtgcctatacacaattgaaattaatattatcaatagtcctctttggtgccaatacacaaattttgttgagcaaatatcctaattttaattttaaatgtagaaataaataaatatattggtaagtattttttaatttatttattgtgaaatccatatttagttgaccaccccattctagaaaatgtttggttgttgttgtaactaatcggaaggcttgcttgtttctgcaactaattggatcatgtaggctaatcacaatgtcgatattggttcatgttagcattttgttgcttcatgtaatctgatttaaaatcaacatcctgaagctgctttgactctacaggtgataattcttgctagggagtctggtttaaagctagaactgtctaatattccagttgaaagccttgtgccagaaccactacgagtaagaacctatttctattgattatgcagtttttagttttaatatgtagtattttgattgacatagatgttttgatgattctgtgcaggcttgtgcatcagctcaggagtttatgcaagagctaccaaaatttgatcaggagttcacaaagaaacaagaagatgctgagaatgctggggaagtgagtaaattctaagacagtattaattctatgtgcctttccaaaaaaataagtattaattctatgttaaagtatctaatagaatagttctaccaactgcttcatacatgcataattcatgcatggaatatcttagggtttgttttgtttccatacaaattaaaaaaaaaaaaaaaactgctactttattttcattttcttttatattttcaaagatatgtacaggtaatgttgaaaagggggcattttataatttttagtgataaccgaaaagggaaaaaaaatccttacaaattaggtacccttagtttgttatatatttattttaattctgcatagtacatgacacagaaacatatagtacttatttgagacacagaaggtgggataggaattttctgattagactgatgacataccaaaacgccaaagttttgcatatcaaatcttcaattggttggttaatgaagactctctctccaacctgatggaaggatgcttgttatatatttcaagcaacctagatttccatatagaccttgatttcaagtaaaagtatgacaattgatttatgttgggtttgcggtctccagtttgtgtccttgactatatatataaacgtctatttttcattttttttgatcggcaacgtctatttttcatgatgacatctctcgtatatgtatattatgtccattaaatatacgtatatttttcatgtcctccacatacaactctgagattgttatgtttgcactctgaaggtcttgagatacgtgggagtggtggacgtgactaataaaaaaggagtggtagagctgcgaagatacaagaaggatcatccgtttgcacaattgtctgggtcagataacattattgcatttacaacacgaaggtataaggatcaacctctgatagttcgtgggccaggagctggtgctcaagtcacagctggtggaatatttagtgatattttacgacttgcctcatatcttggtgctccatcataactcacaagtttcattctgcaagcataattttctatgtttggtttcgcatccactgcttcgtgacacattatctgaagcaacgaagagttgcttttatgtccaaaacgtgaattttgatcgaaacgtatgatgtcgattggatatccaaacacatgcaaatttgtatcatctatttatttatcttgattttctttgtaggttatttgctgcttataacgttgtaatgtaggcttgtttctcttatcttttgtctggaagaataataagggaatggaacagaactccattacccttttttgtgagttatattgtaaaggaacggaagtaaacagaattattataattttcaacttcgctaacagcctttttaatctatagtaaaaaaaagactgatgatgatgtgcaagtttaatctatagttgagtatcgtatcctccttttgcacgtagtagatgcttgcacttacaatgtaaaaacaaaagagtaattaatttaatcattaaattattgaaagaatattttaaaataattactaaaatatatttaattaactgtactgtctttataaatctaaattctgtcgctaatcaataattattaatagtttaatactaaactgaaatatgcacaagtttcatatattttgtgcttggttatttagattaagtgcaaatcatggaaagaccatttttattcatggaagttgaactactttttattcttttgcttccgtcactccatcagtatttaaaaataaaaaaaaaattaacaccacattctttgatattcttgtttcatatattcatattagcaccagactctttgacattcttgtttcatttttttttggagcataattgacgcaagtctggttaaatatgtgtttcatttttcatttaatgagtttcattccaaaattagtataatccacataaactttaactaataaaacaaagttgaaaagaattttttttagaggaaagttgaaaagaatattaaaaaatgtagtaccatactttctcctttttgataataatagactgaattataattttgattcccggtttaattttcatattttaaaaaattcccaattcgaatcaaatcctcaattttatataagttttatttaatttattttggtctaattaaattctatatctcatatatttatttaagataccgtcaaaatcagtgtcgttttttggtttctaatatttgacatttgctcttcacagtttgaaatcggtgtcaagtatctatttcatttaaaagcaattgttagttgcaatcaagtaacgtttttaatcttgaaaatgaacagtatattccctgagtgacgagttctctttctccaaagaaatgtgctgcatattctcaccaaagaatatactaagttcatagtatgactccaaacaagaacttaaatattttgttgaccaattaagctcatttctacatatcacatccgcttattattcattcaaactgtatggtcctcacagcaattggggtcctcacaaaatacttgccatctgtccatgttaggctcccaaatttgtaatctccatgaaacttttgagttgacaggaaactgacactaaagttaaggattcgtgcatctgaattgaaactcaaagtttgaggttcaactctaacttttatgccatatggaaccttcactagagctttgtagactgcagtaatatttcccacgtttgtcactgttctcattactgttgcagctctcttcaggtttggaactgatatggaaggaaggttgaggttcagtttttggtgttttcctttcttacaacttgtggtggtcttggtcactttgctaatggatgtactactgtgacccatggaacataggaattgaacataatcctcagtggtgatatcatatatcagtcctggatccagtgctttattggggtccacgtgtccacccccaatatcaaaagggtctgctgccttatgtgtggaaccctcttcagatataaggcttccatcagttccagtttgagatgctacaatttttaagtgtaacaattaattagatacattggatacagactattatatgtaataatgtaaatatgtaattttaatttgttgatttaatgatttctactgactcacctgttgtaaccaaagctgatcttatggctgcaggtgaccaagttgggtgtttggatttgatgagagctgctattcctgccacatggggacatgacattgaagttccagataggaatgcaaatccactactccttgtagtgccttttggtggaaatgcagccaaaatgtccacacctggtgcagctatgtcaggctacctccatgaatcatcccccaaagtagaagttaatgatgacatcatataattaaaaacggagtaagagcaataaatatttatggtaagttgttgactacaatttacagatcatggcacactagataaacattttttaagcacgctcaaatcaaatttgcctttgttgttataataaagtatgaactatatttaattgcttttgtctcaaaatttccgggaaaaaagtttggtctgattgaataaaaacaaaatcatgtctgcaaatgaggtccagatatacctttagcactgttggagacatgctactgggtcctctagatgagaaagatgcaactcgaggtgatgtacattttccaataacagtctttggaaaacttaggcttgctgttggaaaccttccagataagcataatattaattttaactcaatgaacattttataagccaatgttgtcaatctaagtatattagctcaccttgatcttctaatataggttagtatttgtgtccccgcttcataatctaccttgatacatggaaatgaaccacattgattgagtccatcttcatgatattgtgcatatactagtccaactcctccagcttccttcactgtaagtgctgcagaaacaatgtcctgttgatctgatactgaaaagcatagaacaattttgcctgctgccattgttgcatttagacttccagattgacaatccttgcttgaaaggcagacacgaacagtagatataaaatgtacaggaatttgatataaaaaaacagtaaaaatgaaagaaaaaaaaaaagaggtctcacgccaaattatctgatgggtctacagctatgcgttcagaatatgtgagcccaacagatccaagattatgttttccaatatcaatggactgtccctatataacaataatcacaggtttaaatatgtatctaattctcataaatatgatttcaggtgattttaatcctataaaatgagtttaatttttatgcagtatcagtgtaaaaatctgtattgccaaccaatcaaaaattgtttttgatatgatttttgtaaaaatcaacaaacttaacctacataatattttgcgattgaatgacaataatttttacattgtcaatgcattgacacagattattagaaatggtctttgacattactaaggaggtgacatgaaatacgaataatcatgttacattagtgatcaatgtaagataacatgacttttttgcatgtcacgtcaccacttaataatgacaagaacattttaaagaaagttaattaaaaatttgcaagaactaaaattagtggaaattcttgttgaagaaccaaaaccatgtaaagtcttattttttttaaacatacatatataacacatttaagacagttatattaagtgttagcatatttgaccaggttgattcaaaaatagttgtagcatacccacacactgtggttatttccaagggtgatggctgctggaaaggccctatctatggtggtagctccaactgtgatgatccatggtgcagtatttgtaacggtttgagagacaggaccagaatttccagcagaacaaacgactgtgatccccttagaagttgcatgaaaagaaccaattgctaatgaatcacgttgatcaacataggagaacaaaggaatggaaaagccaagagaaacagttaagacatcaactccatcatgtatagccttatcaaaagctttgaggatatcagcatcagtgcaatctccaattggaaagtcccaacaagccttgtagatagctaagtgtgccaacggtgctcctcctctggctaaaccagaagcaagtcccctataatttgcatttcctacaaagtaacctgctgctgtggaagctgtgtgagtgccatggccaatggcatctcttgctgagagatattcatcagtgttgtttccttggaggaatttcttagtctgatcacttattcctttcatgaaccatctagcacctattatcttcttattgcaattggtggagttgaagtgctttcccccttgacaaattcctttccaccttgatgggatttgtcccattgcttcatcattgaaacttggtgactctggccaaatgccttcaagaaatcatatttgtcattggttacattgccactttccaatgccctgcttagttatttttgttaaaaggaaaattaactactagtactacctgtgtctatgacacctatgatggttccttcacctaagttgctgtcagagaaagcagtttttgaagtggaatgatggacccccataaagtcccagcttctggtagtatgaagtttatgaatgccatttggaatgacagaaactaccgcaggaaactctgcattacatggtatataatataacttttgaaatgttctaaactgggttaaataacaagcctaattaatgcaaggatcattcatacttgctattgcttctgcttgatattttgtcaatcttgcagcaaaccctgaaaaaccatgcttatagctgtaaagaatcgaattctttgcagcttctttgcttcagaacaaaaagaaaacacttaaaagttatttttttttcttgactcttattaaagtaatagaatatcagctccattagaaaatgagtatgtgagggacacaggccataccttcctaggagtgatgataacattttgtggtgatacattttagtagtttgtggattttgatatatcttatctcccatgtatacaatgtgcacctagaagcatttatttaataattgattgtgctcaatgacatgtatttacatgtataccaaagcagaactagaaacttaagttgcactcacagagcttgtttcagcagagttgaccagagagtcttgcagtaagagaagagcagaagcaataagcaattgggcctttcttgaccatctccagtttcttgaattagtatccattatcagattatctaataggaggagagtttcaaaggctttccaaatgcataaaaacatacaaagtatgtatgatgcatataatgtaactttttgaaaataagaaaagttgggagtcctttccttttgtgcagtgcactttttaattttttggcccaatcggatgaaaagtatgcacaaatatcttcatcatcagcgagtgttggggaggaatatgtgccagttagtatactgcttttatttttatggctaaagcatactttctcttgtcttatttttgtttgtttcaatttagtctcttaagtttaaaaagtttcacttctgtattttaaatatttatgttagatcaaattggttattttatcagttttgttatacaaattaatgatgttaattatggcctatttgctaaatgtccatatgatgtcttacagttagccaatgtcaaagtttttaaactcctaatccgtctgtctaaaaaaattaaattcctagtccgagttagcactcattgaaggagacaaatctctctcattagtaccctttttttcataagaatcaaatcaaaaccttaaaaagaatcaagctagagtccacttggaataacaggcattggtagtatacttctttaatttgagtgattaaattaagcaatcaagaaaatcacacaaaaaagagttagacattaatgccatagatattaatcacagtttgatctgattgcttatacatctctaatcttttgtttgtaaaattcaactctagctatcaatgctttttcggggtatagtgaaatgatgcagatcataaagtggtgtgtagtaatgtagtccaaaacccatcatcatcccacgattattgaaaccttttctttttctaaactttgagtcccatcttttgcttttaagtcatcaatgggactggactgtagccagtcttttctaatgcaaaaggaaaagggaaaaaaatgcagtttcttgagtgtttttagtgttgtcttccaattaaaattagaattttacctctgtaaaccgaaacttgcattaaatgttaacataaaacatggaatggaactcatattatgattgaaaaataatgtcaaaagccatctaagaaactgcatcttaagttttatacaaagcaaaattgccggagagaaaattctaagcatagcaaatagcaaaaaatagcttgagtaatctcaataaaattggctgatttggatcctgaccatgaaaaataactatatattaaataataaagagaaatacagcttaaaaaatttcgaaccgttggatgaggattgcagggtgctgcagttacttttggaatgcagagatctggtccctatttggaccccccttcaaaagaaaaataaataaagtacacgagtatgacgacattaacttcctataccagcattttttctaatacacccaacatatacaatgcaataccaattttgcccttctcgtaatctaaaagcaatccgtaaaggtttgtatggattcgtaatccataagacgaaacaaagaatccgtaaggttcttacgaattcgcaatccataaagctcttacggattcgcaatccataagacccttttggattcgtaatccgtacaagttaaaattttttaaaatgattttcaaaaatggtccaagtaggtgtcaaacccataacctttaattacgaatccgcactctaaccaactgagctagtggaccattcatgttaaaaactaactaaaattgttatatataacattataaattttaatgtatatttaacacataaatttacataataaaatatattttttaaaattaattgttaaaaaatatatatattataattaaaccatgattttatctaataatatatttttatccaataaaatatatttttaaaaattaattgttataaaaatatattttattggataaaaaatatactattagataaaatcatggtttaattataaaatatattttttgataaaaataaattaaaataaaaatatggcttaattaaaagttatagattttaataaaatattaggttcatatatattaaaaaatttaattttataaaattagatgttcatatacattaaaaatttatatatgtaaaaaatatattattagataaaaattaattatgtaaatttatgtgttaaatatacattaaaatttataatgttatatatagcaatttgaattagtttttaacatgaatggtctagtagctcagttgatcattcatacggattacgaatccgtacgaacctttatagattactttttggatgacaattttgaaatttacggttgcagttttgcatgatctgtgaatggatcggcctttcatttacaaccaaaaaattcagaggataaatttccttctttttctcttttcatgttgtacatctcaaaatggtacatgaataacataattctttattattttctataccgaaatgcaatgcacgacattttccttgaaattggattgcttagaatcagatagcaaatgcaagaagaatctatgccgtttttttcccactttaaaaagttaataaaatactataagcttataaaacttgggtcattggaatgaatgcagaggctgcaatcaaactttaagtcatgtttgcctacacagttcaactttaagtccaataaatgactgtgggagtaaattacaatatgcatcaaacttttatgtgacttacgtaacatcaatcaataccatttatttgttttctactttctcttaattggagtagcccaagcaataatatatatgtaaaaaataaaaagttgcacgagtaatatactcgctgctttggaaattgctcctctttgtgaagaataacacctttctgagctccactttctctatacctttatcaattttcaccaatgtcattttcgcatggaatctttccttccaataatggaataggtgatttacagctggatacaacattttccaatccaactagttactgaaagttcttgcagcaaattctctaatgcataataacttgctaactacaacttcaacaaagagtatttttggaaagagacgaggagagtttataaactagtttgaccaaataccgttagcatatatgatctcatttgattcaattcaaaactaaatattaaaattgtaatatattatttatcttgaaatttattgattattatattttttttatctataaagttctataatattgtgaatttttctttttcaattttattttcacaaattttgctcttccacaatttttttcacggattgatcatatttattatcttataatttatttgtatttatacaaaatttatttgtgataattatttaaatttattttctccttccttaataaagttgttttatttcttctcctcaaagtcgatagacgttaattatcttctttatgatgatttattttgggcgtttcacctctttttctttaaaaaaaaaaaaagaagaagtaatttaagtgtattgatgagtgtcacccctttgtaaaaaaaaggtattaaaatgtattaatgacacgtttgtgacttattgacatcttcctctctcctctctgcttcatcccatcagtgtttttaagaaacatggatttgtaatatttttaatataaaaaaattgaataataataattcctcctcttacttattaaataaagaaagtatttgaatgtttttaaagttttaaaatattaaatatctttatttttatttaatatttttcattaagtattagaaagattttcaagacatttgtattttaaaacttgttcgtaggaacaattgcactgcttaaaaaaatgtcttttaaaaattactttcctactcttgttttggatcttatgatactttcataaataaaacattgttttatctcatacaacatgtaattgataaatgctgatattttatgaaattttttataaaataaatctatttttgaaagtttaacaattttttttaaaaaatactatactgaaaacaaagtttaaaaattatattgaaaacaattttttaaattaaaaaaaaatcaatttaaaacaattaaacactcaagaaatattttttaattagctttgtcagatgccaagaaagaaatagtagaacaaaaatatagctttctcctagtaaaataaaatcatatcaaatatttaaaaaaatcatatttatcaaatctatacaatttcactgtatttaattttttaaagtgagtaatttatgtttctttaccttcagtttcattgttttaaaaattcaatcgttcataaatgcaatatttttcacaccaaatgtaaacgtaaaacatattgttttgcaataattcgtttataaataacaaaacataacatagctatacaattcaagaatcgaagcttgtatttacattttctgaaatggctggttcaaccatcaagattcttagcatagttttgttccttgtctgtcatttctcaaggtaaatgctttcttctattgtatgaaacataatttttttatatattgttgttagtaatttctccatatatcatgatatcaggctatcgtcaatgttctttgaaagatctcactaatttccaacaagaaataaagtgcaaggaaaacaagaatggagtgtgactatcaccaataagtgtccgtgtgttcaaaagaatatgatattaaattgtaaaggatttcaatccgttggatccgaaaagccttcacttttgaaggtcttgcacaatgtttgtcttgttaatggtggtcaaaccatatatggaattcctgtcaaatttagatatgcttcggaccaaccatttccattaaatctcatttcttcggagatttcttgttcttaaatgtagatccaagaagttttctcttacaaaccttgatgccatttactatagcttgatttgtaggcattataaatgcagaataaaacattgattcttgctatatgttgcatttgtttgtcaattcctttttgtcattcttttaattcctgtcattttttttcacttgtattgatggctttagtttgaaatcaataataaggcctctcaaacgaaaaatgaactaagttcattagtcaaaccattgaatcattgctcctaaaaagaaaaagaaaaaataacaattgaatcattgaaaatagataaattacgatcattctaaaattaaaggaaaatttcaaaagttaactattttctattagacttaaatatactcattgtaatttattcgatattttgttttagtctttgtatcttttttataaaaaaattgcccatggaattcagctttgatacacagacacgcgatgaagcagctgaattttttaccctccatcgtactattccttcgttgatatcattagcggttgttaatatatatcaattaacttctgctatgataacaatacactaagtggtgatattaaaagagacacaaaccctattttatatggtggaaacagggaacatagtccacccaataatattgcaattgaaatttggaggatccatggaacctccactgaccaccctaagcacatgacactccacacttgttatgctaacctggtgttcacgttcttataaaaaccagcaggcacaataaaataaaaggtaacgaagtaattatctaacaattgcaattttctttctttatgattttttcgggtcaattctctttcatatataattgaatctcaattatcattaccaattcaattattttcaactgctcaatctgccctatatttttgccaataggtaaaaaaaagcatctagaatgtggtgggcaacttaacatggatacggcatacgtaaccacaataaagaagacagaaatcagtaacacataacatgtgctttgttgcgaaagttatcatccatctactgactgagctttgaatcaccatatgtgcgttcacgtattgtgtaggctctcatcatgtgaaattaaaatcaccacatcacgacccaaattttaagattatatccattttcaaaaaattaaatttattcagtatatcaatgcaattatgtattttcttttaaaaaaatccctttatgtctctttctatcgccaccaattagatgattgttcaagtggtgcttcctcctccacgaaaggtaaggtaagaaggcttgatttctctccttccaaaatggaggtatagaaccttagctagatttaccaacagtgttaaaggatttaaattttgtaacaactatttacttaaagactatctaaccacctcatccccaactcaattgcctaaacaattttgtagatttcgttatcgtacaaagtgttttttttttttttttttaaagtttcgtaactacaacacatcataaattccgggcaggtggtctcattattcatttgaccagagaacatattgctccatttggtaaatcattatttatttgtaaggtatcgagtggaaatgatttatacacacactagaccttataggtggatggagtgttgaaatagatgcataacgggcaaagaagaaagattatgaaacatcaaacatgcgataaatatacttctgattcaaaagggggaaaaaaagaatataatacaattaataaaataataaatgtatagactatagtccttctattcctaaaaaaagtagaaacaaaataatcatgctcacaatcagccggatcaggtaacccaaccaataaccatcctttaaaacccatccgtcggcttaaagaatcaataaagaacgccaaactcagagatccatgtttagttcagatgagtagattttaagaacacaaaagatgacattttgaaaataataaacaattacaaagaaattggtgatgctaatagatcaaagcagctttacaacctctggttttcttgggtattctcaagcaaaccttccactatcatatggactaagatgcccttggatagttgtctcgtttatcaatttggctaccggcaatccattgaatcaaaagagtctgcaaatcctacaggtttagaggggatgcttgattgggtttgtgagatggaaatgtcattaaatattgaggaagtgccttcattggcttggcagctcagccactttatatatgctctccatggtttcctcatcaggattgagaatttgaccaattgcctttggaatgttttccttgttaattagtaccctacggaaccatgtaaccaagtgagacctttcatctggcacagtatcatccaatgcctttctaccggtgataagttccatcaaaactactccacatgcataaacatccactttggttgtcactcttccagtagctggcaagaaacagagtaacattaaatataatcaaacgaatagagtagactagcactaataaaatgcatctaatcacatccaatgcaacattttaggaagttttatgcttgcaaaagtcttgatgctaaatggatcaaaacaagctcaaaattaactagttttaacaaaagatgtgtcaatgcactgagccaccaaggcaatgggatggaaggataaattccacagcagtgattaattgcgacagagaactaccacctaagctcatgacaatatacagcaatccaagatttgatgcaaaccagagtattcatcacatcataaaggataattgggagtcagactctgtaaactgtataaatggctcaaaataacttgaggcatcgaccaccaagaactatgcagaaaacccctacccaactgaaaaaaaacacgtgaaacaggcaaaatataacattgcaaagaaatagccacaaagaattctgaagtagccatgtatctagggatttagtatcaattactttccctttcaactttttcttttttttatgtgtggttactctattgaactacttaaatttgctgaacaccatcgaagtagtaacctacaactataaccaccaaataagtaaaatatgaatttcacaattaaggcacaattgtacagaactaaaatcaaaggctttctatacctgcatactcaggtgcaagatatccaaatattccagccaaccgtgtcccaacagaatgcttcccatctggtgcatttttaaccaacccaaaatcagcaacctttgctctcatgtcattgactagtagtatgtttgagggttttaagtctctatgaatgaagctttgctgagctaaactgtgcaagtattccaccccccgcactacatccaaagctattactaccctttgtttccaagtccaaggtgcatagccatgcccctgccactcaaacaggtgctgtgttaacgtaccttgaggcatatactcatagaccaaaagcctttcaatgccattgatgcaataccctaaaacagcaaccaaatgtctatacctaactttactaagaactgcaatctctgcttcgaactctttcagtcctttgttccccattgcaacagattccatcctcttgacagcaaatttttgttccatcatgcaactgccccttataaactactccaaacccttccctgcctaaaatgttctcctcgcagaaattattcgtcacttgtcgaagaacttggtttgaaaacgttggaccatctaaagcatgaaggtcactgcgatcaccactgctctggctttgcaactcactgggaacaccaccatatccattagaaacatggacagcatcaggtttaaaacttcctttcccattttcacgaccattaaccctactgaacttcccctgtcgcctgttgacaaaacacttccaagacaaacagcaccactgcaataaaaaacaacacaataacaactacaccagcaatccaacccagcgacaacgaagaactaccctttgcggattcacagccacttccaccagtcgaagaccctgaaggagtagttccatttggtccacctccaggactaagagctttcgcaagcaaagcatttcccagagtcaccaacttcacctttggcgggaacttgggaaccaatccagagaggttgctatcagacaaatcaagagtctgaagctgagacaaagtagtttgattcatttttcaaaaattataattaaataaaataatattaaggagtatacaaaattaaataaagatataactataaagaaaaaattttatatttaaacttaaaataatactacctcttaaaacaataataagttaactgttctaaataataaagtattttaaacttagaattaattcattgaaaatgataggaaaaaaaaagaaaagaagcagaaaaacaaaataaaaaagagacagatggacaggaaaaatcacagcacagagtcctttaaccacgtaaactgtgatggtctcgtgggcaaagaaaagaagcagatcgaaaaacaacaacaaagaacagcattaattaataatttagcatgaactgcaaaactggtcagaagacgggaatccaacaaaattatttggcaaagaagtgcattaattatcgattctgcaacgccatgccatcaagaaacgccttcagattcctctctgaaggaccaccttccttcgctgcctcccttgccaaacccttccatttctctgcattccttctcaactctccactccccatcacctcttccaaacacttccttatttcttccttttctactatgccatcctcatgatccaccctcactcctatcttccacacatcttctatcagtttcgcgtttgtcttttggtccgaccactgaggaaacgccaccatgggcacccccgaaaccaagctttccatggtcgaattccaaccacagtgcgtcacaaaacaacccacggaaccatgcgacagaacctccacttgagaacaccacttcaccaacttccccttcccttccaattcctgtctaaaacacacctcctcctcttccttctcttcctctttcactctaatcacccacaagaacggaaaaccacaacctaacaacgcacctgcaatttcctcagtttgtctcttagacaactcaaagtagctcccaaatgaaacgtaaaccacagacttcttttcctttgagtcaagccactcaacataaccatctgagacttgtaacaagtcaccaccaaaggaagtatcttcagggtccttcccatccaagaacgcagaaggaatcaacggcccgatggggatcatgttgagcttatcaacggccctcaacgcttcttcttccaaagcttcaaaagtatttaccagcaccttagggttagcttccaggtcaagctgtttgatctgctcttcaaacaagggaaagacgaacgacaacaaactcggtttcgactttagtaaaaacgatggcatgtcacggggtgaaagcgaaaacgacaatcccggaagcactattttctctttggtttcgtcgttgatgtaatcagcgtagccgtgaaagtagtggtaaaggatatccagcaccgtggcgggttcgatccagtacatagctgttgggaggttgagtccacgcgccacctgtggggcccacggaacgagtaaggtgtagagtaagcaagtgaaagggtggcccccgttggcgctggagagtatgaggttggacacgaacaccgaggcacggcgcttgagttccgaggcgtagaggttgtaatcggagtcggtgccgcggatggcgtggaagccgtcgtcgtagccgtcggagaagggggcgagggagaggccggggacggtggttgtgttggtcatgcggcggtgcatgtggagagtgatgggaatagtgacacgtgcacccatggcagtgagtcgcttcgcaaactgaaaagcggggtttatttggccttgtccggggtagattacgaggaggaagcggtggtggagcatggtggcgctggaactggctagttaccctcttttgctgtgaattcacacttagacaaaaatctttttttcattcatatacagcctcattgaccaatttaatgtgctacaataataatatatatgtttttagttattttttctattgttgaggagttgggtattataggcattatcattataatgcttctggaatttttctttaaatcagtattttttttatggtcagttatatgctgtggtgaagaaaatgaatatagttttattttacaggaaaatgaatcaagatttttttagaataaaaatgaatggagtttaattgctagaagaaaatgttccaaaacatataaaatgcacttatttcatacgtatatggacatccaatgtgaatgcttgtatgtttgactacataagaaaaatgtgaaattcttcgtcatgtcgtttgaaattgaaatacatctcttagacaatttctctgttccacccaagtttttcttcgataattcaaacatcaatgttaaacagttatcaatgactactaaaatacaagaatattatcattaatttcatcattttctatcatatttttttatatttgaaaaaaaaaaaaactgttgcatcacatgggatgggatactagtatcaaatatatagagtattatcattataattataattataacagttggggctgtaagaggtttcgaatagtatgcatgatagaaaccatagattgcatgatcacactgtgttattatacataaaaaagaattgtgtgacatgacgtttgtggattctaatctcaaaagcatcaaaagctaagtctcaccagctaactgccttcatttaattttgtatgatctacctagtagcttcctgaagagggggaccaccctccaaataaatttcctgctatggctcccccacatgcttcgtgtcatcttaattttgggttaaataattttttttatctctcaactattttagattttaatttttagttcctcttcaaatctgtccattttagtttcttatttattttcattattcagaattaatatatgtgagattgatttttatcctttattcccattccaagatcagtgactaattttgtacaataaaaaaatagacgagagactataaacgaaacaacagttttaagagaaactaaaaataaaaattgaaatagctaagtaaccaacaaaaaacttatttaattaatcttgtttattactttgtatattaagccagcccaactcagtactccctctctcacacaaaataggtcacagataggcacataccttgcatttcatatcaataaactcaactggcacatagaaagggaaaaaaagtataagtagagatacataatattggataaaaaattagaagtatttttaacggatttgttattaaaaaattatatttttaatagaaaaactctcaaaaatatttatgacttatattcaaacaagttcataatttttttatgtttttatgatgtaacatgtacaactttttaataataaaaagtaatatttttttattttttagattatttaaatattattttaaatttatgccatttaagttacataaaataattatttaaataatctatacttttaattataataaaacaataacaaattttaattaatttatattaaaataaatttttataataaataaatacatgtaaaattaaatattaaatttatttaaatattaaatttattttaatttataaatttttataatttaaaaaataataactcttcactaatgatacacttaaaataatatttataaaatcaattaaataaaataaatgtcttaaaaatttattaattaaataaccacttgtcacataattgtttattctgaaattttaaaaaaaatcttgatttaaaaatagaaagatgaatttaaaattatagagatgtaatttaacttaataaatatgcctttttttaaccggaaccaaggatatttgatattttttcatcgatggagaatgaataggcccttacaccgtcaattttcctgagatctccttgatgttgtgaaaaatatagaagcctttattaagaaaaaaaaaattcggtggaaaaggaggctcaacattactacatgtaccattcaatttttttccgaatgcaatttattgcagcggcattcttgagaatttggcaatccatgccattaggaatagtctcaaatctcaattctcaaaaggttaatgtggaaacgtcaagaatattcttaacgattaaccatggtaaaaaaaaatagaatattgtttggtcaaaataaaattatgtgcaataatattttcctcactttagttgacatttctcgcattataataatttgaatcattgatttctctatcagattgactccttcaacaaattttttcaattttaggcaatcccttttaaaatgtcccttctagttacatttgtaacactagttgtttttctgtgttttatagacttggacttcttcatatgcttatcacgataacatttgtcttatgctcttatgcatttttgtttccccttcacatgaatagagtctttctcatatattagagttattaccaaatgttcttaagaataagacaaagaacacaacagaatacatgttttatcctcatactcaatttttacatctagctttgctagatggttagttgataatctgattgaagacattcatgtgttgttgaagagcgaaatcctcctacatctttaacatatagtttctacttaagatatagtttgttcgtcaacggttttgacatgtattgactctccaatttctttcatacttccccttggagatgacaacttcatcacatgataaagaacgtcgtttgccaagcataagcatatggtggttgtcgcaactctctcttacaactcctctcaattcaaaacctccatcttctcaaactttgagtcgcacagtgcctctagaaaaccttgctgtgatttaggtttgatttttgcattttgcatattcataggcgatatataaattttataacaaatttttgttgatgttgataacttttcttgtagttttacaagaatacgtgttttctccttatttaaatttttatctataaaaaaaatatataaattctctcggtcccgagcctaatttttagagtttttcctattaattttaatagaaatttatatttcaacatcattatccaatcctaattaatttgcggaacttgcctcccgattttgtttttagagcgtattagacgtgattcagtttgtgtagcgtagtttgtttgttgggtttcatttactcagactctgtgtgccaaaaaataatattcaatcctactagggcaccttgtgtcagtactcacttgacaactttgctcctgtttcgagccaatgtttggtgtagctagccgtgtaggtttatggcttcagcgaccagattgtggtaaatttattgatttcgttcgatgtcttgttgtggaatggtgtgcttccattttttagcatattgggttactgtaggtgatgttgtaggcttaaagttgtatctgaatttggggtgtttaagtggtgatgcctctactagactggttttggtgtattggcttgtctttatgtcttggtacttttcttttttggcttgtctcaatttgatggtgctggtagtactcctcgctccgtctctgatatatgatagtagtttatatatatatatatatatatatatatatatatatatatatatatatagcttaattattttaggtgtcttaggtattgcatttatgtaattttggtctttcatatttcaattgaggaaattaaattcactaaatactttaattgtgcgattttgatttataattgtaatacttaaatgatccaattcgcaaaattgaaaactagaaaacaaaattgcacaccttatgcaattacaccttctttaatttattttcactgatgagcaatcctttattttaacaaaaagtaatcattatggtcctgtttgtggaaaagcttattaacagcttctcttatgttacaagtgtctttatgaatgtttgggatggtttttataaaaagatcctacgacataagatttttttagcttattttaataagttgtaggagtagcttattagcaagtgcttaggtgttatttttagaagggtcagctttcgaaacccacctttgagtgttccaaattcttatatatatatatatatatatatatatatatatatatatattcattcccttcaccgtataacatttttattctttcagcttttcatttttctggctttatctaaaattttgttggctttctttccctagccaaaaacattcacacgggggttgtttggttatgtgtaagagaaaaaataaataaaattgagagtaaatatatgaattaaaatagagaaaaagaaatgtgagacatacgttattttttaataatttattcttaaataatattttttctcttcaaccaaacaatcctagagatgaatatatattgaattcttccaaattaattaacacatctactcgtgtgatagatcaagtctataagactatcaaaaaaacaaattgatactttttacaagcattttataatctcaagaaaatgttttaatttattcagctaatttcatgattcaaaagatattcctttcttttagatttattattcttatttttttgtttttactataaaaataggtaaataataatttagtgattttatatttttaatatttgtatggtatacaacgttatttttttatttttttagttacttttaaatgttatttttagtttgattcttaattttttttaaaattgtaaaatgaaacattttataagttcttatacaagaatgtatatccaaatactataaaattatgaaagcacttttcaacatgaatatccaaatagcaacaacttattaaatgttaagcatttgtaacataagctcttatcgaataagatattaattaagttattttttcagactggcccataatctacgaaagatatgcagctttgaattgcagttgtcatgcgagcacttctttattttaaaataaaataaaacgagcgacaagatccgcaattctaattacagtccaaactctgtatctcaatttccgcttcggctgtcgtatacttttaggagggcctttttccaatccctttattctaattgcactctcctaagttttttttttattttttatatatatataaaatcttacaaaaatactgctaagtggagggtaagccgtaagcaacaaattctttaatttatatttaattattagttgaaacttattaaagattattttcatttttgtttagtatcgaatttttttaataaatgttttttatttatcatttacaaatttcaagataactaattattttttttcaattatattcttattttttatctgatcttcaattaatttacatacatacatgtattatggattatggagtaataatgataaagggtgaaataggaaacctataacttctgtctttgtccctaaatatgagaatattatttaaattttttatacaaaaatatccctaattattatagtctataaataatagtaattgctatgaattgtctttttctctatcttgtgaagattagataattgaggaatttaatttttaaaattaaaattcaactactattattctcttctcgtgcaaaataatttagttagtcccaataattttaggaacaattttgaaaaatattagagttacaaataaatctaatggtattaactaaattaataaattttcttaataattatgaattaattataaaagtcttatatttaaggatgaagagaaattattatgtttcttagtttctacataaaaacttttaaagacaaataattaaaaagaacaaagatcatatgagatgaagagagacacattaaatgtggagataaattcaaatttgtgatttctattaaattttaattattagaagagagtgtatttaaaaaacatagtttttaaatctggaaagtaaatttcaaaactatattttaacaaataaaagaaagagaagggaggggtgtactttgcatgctgtgaaagtcccaaagtgacgcctgatcatatctctggctaatgcttttgggcctttattgtggaccagtaacagggactatttagaacaataacaaaataaacccaacatattcataaatataaccaagctatatattagtatatcacttctatctctatttataataaaaatatatactttttataaattattatagaagaattcttaagatatgtataatattaaaaagataatattttttcttttttttttttttcctaattgagatctaatactagaaaaaaaataggagaaatattgagagatctttaatcttagattaaaatctcaatttaaaatctattattaaagatgctctaagactctatcttaattttattgtgcattaatttttttttactaaaatattctaattcattttattacataattaaatgttgatttgaattgtcttttttctcatttttataaagataggagaagataaatagaatttcaataatattaatattaagaaataaatttaaaaaatgttatatttatataaaaaaattaacgctaatacctaagtttaacaaactttctttaaatgtataaattaatcaacaaggttttataattagaaacagaggaggtagtataaaacaaaaggcaactgaatagcaaggtaaacatctcgaatagtaacaaatatatatattacaatttatttatatttattattatagtgtatttaacttttttatttcacaagtattgttctttaaattaaatgagaaaggatagaaaaattcagatacgatgaagctatatatgcatttattgtgggcaaacatgatccagaaaagcccttagattcttatccgaagagccgccatcttgcttgacagcttccctggccaaacccttccaacttttcgcattgtttctcaattcttctcctttctttccactccccatcgccacttccaaacgcttgataatttcttccctttctactatcccttcctcgttcacctgtttatccactctcacccccgtcttccacacatcttctattagcttcgcgttagtcttctgttccacccactgaggaaatgcaagcataggaacccccgaagccaagctttccattgtcgaattccaaccacagtgcgtcacaaaacaccccacagaacgatgttgaagaacttccacttgagaacaccaatttactatctttcccttctgttccaactcctctctgcagcttagctcctcttcttttccttcaactagtgacttattttctttttctctaatgacccacaagaaaggacttccacaatctaataacgcacgtgcaagttcttccatttgcttcttgggcaacacgcaaaaactaccaaacgagacataaaccaccgacatctctgccttcgagtccaaccattcgctgcatccatcagagacgcggaagatgtcaccgccaaatgaagtatcagtgggatctttcccgtccaagaaggccgagggaatcaacggcccgatggggatcatgttgaacttatcaacggccctcaaagcctcatgttccaacgcttcaaaggtgttgacaagtattctgggctttgcttgcacgtcaagatcatgaagctgctcttcaaacattgaaaccgcgagagagtcaatagtagggtttgaacccaatagaaatgaaggtaggtcccgtggtgcaagcaataacggcaatcctggcagttcaatggaactcgaggggtctttgattttgcctttgatgtagtcaccgtgttcatgaaagtagaaatagaatatgtcgagtatggtggctggttgagtccacagcaacgccgtcgggaggtgaaacccgcgcgctgcctgagctgcccaaggaaggagcacggtgtggactaaacaagtgaaaggatgaccctcttgcgcgttgaaggcgatgagattggtgacgaattcggagccgcgacgcttgaactcggaggcgtgcagggcgtaatcggtggaggtgtaaccgtcgtcgtagccgtcggagaaagggagaaaggagaggtcagggagggtgggtttgttggtgatgcgacattgcgacggtgcatgtggacggtggtggaaacagtgacgtgtgcgcccaaactaacgagacgctttgcgaactggaatgcagggtttatgtggccttgtgctgggtacatcacgatgaggaagcggtggcggaacatggtgcgtgatattgtaattgcagcttaatgatttgaaatgattgattttatgttcggaatagacaaaggagaaaactactgcggtgggtggaagaagaagaaaaggtagtgagaactgagaagtgataagaaaaaactgaatgtatatatactgataatcaattaatcatagactacgacttgtcatagtttgtcatttgtgacctttgaggtgacgaatacgtagcggacttcctcaatctatcttcatcccttatcctacattttagtcaataggagtagttgaaaagatagattttctgagaaaaaattcccttcacagccgacacatgtttgttagtggttaaaaattaaaatctttaaactattatatgtaaaattcaataaacaatatatataaaaacatattattgaaaaaataattattaccatatatataattttatgtttgaatttcttttacacaattttttaatgaattcttttacatcagattaagaacaacaataaatatattatttattgaaacaattttattaaaatatttttattattctcaaatgcattactagtaatcattgagtgattaatagtagtggttgaaaaaatggtaagcataatattcaaaattattatatcaatgcaatttatttgacatttattaaatatgtcatttttgatatttatttgttaatttatccgttagttttacagaacattttcaattaaataagtcaacttataaatttttaattaacttttcaacttttaacttataacttacaaattttcagttatcttgtcaatcagtttgtcaaacataatcttacgattttgaaaaaactatgaaattataacattttaatttcaaacatagtcttacagttttaaggaaacctatgaaatcataacatttaaatctcaaaaatggtcttacaattttgaggaaacctataaaatcataacatttaaatttcaaacatggccttgtagttttgaggaaatctattaaatcatagcatttaaatttcaaatatagccttatagtttcgaggaaatctatgaaatcataacatttaaatttcgaacatcctaatcacaaaaaccattgccaatttgtgtcataaaataactatctaggtcagtttttttctttaaaaaaaactcttcatttataatttatatatgaatttatctcaaatagctgcaaatgaggacttttaaaaggtggatattgttcctttgaactcaagcatccttgctcatgcttttttactttataggtgtgacaagtttgttgaattttgaaataaatgaaggagaattaggaagagtgagtagaggaagatgaagatgggataaagtaggggatagacttaatatttttagagagaaaaaaaaaaaaaaagagggaaggagagaacgagaggtcaagtcttttacttcttaatttgatcattatatgtttgtcacctttaattataaatcaaactacaatgttttactaaaataatatcataatataattttttattttaaatataaaatatattttaaatatgtatttataatataattttatattaatttatttatctattataaattttagttatatgaaaaagtactttcttattgtttattattttcttaactattctgaaaaacaattgataagaaatagggtataataaacaatgaagtcgaaaaaaaaaataaagacaaaagattataattctaaaggagactaaaatccccgccaaaaggaatcctttattcccgccatgaaatgtctctcatatccaaccattgcgccaaatttcgcgtatccaactctagcgcgcaaagaccatggacaccgtcccaagctcccgtaagcggaaccacccttctggaacactgacccgcaccagatcacagctctatcatcaccggaaccgctccggtcaactccgcttcgatcctgttcccgcacaggacgaaccctgcgccgaactccttggctttcgccgaatcaattgcaagaaaccgaagcgcgacgacaaggagcttcctcgccctctgaccaaggaccttcgagctaggcgagtttattcccctccgcaatctacaaaccccagtttgatcgaaagcacgtttcccaagggaagcgccgaagcaaccgagagtcccgatttggggcttttttgtgaggctcggggcttcggtggagattgttcggagaaagattgcgagggaaagaacggtggagattgttcggagaaaattgatggtttggatggagcaatgactctacccgactctgagatttgcggtggttcaaattccaaggttaacgaagatgtagggaaactggacgcagaggttcctgtcaaagataccccttctactgggaatgtttcttctctcaagagcaaatctgtaagggtctcacatgttttttaatttattttctttatggttatttatttatgcattttttgggtgaatttcatacacatgtacctggagattgaagccctgaccacacccttaagaggtttctttatgtttattgattaggccttctatccttagttgttagatccaaccttaattatggcgaattatgtaattaggttacatgagttattgtgggtgctctaggttaaaattccagtgaataacacttgtttttaaatattattgtagctttgagaacatggttttattattgtagagttgattgggatctgtttgcaggttctcagaccacgtttccagggaaagttgttcaaggccccgggttcagtcaattacagaaggttgtttccgtttctaaaggataccgtgagagatgattctggtaattattttgtgcggcaaaccccttattttttatttacttcattggttgatgatttagttgggtatgtgtgatgaatgagctaattggtctgataatatcttgtaggtacaccaaaattgggtttttgtcagaaagatgaggagggtagacagggattccaacttcttttgtcatctcaaagtcaagaagagtctaaacaagaacttaagacggatgccaccgcagattatggtgttaaaggtgttgcaagtgatttgcacaatgatgacttgaagcaattgtctagctacgggaataatcttgatcgtgctgaggctagtacggcacaggagtttggtgtcttgaatgaagaatatatacagacaactcctcctgatgctgatatatgtgttaattcagaggtcattgtcaaaccgatagattttaccagagacactcaggaaaatgctggtgaagtgtcttgtctgaaagttgacaaggggaaatattctctcaagagtaaatccgtaagaatctgtccttgtttctaatcttgtttgctaccaatttatgggttagacatttagttactgatctttgctaaactataattataacttagttacataataaaattaggtctcaaaaccataagtgatgaaatattttatgatattatattccaagaaaaaacttttgatgtagtagttagtcggctttctagcatttcatgtgtctgattttttggtaatattaacaatatggttttacatttagttgcaatttaaatatgatttgggatgtccacgcaggtgcctagacaacatttgcaccggaaactttttaaaaccccaggttctatcagctataaaaggttgcttccatttctaatggatcttaccaaagatgactctggtaactatccttgtgtattcaaccactttaataatacaaatttcattagatgttttatgcggatatgaagtagctagttgattttacagatgcatccaaatttgatcatcaagatgaggcaaatatgcatgcaaagagctcccaactccctttgtcatctcaaagtgaagaagcttctatagacgaacataagacaaacagcagtcccatgcatggcacagttgaatctaatggtttggaaaactatgtattagttaatccttctaatgagctatctcatggcaaccagccaaaattgacaccttcccaagacttgcctgaattgtcaacacaattggacgcaaaagaagtggtttgtggggatttatctgcaccctctgtcagtgaacatacagaaaactttgcgattgcttctaaagatgaatgcttgagtgcatcagagcttaatccatgttcagtaatggtggatgattttcactctgctaagaatgttgtgcataatgatggcgtcaaggaagtacagaataagatatccagacaacacaataatgagtcaccacccaaagatcaaaatatgctccatatcaacggtgatgtctctgagcttacatatgtgcatcattcaagtaaagaaaaaggattcactattgcttatgatgaaagcaagcagtttgtgaatctggaggagcatgaatctgtcagcagatttcccctgaatgtcagaccctaagtcaatcggatcccaatgtgctagatgctgaggagaatgtaacaagtttaaatcatgtccgggtttcaaatgatatatttagagctccatctgagaatattacctcagaaaaatctgacatggcaggggatagtggtgacaaagctggaactgtgcagaatggcatagttttatgttcaagaaggccttcaaaaggtagtaataaccaaaatgctagtgaaatcgaaaatggctctgaatccaagatgacgtcggtgaggaccctaaatttatctagtgctaaattatatttccataaaacttgcattaacgaacaacattatgattctacttgccactctcattgatttaactgatacttaatttttttgtccctgtcatgtatttatctgaaatatgtttgattatgtgattttgaaacaggttctcaaacgctgtccgcagcttaaattgttgaaacaggctggatctttaaactacaagagattgcttccatttctattgaataccatgaacgatgattcttgtaagtattggttcttattcttgtggaagatacttgtttagtttagtatctttcaatttttttcttggtcacggcagctgtagttctaaactaaacctttaatacttctaggtgcttcagtaaatgatcattacccaaaacttgcggaatccatggatcaaacacctcttctgccaatttcaacttcaaacttacaactaactcctgtaaatgattcaaatggctgtgttcctatggaacattgtgctggcaattctggtcctcagcaacaaacagggttgcaggcttgtgatttaaacaatgatagttcaagccccaaatctcaaattcctgaataccagtcatctcatgattcatgcaaagtgattctactgcaaaatgaacaggttgtattaaatggactatgcaagccagagagctacactgatacatcaatttctgttcacggaatagacttaccaatcacaaccttggcgcctatgattaacaaagttaccaacagagaagaaaaggcttcacctacctcgtccatgtcattatcagtttactctgaagtaaaaggaaataattctttcctgatgccttctaatgagaagctaccagaaacacacgaatattgtcagagcttgtctcaactgcaagttgtagagcaacctagagtccctgccgttgctttgaaaaaaggaattttaaaaagaaacccaagagggtgcagaggggtttgcacatgtttgaactgtgtttcttttcgccttcacgcagaaagagcatttgaattttctaaaaatcaactgttagatgccgaagaggttgcctataatcttatgaaggaactatttcatctaagaaatatgttagaaagttctgctgataatgtcaacaacaatcctgtttttgatggaagccaggtgagtactaccttgatttgtagttagtctctctaatgtgttaggtagagtttgacatgtgttgcattacctctgttccgttttttttctccatctggtcactggatcattattttatcacctagcaaaacttgttattttgtcaagcttttgatgccctttcagtttgacacgtgaattttatgactgaaaattgtgtctatctcttttaagtcttaatagatattaaattagtgtatcaagatttgttgggaatcgatcaaaagggaaatatatacaagtttttcacatgataaaatcacaggaaactaaaaattgaacatgaaagtattcattcttcacaagtatataatattctgctttgggcttaagaagaaagattgttggtcagttaattttggccatgttctatcttgagggcacattgtattgacagcatcactcagtagctttctttttaaatacatttgagctatgaaaatatatcttcattctcactattatttaattgtttttttccttgtccgtttcataaacttttttggacttaatctagtttaccgttgaacttgtaattccatccttttttcgtgtctgtataggcaaaatcgcaatcaattagcgtaaaaataataggcaaaatgcttaccaaactgaggctttttaccccttgtatgtttcaggtgaaagaagcttgcaggaaagcatgtgcagcagaagaagttgcaaaggaccgtcttagtcagatgcacgatgatcttaatactcattgcagaataacggtatgtgcatggttgttatacaccaataattggttccttcatttgaacaactgttttatttcaagttgttggtgcagagcttgcggccaccaacggttacgtttgcggttcatgttgaagaaaaagtcattcaaccaggcggataattctgtaattgcggtcttaaagcatttatcctctcatcttggaattttttttaggagtgatatcaaatataaattataaatcaggtttagtcttggaaaactaaatatcagagaaatatgttcgtccttttgaaacagcaagaaagtttgagttggagcggacaagaaccttagagatttttttttttttttttttgtaatttatgttattgtaaatgccttttgttcgcagttatgattcattctaatttgccctatttttttaagttaaataattttttttatttgatctcattttttaaaaagtaatactttttttggtcatgtcattagtatcttcattccactatattaaagattaatttcatctagcttaaaaaattttcacatagtagaaattaaatatgaaattttttgttaaatacgtgtgattaaatactaataatttcttttaaaaaataatagaagaataccacaccattgcatgccattacaaaaatatgaataactataaaattgttggaatgattgcagatgtgaaaaaacaaggatttcaagttacttgagttttgaagtaagcttcttagagtgaatattttgatactcataaatttaaggtgtgtttgatttagaaaatagaaatagagattatataaatagaagataaatttttgaattaaaatagaatataaaaaatgtaaatttcacataaaaaagtacaaaaatccttttttattttattttcatccttcaaaataaacacaaccttaaatagagaataaaatgcacaacatatgacactagcttggacaaatgtgaaatttgatgttggattttggtatttttaatattaaccattcataagatctaatgattattcattcttcttacgtaaaaaaaaaaagacttaactgtcttttatagattctttaattcctaccaccgtaaataaaagaaaaatataaaaaagtagaaagtgaaaaaagaggagatagaaaactaaataccctaaatttattatatttttcgcatatataatttatcttcgttttgtttttcttatttatattttctcttaaacgcacctaaaataatgaattcctcgtataaccaacaatcacttttattgcatttaagatatttttaggggtctgattctctctctctctctcttcaagaagagggatctctaagtacaatcattggcacaataattgtcgatacaaacaaaattgttagtctgattatgtttggccaaggggataacatttgctcagtcaaggtatgatggatcacttttccggaagataaatgcttctttttttttcagctatgttatttatatactttcttccggttttgaatagtaatcaaaaattaatttacgttaattgagaaaatatgttaatattatttatttttattaattatatttaaaaaataatattttttctaaactgtcctttattgaaatttgatataaaagggtcattagaaatacaatatcattaaatgaaaaagatgtttgaaggatcatttcattaaatagagtaaaattaattaaaatttatttatattgtggacaatttttttatattcaaaattaggggagtaacatttagataatacagtatattttcaataatattattattttatttcttttaattactttaattattttattttatgcttttccccctttttgtctcttttattgtaaaaatcatatgcagtaattttttttataaaagttatataagtagaaattttatttttctctttatctttttcgataatattaattaagaagctattcacccctgatttaagtggcttaaataattaaactcctttaatgttgactcgaaagaaagagatttcacataatttctcatgtaatatgtctgcatgcatttgtcttaccctacgattaaggttattttctctctctttatttatttatttgtttgttcttttttgtccaacgatattgggcgctctgcatgttaatataaaatatatgaaaccttttgagcatgcagaatattgatgttttgtttcaatttggattctatcaagtacttctcgccatacaattttaaaattatattcatcaatcttaaatatgtgattgacggatcataaaattatattaaccagcagtaaaaaaatatattatattaaccaatttattactttattaatttaattttatcgtaatcgttaaacgtaaatgtatgtctacattgtctagaaatttttggagaaaaattggaaagagagataccatagaggatcatcaatggtgcaaagtgggatagctgatagtagaggatggttcaaaatctcatttgagggaaaaattctctttgggtccatcttattaatacattatttaattgatgaaatgtatacatgcttgggaagagaatatatatatatatatatatatatatatatatatatatatatatataaccaacaactgtctagttgacaatgatggagttatttaaatatattaagagaaattcaatttctcatatatcttgcatatcaaaaaaaaattatttggaaagacaaaattcaatttaataattttcatatatcgaaaattagttttatgactttatgagatatcttactttcaaaaaaaagaatatctatatatatatatatatataatgtacgaatgaaattactctaaattattcaggccacccatttaatttccatattctctttagatctcttaccaataatgcacagaataatttttatcccaaatgttaatgtttttatgtgcttaaatttgaatgccccattttgaatcctctcgtttaatcttatttcctgcagccatcttactaattttgaatgcccagggtctacgattttttatgtcaatgtggtatttctgacagttgattattaattattaacattccatacgagcaaagtgacgtcgatcagtaccagaactacagtgctattaaacttgactacacctttttattatatgaacagatagaaattgattccaacatgatcaatttcacagggtggacgagataggatgagactaactgcccatattgacaagaaaattaaagtggtacaaagaatatgatttattattatgaccccttaatatacatatacattagcaactataaaatagaaactaaaaaaaacaaaggaagaaaaaaaaagacagaagtcaataaagaatctaagacataataaacatagcatattttacatagacgattcaaatccaataagaaagtggccattctcttcatctcttggaaccttcagcgtctacattcagcaggaagaccttgtgggaatcgcttgagatcactgcagtagttatagatcatgaagtacttctgaacccatctcagtcttcttctgctataagcatcaagctcatttgcctcatattcagcaccagaatttgaaatggaagacctggatgagaactcagtggctttgaaattgcggtagtatgctgtaaagggtgctttggaccaatcagttttcaccaatcctcctctggtggcccagtcatcagcattccagaggctagaatagattctcatgggctggttctttggaaaaggaacaccaagagattcagcattcttgaatacccttattggtgtgttatcaaccaagaatctgcagttaacccaattcatgatttggttaatggattttggtgaaaacttagcatagagataaacaaagttatatttctatgcaatttcagtgaaaacaatttacactttcaaatggtatgacttctagttcaaagataattgatgtcaaagtcaatgaacttaacatatataatgattatggttgattgcaatattagttgatagactatttattaataaacaaaaaattgtattttgaatatttgtttattatcacttacatgatgtgctggggcttccaaatgatagaataagtgtggaagtttctggtggggtcgaaccagagatagaactgttgctccctgttacctttgccttgggtgaagatgtttgtgtggagaatataagggtccccacttaggtttcccaaaaactcgaaatcaatctcatcatgtgttggcccttgggatgacaactgcaccgcagaaaatggaattactatagttattgatatggcctttgtgtgtggtagcagcacaaacaactcgacaaagaaaaggacctcattttggggaattgtgatgtttgttgtttattaacaggaatttaaattgtgtgcatgcataggaatagtatgagtttatcaactaaaaaaagccttagattttttattttttttatcaattcaaaaccagaaagtacattatgataaaagtagttcattaatattacacgagcctttttttttttttaatttgtcattagtttatgctatgaaccgaagttttcaatattaaaagttagtaatgttttggactaggtcaaagttagccaccttcccctgtcacgagcgctagttaaattcactgcttaaaaacgaccaagttgattaatgtatacgtcaatgtttgaaacagaaagcagcatggagtgaataaataaagcattagttgttgacaaagtaaaattctgtagtctaacttgtttttgtgggtttgctacaatagcattctcgtgaatgtacagttgagtttgacaaaggttgatgtcttaagtgaagaagcggtcaatagtagtcgtatttgaagacaggattttatcatgttctttcatgaagaatcaattctaaagcaacctaaaagaagaagaagaaaaaacatatacacacatacaaaaaagtctacagtatcactgtattagctcatgaagaaggaaagaaactaataatttgaattagtatatttttcttatggtaaaagcaagggtaaatgagtataccaaaaaaaaagaagataagaaacatgataatagcacaatacaattttttaatttggaaaaaatagaaaatatattgaaatatggacaaaatttaaatacactaaaagtattattctgtgatcagaattagagttttacttcaataatctaatctgtctgttgacatttattacaaacctatattacccaaattatccaggtaaaactgtaattttgattgaaaaataacactaaaagtatcaaaagaaatcatatttaaattgtgtttgaaatttttgtttgtactttgtagtataaaatattgtagtaatgaaattaaataatgtattgcaaatattaatgaacatacgtagtaagcagtgacagtgccagcagagttgccagcaacgagcttgagctgcatatcaatcctcccaaataggtattctttctttgatttgaagccagagccagagactttgtcaagggaaagagatagaagctggccaccattgaatatcttagcacggtcaccaccccatgttagatcaaagtcttggtagaagctaccagcacaggtagcaaccatagtgctaaccattatcccaactagcataagaacatagaatcgaatattgtgagtagaaatagtagccattttggacacaaaaaaaggagagaaattgtgcttcttgtgatgtgagggagtgtgttcaaaagaggggtatatatatatatatatatatatatatggaggtggggatttgggtatgagactatggtgggacgcgtgaaggagcaataactggggctggtgggaccaaaagctggtgccagcttagcaagttttgaaagctggtgcctttttgtttggccattggttatacttcaatagattttgagttatggtttttgggtttgtgcacaggatgctagtattattcagtatgggcaatgattgtttccatgatattactcacaaatgaaaaataaataataaaaaaggatttaatcccggaaatataggggtggaccccatttttgtatgatttggaacaaaatttccctttctttcataaaaagagagaaaattaggtgatggatggatgccaactgggtgtgatgtggaagcagaataaagacatgagggtattttaccacttcttagtaccatcaatcatcaattatgcatccacttagatggtgccatgtggcggagttgtactgagttattgcccctaggatattgcctaaaccaacacctaaattttcactgttaaataatcttcaagtttgtgacatatagatatacatattctttgatgttggagttaaaattcaaaaaaatagtcacaagattgccaatgatatggcatggttatccacttcggccatgctgataactctttctgcttgctttgtttcgggttgttgcattgcttgagttttagtttgtcttttccaatgcagacaacaactttggatgtgaatgacaaaacaaataaaaaaataattcaaaccaatatgcatttatttctcacgagtacggtgcatatacaattatattaatatctacttgtatgacaaattatttattagaaaaaatattagtgaatgaacaaacttcctacctgcatccacccttcattgttacaataaccacagatttttttcctgataaatggtccgagcatttaataaggaagttctacagaatcaaccttgaaatgagggtaagggcatccataatggcacagtaacgaagagtatggcaatgaatgatcgcttcattactaaagtactaataagcgttacaaattatagttattattattattcaggaaatgcagaaactagatcaagagttggagactgaaaaaaaaaaaaagatcaagagttggagtatttggatacttaaaaactattcattagtgccaatcatcattgaagtgtagccttgcatccctctaatgttaattaatcaccactaactagttattggaataaaagtgcaaatttattggttataacttataaagagatatatggtcagtgggaatcaacttatggcaaccagctatcagaatctccaccctttccttgcaaaaagtaactaaaatgatgatgccttatttaaaaagtactccactactattttaatgaatttgagaatgtatatagcacctcagaatggacctgattttaatgtgaatacatatagttggggaaatttaattagtgtccttcacttctttctaaattctatctaatcaaaacagaaagcatgttttcttttgctaacaaaataataaacatatcagtacaattatacaaatcgactgcataatgcatatgattgatgctttcggcaatttatgttttgcgtccttttaaataaaacctttgtttggttgaatatgagtctacatataaagtagatttgggaaagccaatacatggaatcataggtgctgcaagttacttggaaagttcaaatgaaacaaaagagtaaaacaacgagatgaatgtgactatagaatttatagacagtgaaattgctgaattcaactaaattggttggtcacgatgatattgatggttgagatattgtcacatatatgatatataggtccattaattaattaaaactacttattcctcatcaaatggcagccttcatgaaaagcaaaggaaagatcataaaaaaagtgtgatttcatccccatagctcaatgatgaggttccttctaacaatcttttatagcatatgcttttggtgaagattaaatttggtatacgccactaattagtgacaataattgtggaattaaatatcatggacgtatcataataatatttaattagtaaccacaatattctctttgaagaaggggggacattgattccagataaacaaattgagccatagtttcaacttttatccgtgaatccgtgatctacaaaccaaaccaaaagcaactactgttgctgtatttgaaatttgagctaacagtctcaccataatgaaaaatggtttgaatggtagtttcccatatgactgcaggttgcgctggcagacagggtcagttgattgtttaaaaaccagaaatgggtggaaatggaatttggaatctctggaagcaggttctatattcattgttttataccaaatgaagcatcagttaatttagaaaaatggtactaaacaagtatacgtacaaaaattgaagatataaaaacttgcatattctttatgcacgaattacttaatttagaacttttttacacacattcctgagttatccatgagtatatctaattaatgaccgagtatctgtatctagctatgtcccgtttttctccccttagttaagttggctcgtcaaattaacccgcattcatattatactaatcaagtatttgcatacaagaatgggatatatatcaaatttgtttcaaataaataaattttggagaaaactaacaaatatttctcgtattgcatgatacacaaaaatacgaaaagaaaactacagatttagaaaaattaaagaaaaattatttaaatgataattaaaaatatatattaagatataaaatatacacattaaaaaatttatagttaaaatattaaaaattaatcaattaataaaatagtacttaaatgatcatttataagaattatatatattatgcttaatgttaattgaataaatttaagtattcttgtaaaaaaattaagtattggaaaaaataactgtgaaaattaaaaggtctcttttaaatagataataatttaaggagacaaatattgatttgatttaaaaccaaagcttataagatgtgtgtaacaaaacgagaaagggcatagatatataagttgttccatgttcagcaacgaagaagatttaaatttataatataagatatagaataaacgtgattcgttttccaactttgattttagaagctataatagtatgtttttgttatttataataatatttttaacaattttatatttcatttctttttttttaatgattaataatatataaactaactggtgtcaacagaagtaaacaagtaataagggcaatttgttgtatatcaaatttagaagagttatttagaaaaacataatttgcatttagacatgatatttttaaattttaattaaaaaaatattttgtttagtttgtaaagtggaacaatttttagatagtaaatgcatacttagtaattgaatttaataaataatcatttcttaacatctctctcaagaaatttataaaagtaaatgattattttttcataataaattaaaccaaacatatactaaatgagatataacttgaaggtccaaggaaaaagctaaaaattgagatgagatgagaccattcatgaaaacaagagaacaaaaaacaagtaaaaagtattttaatttttaatctaaaattaagttatggagaataaattttaaaataataagagaaaaataaacatgcaaacatatttttttatattttagtttaaaaaaaaattctaaaaatcaataacgaggcatacccatattcatttaaataaaccgtgcatgtaaaaaagaaaaggagatattttgaaattcagcttctattctggttaaaagatgaaaaagaaaacaaatctagaattcagcttctgttctcgtgaatctagcaaatcttggtttgataagtttatgttttggtttcaatgcagcggattttgctatgcgaggctatgtgatacttgtttagatatatattgggttgcaggaggctcaaactttgtttcttttcttttgtctctttgatttggtgattaataaaactcattttttttaatttagaagaattaaaacaactcccgtaaaaaaaaaacaacaactcatcaagagaaatgtttattggatcttttatttcaacacaaactcttcttttctcaagtagaagttagtagaatctaagacctttgcaacaccgtcttatttagcataaacaaagtttaacgtgtatgttttttactaatattaggaaaaattataattaccgaatgcatgaatcaattggtataaacttttttctaatttaattttagagcacataactatgttaaatactctatgtcgagtaaaattttctcttgttgacccgtggtcttgtaaaaggaaacaaaaaaaaaaaaaacttctattacaagctttttttctttgtaaaatgaattaatctgaatattaagattctagctcaatgtgtttagattaagtttcaattctactaaagttaagttgaagtccaaagcaacaaacaattacttcaactttttaaatttttcatcatgattttagaggttaaaatcgattctaacttctaagagatgtacaaacacactataagtgcatgtttgaagaaataattgacattttttttaacttaagaaattgtagggggaaaaatctttaaaataaattaacataagtgtacactgaataggtgttgaaattaatttattttatagtgaatcaaatcaagcacaaactaaaagacagaaatataaagcaaaataatttcgacagacgtaaaaacattttaaaaaatgctggtatgtacagcgcatacagtaatattggaaagtacgaaatgagaagttgaatgctcaaataaaaatcaaaatccatgatccatgcatgcatgttaattgttattattatttctggtacatgcatgcatgttataattatattagtaattgatgaacaaatttttgtttggtttccaagtctgaatcgatgggcaattgaatagaaagagacctctacacaacacaggagagtgcaccgaaaaccaaatgaaaatccatcaattaaggaagcgcaacgtcacatcgtgcattgttgaggtgggtcctatatatgaaaaaatgctttctaaatataaggattcatatttttggggtttgagaattgagatattcctttgggatggggactcaccaactcttatcatatcaaacgcgtgatttcaatgatttcgggtaaaatgaatggtttggataattttgagttggattaaaattaatagatttaaaaattatttaaaatttaaaatgtattaatagtataatgtgtcatttaattataaatcgttgtttgatagttttgttaagctttatactagttatttaaatagtcatatttgagattatttcttgttgattaacagtgttaaaaaatattacatgaataacgtgtggaaaataaattcaaattaatagttaattcattaaaaatacattaatcatttaaaagaaaacatctaatttatttgccaataattttcacagatggatatctaattatccatttaaaattatttttttatttgtcaacaaaacttctctccttgtgagtactatttgagaacctactatgagcatatgctcttattgtgatcatcattgatccaatagtttaaattattggtttataaaatacgatagatggtttatccatcatccaaaccatcatgttttattcttataattgggcggataaatttgtacatgaatatattagatgattagtgaataaatggaggtaactatcagcctaatactttgtttcaattagaaatgaaatagacaagaaagaaagaaatagaaaagaataaaaataaaagagaaatagaataaaaatggtttttgaataaataaaaatagtaaagaaagaagtaaagaaatttctcttcacttgtttggaagagtgaaagagaaaaataaataattatataaaaataatttgtaattaaaaactaaatttaatctaaaaattaatttttaactattattttttcttaacataaaattatatattgatattttttaatcttttgttataaaaaaatatttagttttttaagaaaatacgacaggaaagtgagatccttccttcatgccaatttggggggagggggtgaattttttttttagatcctacgacaaaaaaaatctccttattcatacgccccttcttaaacaataagtgagaatttgatatctgttgtctatttctcttttccatttcttttcctcccaaactccagtaaagcaacgagtaaacgagaaagggaacaaatttgtgccatctctttatgaatacaacgtgtcttgaaattgatttttctgtgagcaacagcaatcatcattcatcaggaaaccaaaaaagaaaaaaattaatatttatcatccataaatggaggaccaaccaatctatgccttttggattggatatcagcctgtttttctttgacttgtacccctcactacggcactataccccattttgtaaggcaattgtcaatttaaagttgtccatgctatcaaggaagattataatttgctgaaattgtagggtgtgctatctttttcctgcagccaagacaactgtactagatagaggaacttccttgatagttgatgatatgttggttaaaaaattatcgtgtgctaaaggtgctttgtgcataagttactctagataagttcgaagttaaaatgagaccactcgaaaggttaacgaaatagccaaattgaacagaaaaatgaatgagaccacatttaaactacatgttagtgatgaacaatttcgtgacgtaaacaaggtcagagataactaccatttgagatcttaccaccgctccaaatcaatcaatagcaatctcacgatcaagtgaagcacctccaagtggtacacgatatttcagaattcagttagtgtacattagtaataaagattatgaagtctgctaaaatctacttgataatgaaaaccaaattagaaaatgcaaaacccaaactttccaataacgtttcatattgaagacaaccataatccattcagaatcaaagttcttttccatttccactgtattacctcattgttgtcaacgtgatgtgatggtttgttatgcccatcgctggtggaagtgagatgatcaatgtaaggatagaagagtttgcagtcagaagtttgtcctatgcacaaaacctaaataattgtttgacatgtgctatggattaaaagctaataccataagcataaaaggtgtcatgaatttgatcatcatcctgccctactgctcattggagtcgtctgaaacatcaaatccaggaggtataaaaataacatcatcccagttcgatgtagaattttcctgcaaaattattttatttagtctcaatttacaaattagattaaggaatatagataattgcaaaaaatcccttccctcaaaaaggggagtaacaaacacaaagggttaagtgaattccatcttctactgtaactttgacactcaccttcatttcttttattacatcctctagagtggcaacctggaaaataaatcatggtgattcctctgaaacaacaggtcatacattgaagggaatcattgtggtctgtacctggatatcgccttttctcatagtaggatttgttctgctcaagggctgccgatttaagtgtattttccaagtcctcctgtgaaaaattcgtaaggtgagaattaaaaaaattcagcttgatttctgactatctaatctcaggtaactcaatgcgagcaaatcaacaatacctttctgaagaaaagtggacgaaatctcttattttggctcttcaatatcagacttctggactgaaacttaccaatataacaactcaaaatactagttaagggattcacacatgaaaaaaattaaggtatcatagcatcaatagaaatgagtgcaatcacaaatgataacaagattataagaattagtgctccaaatatacttgtagaacagtagaacaggtccagttcatagtgtctctaatacagtatcaactcaatcaagtttcttcataacataaacataacaaatccgttaaaaaaactggcaaacaaggaagcacaggtacttcaaaatataagttttacctgtgtgttagacacatattcgtgtcaaatagcttctttttttttttactttatatttaaattgtttaccaatacatatggaaatgccacaaaaactagaaacatgatagccttttattatgcctacaatgactcgtgctaactgtaaaacaccaattctctcttttgattcaagatttgtgtatttcgttttaattttatacttgatacttaatttgtgttatatgcccataatttttaaagtttgatactcatttcatgttgtattgtataggtgcctcgtgtccaatgttgtaaaaaacatgagtttactcgttgactcgtacgagttacaagttttgcaccctccatcgagcaaacttggaggaaagatcggagacactgcggaacggtcatcaagagcgggtttactcacgagaacggtggaatgttaactgttccgttcccgaaggtggctttttgtggcccagtttgaacacgtttaaaaaaacccaaatatgatgggctattcgggccaggtttgctgacccagttcaaaaatgaaatagaagaccctattttcagaagcaaaatgatcctccaagacccctctcggaaaaattccatttgctccccctcgctgtcatctccatcgtcggcccactctgccttcgccaatgcttccgtcaaaggtttgaactttgaagaaaggaatgaatttgttaatggggagtggctaatccgaggtttgaaagatacaggactccaggcatgtgctagcagcaatttatgagtagcagtaaagtacaagaattttagatggtctatagttaggaattcatggatagaatagtggtttaggctgtaaacctgtagaggttttcggaacttgaggggcttggggtttgggttcctatcatatgagtattatagatactggttctgaatgtagaaattaacagaatgaaagaaaggcaaatttattgagcagcatcctgcagcctcctactctggatcaatggaacccagaatgaggataatggctttttaaatttaaagtaatctccaaagaatcgaaagcttggtctctcccacccactactaactaaccaactaactccttccacttacattctctcccactatttatatcctacctcttacagcatcagagtcccaactaacaacaactctctaaatactttaactagcaatatattttcctaattgtgggcctcttgctaccaaagtactccctcctttccattttctttgacactttagcaaaattaagaaaaaaaaatagtcccattttgattggcattttaatatatctatgaatccttaaatatttgtttcctattatatccttaaccacttattatggagtgagaaaataaaagagatgtatgaaggagagagaatgcaattcatataaaagacaatctattaggaaataacactattttttatgaaattaaaatattaatggtattttttagttcttgtgccaaaaccttaaacatcacacaaaatgggacagagggagtaaccatgttgttaaatggtcatggccgccatggtgggaggatttgttgccaaccaccataggcaatttgtgaagggaggcccattatggcagtgccataggccacaatgaccatctgccattgacaacattggggagtattatcaatatcatattcacaaaccaaaattcccatttatgaactaatattaaattgataactgcatcagaataaaagactatggagtgtatctctcactctcattctttttattgagctggttctttccccttttctcttaaataaaattataaaatcaaacatacaatctatatacacaaaaagcatgcacgttgctaatagaacttcacactcaaccactcagtgccacttgtttaatgatgtttcacaagtgaagactatgttacctacacagctatgaaattcaaggactttcattattataatgatgtacttctaagacataagatcactttatttttctttttttttttgttctaaaattgtatatatttatttatacatatatgtttgtatgcatgtccttgattgttcatccaattttgcaaggtttctgcttctctctataaacagataatcagcataaaaacagactcccctgggtggggataaggttgcatgcatctacctccctgagaccacactgggtgggagcctcaaacattggctcacccttcttttccttaaaatttatgtagtattaaaatgttgtgaaacattcattgaatcccctattttcaaatagctcgcaacataggaattaagacacaaatggaatgtccagacttaaaaagctgggagaagaacctggaaaacgggaacaccagaaaagccactggaagcaaagccagatttttccctctcctgtatagcatgagcgtacattatcattactgtacagctcaatgaccaatagcaaggtaaatagataatacagggattacaagcaaattttcaaacttcacatcaactatgcatgacgaattttaagaaaatggtatcaaattagctaattagaccaacataatagaaaaatgactagtacaacaccagagcagtcaagctctaattctggtaattggtgagaaccaatccaaaatcatagtaaatttgtgaagaagctttctatccacacagtaatttttcccccaagaaagctttgtcaacataaattgcacacaaagtactaaaaaataatctagctcaaagagaaacttctaccttcctccattagacaacatcacatatcagaaccaatcataattccgagagtaccaaggggcctgggctaaacgaattaatacaaacactgaagagtgaagaataaggcctatttatctgttaaaggtggaaagcaaagaagaacagtgaaatgattcaagttgccatgtttgaaaagccagtagcataaattattcattcaattgcttctttgccatatatccgagacactacagaagtggtccatatttgaatcctcattactccaattctaacaatcatatcgtacatcaaccattaacagtggcacatgttctgttcaatcttctccccaaggtaatttcaaatgacacattaaaatcataaaagaatctcaataatcaggtttgattaagatattaggaactaatggtagcatttagggagtgtttggtaggagagaagtttttggttttccatgtttggtatgtattttaaaaaaataacattcctgaaaggatgtttcctgaaaatgtttctcaatcgaaaatttcccatggggaggtagtaatcttactctcccaagtttaatttttcttttacaacagtaaaaacatcgtattattctttattaaattatataatataataaataattaaaatatagataactcttcgattcctccaaaacttatctaaagatttccaatgtcaaccaaactaattttattcattcccagtaaacatgattcccaggattcatgattcccggacatgaaaaaactttttccctaccaaacgtccccttaggatttttgaagggtttaggagtgtgcaaggttttaaatttcggtataacagtacgcagagtcgcagagcatcgtttgagcgtatccaactatacatttggcatacgataatagtaataataaagaaacgactcacttgcagggcattctttacttgagagaactcaggtatcaatctaaacgcaacgccgttcaccttgagctgaaacaccttgttcaaagcaacggggacaactttagagccctggcgcgcgtgggggtcgataagcgtaacctggttgaggagagcctcagcgtcgtccttgttgaagcagaagaggccaaggtttttcccggaggaagagcccgagaccaagagaaactcctcggaagcgttgctgagggcgtaaacgggaattccctctaagcgctcctcgattgcctccaccgtcatggccatgggcctgcctccccagggctgggctatccgagcccatggcggcctcgcgcggttgggctggagacgggtcaggttgcccagcagcgtggagcagcgaccctgaagctccgccagagccttctggaagccgtcaaagttcatcatgtttcttttctttgtagattgcagagaaagaagatgatgagtgagtcactagtgaatcttcaaacgctttgttcgttcgcaaggaaagtatcgtgttttttttttttttttctgtcccttgaaatatctcaaagtatgattttaatttctataacaaaaaatctttgataaacttattttccaaacgtagaaaaaaattaagttctgaaattaactacgaaaataaatatttctagaaattaaattctgaattttttaaattttttatacaatttcgaaatttaaaatacgggaaccaatttttttaacactgctttgagatttagatttcgaaataatgaaatcaaatctatgtatgaacacattattgaaatgaaaaataacaaaaagaatattgggtgcgctttaaaaagaagaaaaaaaaaaggattttataatcccctattgttgtatgctgtgaatgtttttgggctagaacagcagcaggctaaggctatattgatgacccaacaacagccataatatgtgtgggtatagggattctataagtatattcctatagaccaaaacgaaaaataggaatggcaattgctattatatctccacaattgctaaatatatttccttctttttttatatttttattgcacagatactcttttatataaaatcataaactctgtttttgcacctctattttttattgttctttgaacttaaaacttattttctcccctcacccctttttttcaatcagtaagcatttctttccataaaaaaacgtattctataatttactttccagaagcaaaattaggggcaagaggaagaaagatatgaacaccattttgcccaaaaaaagaaagtgtgaattggggatccatcaaattccagtgctacacatattgaaattaaattttcactctccccaaaggaaaaaaaatacagaaaaataaattagcatccttaaacaatataggagggagtagattctggaggtgtatttgcaagcagcgcacgaatgcacacgcaatccaacaccaataaatcaagtatgcttcctcaaatccttgttatgaataaatgtgccatgaaagtgatgaaacccatgaggaactcgagatgaaagcttgatgggaaccccgatttgcaactccaattggcaatttccacttttcttgttatgcacaaatgccatgtgtgtgaccatatgatctctaccgataccacgaaccataaagcatccagacagcccaaactaggcatggccataattaacatgaccatatgtgctcggtaagagtgatacctaatatatggttcaagttttgcgttgttgtaatgtgtgtgaatcgtgacatcaaagtgagtgtgtgtgtgtgtgtgtgttagcgtgggtcttagactgtagatggcttatgtgggaataatcaaatactctccaaaaagttaattttcagaaaaggaatacttttgaaaagaaaaaaaaaacgataagatgttaaaaaaagtgcaattactaaatagggaaggtaaatatatcaattgccaataagaattctatattctagaccaagcttgagcgtcactcggttagagtcggattaaactcaaaaatctaaaaccatagtgaattaaatatttactatttaacataaaatccatccatttatattgtcgattatgtcggataacaagtcaaatgagttttagatgaattagttgggtatgtgtcgacaccaaatgtggttgaaagataaagtagttattatgcgtgcattgaatagagaggaagtgaaggtaaaggaaagtgagatcgtgataacatatttaagttttattattttttcattatacaatttaattatacacaataataaggttgatatattacaataacaggtaaggtcaatgatcttgtttcagatttatatggtcttaatcgggttggggcatgttcaagaaactaaccctaacaatttttggattggataagcaaattaattaagtttaacacttctagttacatatgttctctagtagtagtatgaacaatattttaaaaaatattattataaattttaattatataaataaatatttattttgtattcaatggacgaactaaaatatcacttcaaaaaaagttgatacagtatcttacttaatttcgtgtactaccatctcttatgaattaaaagttttcttttgaatttatttcttgtttttattttgaaatattcatctataatctataattacatataaaaaatgcaaagttttggtatacacattttttatccttttttattatcataactgccttcataaatctattttattacatttttcaaataacccataccgatagttatatattgtaatccacccacgattatttaacttttattatttatattttttattttttaaaatttacagagagacaccaagtattaataataaaaacatcccattatagagtattttattttttaaaacacataatttcatcatacttaataataataacaacactagtgtgttctttaaattttcaatgctcatttaactcgttagtaataggacaaaggtgaaaggtttctctctccttatcatttgatcatttaacgcaattaaaataccaatatttgttgttatgtgattataatacttctttattgtcttctaaggcacgctcctccgacactaaccaccttaactaaaatttcttagatctgccagttgggcaaagatgattttatccacaagatctccaacaacacagcacttgctaagggccccaccattgtgccacttaactcaccaaattattgtgaccatctccttctccatttctaataacttggaatctcttcaagtttacactacttttggtgcaccaatattttgcctccttaaagagaataaactatttattactaacattttctatttaggatcagtacacctaagtttgtttgtttttaatgtgttttaagatatattgaactgacctttaaaattaatttaattcatcttaaacttgcaatgacagtttattacgtgatttattatttaatattgtttttttttatatattttaaaaaagttctgcagataaaatggcatgataatgatttgtgaactgtgtaatgtgtatgaatccaaactgaactactccatacatatactgttggttcgaaagcgagacgaaaccaaacccagcgtacatcaacaatcatatatatgttggagatggcccaacgtcccagaagtttttatttttaatctgttataattatttttgtacgtttaaaaagcattgaaacttaaagaaaattggttaagaagtactagtcctatcttcgatgattttaacaaactgctacaaagtaaactgaaaaatattataataatctgatatgttcgttgacttttgaataactgttttttactgttttttccatttaagatcaatgtgctctcttgccgaatagtgttattccaatttaaaacagaaattacattgattgtggtgacaactttggttataattggtactttttttttaagtggttatatttgatacttcttttttgaggaggttatgtttgatacttaataactggtaaaatgaaataaaattaagaaagattaaataaataaattgtcagacagtcacttagattaatcctatatacttagaagagaaatcatcctaaaaaaagagaaatgaaataaatgaaacacattagtttatactttataccatgttttattaaattacatctcaatttggacaacctaaataacaacataaattttactattttcgtgaatataatcgtaccatatatagtcttccatgttagtataattttgcacgagctcacaataaaagcctcccatcgcctaattaagaatataaatttttaataaatacaaataagtgagaaatagtaaatgaaatgcaccaaagaccgaaacctaattgcagcgtaaccatcgtttctcagatacaaacaaaaaaatagtaatagaactgttagaagtagttgcaacgtacgcaggggacatactttctcatttggctttggacgcttacatggatagaccgtacacactacactacacatcacaaagattttactccaaccaccaacctcattggccgtcattctccccaccgtcacagccatgtaacccttccactatccgcagcggtggaaaggtcgtcacggggagaggcacgtgcagcgcatgtgcacactaagaagtgttgtacgttaacgacatgtatacccctgagaagaacgtgagaagaccgaaatacccttttggacgtacaaatgtacaagtgtttgaagcggagaatggagatggaaacggaagtttcgtgtttccatgaacagtgagtgacttacgttgtccacatgggtgcgggtccttttgtttttttatgctgttgctccaaaccagtagtgtactactcctccacttccactgtaattaccctcttctttctctgcagcttctctgtttatcttaatctaacacacacacacacacacgccccaagccttcttctgttctgcttccattccagtaaagttttgatttttctagcctccccattcttcttcttcctctgggttttcacttgttggattttcttactgtctttcattttcgatggataaccaggatcaaagaagaactcacactgcaggtgctttttcttttgcattttctctttaaagggtcactgccctcatcctcatccccttttttctcccttttcttcttcttctctctcttttcctttccatgtttcattattatattatttctctttctgggttttgttggttcggtgtttttcttatgaaaagtctttgtctttctggggtgtctggttttggaaattgtgtctgtgttcttttgaagtgttttaagtttctccaggtgaagatttttatggtcttattattttttttttgttgaaaaatttgatgttgaaggacacgagagtcatggagttcatttgtgtcacaaatgtggatggccatttccaaatccacatccgagtgccaagcacaggcgtgctcacaagaagatctgtggaaccattgaaggttacaaactgtctgcctccgagggacaaccccatttgaatggctcagatgatgaacatgtttctgatgatgatcacaaaacaccaggtggatttccttcttatatgtagtgtgttaactttaatactgagaaatactaggagatgaagtaaatcttactaactttgatgctgagaaatactagaaaatgaagtaaatctaactgatcttgacttagtgagattaattttaattacttttcttcatgtatagactttgaaattagtactacattccaaaacaaaaggtttttctgattcgttgctattttattaggtttggttgtgtcaggtccaaaatccttggagacaggcaacaatgagaagggcaatgaaggaaatggagaaaaattaattagatcagaagatgaggtgttttcggatgcagttgcagactttttggaaagtggatcgaatccagaaattaaggaacggttgcaagataatttggactcaggtgctaatgtggaaagggttgacataaaagaaacaaaattttcagggtctactgaggacaaagatttcaatggtgcgaagataggttttagtgttttacatcatatttccttttattaaattgccttgttagttttttcaacgagtatggacttgtgtgcggtaaaacattttggcctggttaattaaaaataatgataattatgtttttgcatgatttacaggtattaagcttgatgattgcaaaaaaatctctaaagcagtttattgacttaatttgtatacgttgattggattgctcaactgatgaaagcaaaatttgcatcttttcacatgactgctacatgatgaacatcaataaactaaacgtgcactattcgtcttgctttgttttgttcaatgaaatttaacttgagtattatttgcttgttagaaacttttgaaaaatcagatatgttataaactatacctttttaagttaacttctgttgtaaaattatattaaaaggggggaaaatcagatatgttgttttgatttttattgatgcaaatatccaggatagcacaagtatattgatgcgcacacatgacataacctacataattattttctaagaaattattgaataggcattttttatgacaatatctcccttttactgtgttctttgtttcttctctgtggttctttcatgtctgattatctgtttcacagctgcagatgcacgtcagttaactgacaagtcaactgatgacagccaaattcaaaattctaatatttttcaaaatgaaagtgttgaagtgggaaccgcggtggagtttcaaggtcaattgtcaggccctactgtggacccattgtcaagttccattgcagacttgaggactgaggaatcaactattgtggatagtgatgttttttttggtttgtcaagtgactcacttcttggtgaaactgaagccatgcctgatatattgccagaaaagaaaatccatgctgctgagaatgtgacagattgcagtttgatatctgttgcaaaggaaactaattttaaagaaaaggatgagattaattctgctgtagatgtggttgaaattgtggaatcatctgataatgttgtcggcgaagcatgtgaaggagtgtctaaaatagcagttagtgatgcagtttccttggatcatcaagtgggtgatggagctgttcatctgaaggaaaataatggtgctgagcttaattcctacagagatgtggttgaaattgtggaatcatctgataaagttgtaggtgaaacgagtgaagaagtgtctaaaatagcagttagtggtgtagtttccttggatcatcaagtgggtgatggagctgttcatctgaaggaaaagaatggtgctgagttcctttctttgttgcccccagataaccttcctcttgagttaaactcagttgtaatgacaaatgatgctcagggagactctgcatgtatgatacagtttgctacttccagtgataacaaaaatttgcaggaaaagggagaaggaaatgttaatgttaatcctcttcctacatgtgatgatagatctgatgaagtgcatcctcagagtgagtatggagactttaaagatcttgaaggagtggtataccaaaatcctttcctacaatcatctgagtcattgaaatatgagggagatgacttgaaggacaaaattactgaggaaaataaatttcatttcaacgcaaaccaattgagtgaaaaaagtgacatcctctctccagatatggatgttatagataatagcatgaagatggagctggtcaacagggagcctacgcctaaagaaatgcatgccgaagagtgtaccaaagtttctccagccaagctcacagttgaatgtcatcaaagatcagatgacattgatgcctcaatgaatgctaccaaaactgagacaaatgaaattcgtatggttcacctttctgaagagcatggatctgatgatgtgtgtaaaaattcccagcagataagtttaccagaaggtagtttaatggcctcttctaacgagagtcagagggatgaatcctttagtgaaacaactagggcaattaacatagacagcacaagtcatcatgaggtaaaaataactgaaataaatgatgtagcttcagatggcaaggttgtaggatctaatgtagaaaatgatattgaaattatattgaaagatcttcaacccagtgacatcttgcaatctgaagtcaaacaatcaaatgccttatttaagagtgacagcactggtaagagtgatgctgctggtgaaatgggtaaaaatgaacatgatattcctgatgctcaatgcatggaaaggtccattgtgagcgatacttcattgcccaaatctgctaccagtcattttgaaagcccagctatttcagagtctttagacattgtggatgatgggcctgtgaacaagtcaaatggtacagagtgcagaaatataaatccactaccaggtgcccagaaagacataaaagaagatgaagtctatattaatatcaaactaaatgaagaatataacaagtctgttgatacttctaccaagtcacatcaagcacaagatgctggactattagtgaaggctgcagaagaccttgctagggagtatacatctcctttaactactgaaccttctgctcagcctgacagggaagtgtctggacttactgcagtgcctgttcaagatcaagctggtaataacttgggtaaacttggttcatccagagttgatgcttcagttgactcaggtagccggtgtgacagtttggaaggcaactggggctctttttcaggtatatatacatttgttgtttttaatagaaaacatttgtactgtcttgatacattctatagtagggctattgtaatatgctagggttagtcaatgaaaccaggtaatgtgatgcagtgcttgttaaagagaagttatctgtagatccaggtgctatactgcaatattacccacttttcatagttgattagaatgggtgagatctttttgcataaacttattctcaccaaagacacatacatactggctattatacctgtgtgcaattgtgcatccctgaatcttgcctggggctgaaatttccaaatgagtttcgttggtaatgatttttgcatgcttgcgaagatgcatgcctagatcttgtctcttaatgtttttcaccaattatattcacctgttgctttggcgtgatccatatagttttctctctcatcctttctaggattgtttttctttgtataaaggtggagaggaaagtcgaaagaggatccatctcttttgttgtgtccttgccttgcattatttgtataaagaaattaaactaaaatattttaatggttttttggaagaaaaatttgttttactttttgtttcatgatccgtgaaacagttctgtcaatgcaatccgatgcaacagctgttattgatgctgaaaccttgccatcaactggcttgctggcatcaacagaagcagggaaatcaaacttcaacaactcaaaagctacacctgacacacagcaatctggaaaatcagaaatgtttgaagcaccatctttaatgacattggttgatcctagtcaggttagcccaaaagccactgcttctgaagtccagaagggacagaaaacacgacagccagattccacttcacaggctgcttggtttcccactcttacacaagttgtcaatgagtctcaagggagaaagaagaatgaagaaataatagccaaggtgacaaactggagcactagtaaggagcacactcctcttaagagccacttaggtgaggctgcccatagcagcaacccaagatctccaaaaatggaagaaaactcagtgagtcagaagagtggtaaagttctggaaaagaatggttctgggttgacaactgttaattccattctgggtcctgaatcccctgtggctcaagtggtaaaaggagaggctgcaaaagaatggaactctccagcaagatatcctgctgacatcaagagagaaaaaaggaaagttaagagcagaccatactggatacaattggtatgctgcacatctgtcggtcctcagcgaaggtagaaaattactaggttctgataatgcttccactctgatggattctggtcattgacatgctatttacagtatttttctgtttttagtttgtctttaggtgcatattttgatcatgtgtcttctgttcattttggtagcctcctaggagttttgttgtatatgttgaccatcttcagttattattttatccctgcaatcatacatttttactatatatagtaacgtatcattattttggcctggacccatattttagtccggacttagttcttgaattttttttgtcccaagggtggggaaatatggtctttgtctgagattatgtctcataataactaacttgcggtttctgccttttacattggattcattcttgttaaatcctttgataatagaagccctaaggagagaaatgggtttgagagattctgctttaaggatatctcattaatgcctgtataagtagactcaatcatgcatgtgtgtatgaagaaggaatttactttcagaaatagttgttaaaggcgggagtataaattgactctcaaaaaagttcaatgaccataaacatgtggatcaattagtggacgatttgatttatttttagttaatcggtggtctcaaatttttagaacgtagatatgttaaaattcagtagggaggaatctcgtcgcattgtggtattacccgagctttaataagttagacttaaggaagacattcaattgatatatcatattttaagtctttgattttaagtcaagtagattgtgtattttatttctgtcacgggaagtagtataccttttgaaaagagaagaagagatacggattaaggagtagaaaaggagcaaagtgcattgcaagaaatcgaacatgcgctctcagtatattgtaattattctagttttttaaagtatctattatgctaatgaataaggatacgttgtttgcacattaaaatttaatttatgttagtcactaaatatgcaatatatttataattaaatttattcatttttttattttacatatgtgagtgtaggctgaaaaaatatttgtaaataaaaatcttattaatgatgattaattagattttgtcataatatcattacttcgatgatgtgattttaaaataagtaacattgacttggattttgtataatctaatcatgtaacactatgtggattatataatcatatcaattaatcattttctttttgcaatttaaatttgaagacctaatagaaaattttatattttatattttgtttttaatttagtattttattaaaaaaaatcactttatctttaatctttctaattcaataactaatttgtggtgtccatggtgaaaacattagtgggtgcacgcctagaagcaatatattttcttcgaatttcgaatcgcgttgttgctgctactgtttactttctcctccacttcctgggagagtggtaggaaaaaccaatgttattaaaatggtctagatgagaattgttgtctaggtcagtccgggctggtatttggatcgcttatgtatgctgtccagtatcgctcgcgttgacctgggttgagctcaccttttttttttcctttcttgaaacagttttgtttctcatattctccaaccatgctttccgacaagggtcatgtggctcaatgtaaacactcattttccaataagaaatcaaaagaattcactgtcaattcaaatgaagaaaataaatttgttttgaaaggatattaatcgctacgattcgaagagagaactattactttttatgaatacagcaaggaagattttgggttaggaatataataatccaatttcgaaatcaaataatgccttatttataaaagttgaaatattttgaaaaaaaattcaaaatatttcaaaaggtacacaaataaataaaacaattctgaagcttgttgtataatttaatttctaattaagtccaattctcataaataaaaagtgatacacaaaaaaaatacagataatagactaacattttaaaaaatgcatttctttagtattaaaatttgaataaaaaaagacaacttttggcaaagacatggttcaaagacatttttctcaattgcataaacattactataaccactgagctaaagtctttagtcaataattatataacaaatttaacttttatagagtatcaacacataaaatttatgtttttaatatacattgatttattgggttcaactaatgtttatcatgataatgcttttaaatttggaatatagacttgtgttgttaaaaactctattgttatttgatatattagataatttatcctaataataattttaaatttagaatatggattaatcaaagaatgttaactataaatttttaatatatataagatcaaaccaaaccaattggtgattactggtttgaccattgatccattaatctagattttcgatcagaccgatgactaatttgattttcacaacattgggaaaaacatcaaaatgttgttaactccttctccgcatggttgactttgacttgctcctcccaagtgagttatcagaaaagtagcttctttgtggttttgtgtggggaagctcaaggtatgaagacattcatatttaggaagttagagattaattaacatttaataaattattaaattaaaaaccaaaatataaaatttgttattatgtccttagttttgaattgcaaaaaaataaaataaactttattggttgatgtgactatatattccacatgacattacatgattagactatacaaaatacacattatgtgacttattttaaagtcacatggaagtaatgaccttgtcaaaaataacaaactaatgaatattcttagtcaatacattgataacacaaatgttagaagagtactgtcatattttttaacactctttgtaacacattttcttctattaattgaaatccatgtctcattaatttaaaaatgagacttaacgagaaaaatgaaacctatgtattaattgagctctataaatttcatttaataagaaacaatgcatcataaagaaaatgtatattacaaacatttttatgaatgttagtaggttggaggcatactaacaatcaacaatgttttccccctctaaaataacgataatatagtatcaattttatagtagagctgacaaaatgaacgagttagttctatccaatccattggaccaaacgtgaaaaataggttggatgaagcttacccatattttatatggtattcctttttttatagtccaataaggcccaatgacctattagactagcccatattggtgcatttatttatttttttacctaaatttataaaaatctaaaataaaaattttaaaagtataaagttaaaataagtccaattaaaatatgtaacttatatttcttaagttcagcctaatctaatagacccaattatattagtaccaatgggctgatttgtaagtaagtttttgtcttaagttaaaaaatatttttctaaataatttaaaataatgacacatgtactgcgactttcacgttatcaacgtgacactccaaccaactaaactaataggtcaattatgctaaaattcaattaatattgataaatataacattaattttttaatgtatatttaatacacatataagtttatataataaattttgtaacaattaattttgatctaataattaaagtattttttacatataaaaatcatagatttaaataaaaatcataagtttaataaaaatttacaggtttaataaactgtaaatacaaatatattttttaatttaacatgtaaatacaaatataatttttattagacctgcaaattttattaaaattatgatttttatttaaaactgtgatttttatatgtaaaaaaaatactttaatcattagatcaaaattaattattacaaaatttattatgtaaacttatacgtgtattaaatatacattaaaaaatttaatattatatgtatcaacattaattgacttttagcataattgacctattaccttaattggttggagcatgttaataacatgaagatagcaggtttgaaacttacgtgtgctcttattttaaattatttgaaaaaatattttttaacttaaaaaaaaaccttaaaaccttaaggattagcaaatccttatatttgaagcctgtaataaagcggtgtataaagtttttcccttcattaagttggccctttttgaataggtagtaggtacccagcgggccaggcccagccgtggcgcgtagggctgagtcaaagtctagaaacccaaaccctatcacccaactccgcaaccattgaccgaaccacttccaccagcagcgaagtgagtgagtctcctcaactcaacaatggtagctgcaaaaccaaagtagacaactttagaagctgcaaaaccataatagacaacccaagaaccccttctttagtgtttgatgtcttgtttgttaacttaatgcaatccctcaagtcacaccctgctcttttattttccctttccaatcacttctcttcttactctgtcagatcctttctctcttctttgtcaacccaatgtcaacactcaaggaaagcacttccattgttgattatctaaatgccaagttcgaattctcgagaactcaatccttctacatctctagacatgtttcaatcagcagattcccacaaaatccattgtttgtgctcagtttttttttttcaaacaaattggattttctgaagcccagattctgtttttgatccgtcacaaaccccagatattgttcattgatgttgacaaatcttgaggcccaaaattgagctctttcagctgttgggtgtgagccttcggagttgtgcaagttcatttccaagaattcctccattttgacttttagtttgaagaaaacattggtcccttctgtggaagctattaggaaaattctctgcagtgagaaagattttattcatgttttgctcagatgtggcatgaaaggtatcaggctcagatagaaaagcagcaaggaagacgcaagtatacaaggatgaaagaaaagaatgaagagaaaatattataagtggagaattatacatggtagatgagtgaaaatgaggtaattggtgtattttgcctaaacaacaagcttcacaaacagaggaagctgaagattgtttttgaactatagaaggaagattacatttgtttaatacatttctaacaacattagggccagcatggcctaatcttttgtgccatagatcaaaggaattacatgcagaaaacagggcaatgggtgagttttgaactgaagattgtgaatttagatggacattggtgaactgatagaggtcatctttaagagtgcccttgagaacaattttcttgctgacctgagattttacaaaacaatgattaggatgaaattcaaagaaaacattgttatccttggcaaattgggagacacttattaaattcttggtaatggaaggcacatgtaaaagattagcaagtttaaaaatagtgggtgagtgagaagttgtgaaagaagaatgaccaacatgttgtataggcatacatgcaccattgccaacatgaacctgatcaaaaccattgtattcagaaccagatgagagattaccaaagtcatgcgtgagatgatgagtagttccagagtcaggataccaagctgtgtcaatgagagatgcgggacctgctagataggatgtgggatggtgaaaagaaggaggtggaggtggaggtggagttctctgattctgattttgaggatactgttgctgaggtccttgaggggtgtttagatatgtggtgtcatagcggtagaagcatcttaatgcaggatgaccatgtttaccacaaatttgacattgtaatcgagtttgattccaaaaagaacctttgtttctattacctctgaaggtacgatcccctctacctctgcgtccacctgagaaacgacctccaggataatcttgtgcagtgtttcgttggctgaagttggcttgaacaggggtaatctctgttttcttgaaacggtcaagcatattttcttgagccaataggaatgcttccaattcaattatagagaaaggaggagatctggacatggcagatgtgattagaggagcatactcttcacttaatccatcaaggatagcctcagagtgttctgcatcagtgagaggagctccaacagctcctaaggagtcaactattttcttgatttggagaagatattctgaagctgagcctttctttttgatagactttagttgatttttgagttgcttgacctttgcctgtgtgtgtgaagaaaaataagtctagagctttgtccagatttcatgagcaaaattgcatcctaccattctgtttttgaatgccatgttcattgatgagaggagccaagaacaagaaggttatcttgttgatgccagtgggtgtatgctgtattttccattatgctttcttggttttctaatgtctgtgcagggactttgtctttatcaagatggtcttgaagattgtgaccatgaatggaggctaaggcaagttgctgccatggcagaaagctctcttcatccagtttgtctgcaattgggattgaaaaagatttcatgatgatttttgttgctggtgtgctcatgttgcttgtctcagaccgaggagaatcaaggatggagtccatggatcgtagatgtgctctgataacatgaaaggtattaggctcacatagaaaagcagcaaggaagacgcaagtatacaaggatgaaagaaaagaatgaagagaaaatattattgatcaataataatctttgtacatgagaaagatatatatatatatatatatatatatatatatatatatatatatatatatatatatatatactcccaaagtacaaaaaaattatggccaatgttgtcttcttggagagctgtggcattgttgggtctcatcttgcaatgctactcaaacaacagccaagtattctcatcacacagcagtctactataggaaactatgtttcgcgcactgtaggcatgggtttccatgaaaattcaagaatgcttgtccatgtaatccattcaataagtagtttgagctataaaacatttaggagaaagctggagctaattatttgtttcgatttttccaatgaggaaggcctgcaatgtttagaagatcccccaactttgcttagaacatcagggaagaagttgaaggttggaatggaattcttcttgcatacacttatgatgcccaagtcagtcctggttcatcagccaagggttttaatgtatagcatgaaggatcgcgtgcttccccgatatagagtcttccagctctcgataaaaaaaaaaaaaaaaactttgcaggaaggttcccaggtatatttatttgttgtgcttgtctgaggaggtgttcttggacaagtatatatcacagtccagagaaaaggcagaggaattattagtagcatacaaggttcattatctggaagcatagtcatatcttcaaattctgtttctgaatattctttacaggaagccttgggcaatttcgggaccacaaaccatgttggtgcttatggttttcacctccttcagttatcccctcacccttccaattgcaatgagatatatgttctgatggcaacagattcttctccctagttttcttctgtttctccaatttgctctacacttctgagtctgcaatccattgtcaattatcacagtgacaaaatggtggcaaatatgcatttaatatttaaatagaagtgtacctgttttagcaacaaaaagtgtttacttacattaccattttgtaattgctcattttcacaaaacgctacaataaatatttatgagaattactcataatgtgtcgttctgttaatttgtacctttttcatatatgctcgtagtcaaggttttaaaaaacagtccatgaccacaatttcagtcacaacttcaaagttttcgggggtgtctgtgactgtaattgctattgcaatgactgtatttctccacaatttccagcaatatcaagaaacgtgatgaaatcacaacctgtatttaaaacttcaatctagtcagaggctacagcagggtagtagtgatggctttcaccaacagacattttaccctgttgatgtttcctccattttgattttaatcattttttaagtcggttcgatatagtcttccctgcaccatttgttacttctctctctccctcttctttttttccttggggagaacattttactacttctattatgttggatggagacatggagttgtaagagccgaacttcttttcaggtcaaacaatgatagttatgacttatgaatatttttgcagacggctttagtcctatcattatcaacagggaagttgtctgaattttcagcatattttaaccattgcaatcaaacgttgacctttgcaaactgagcttatatttcaattcagtacgaaaatgtttcaattttaataagaaacctttactggggttcaaatcttgatgagtttatgggaatttttttgcctaatcaatacgacctatatgaggatttgtaagcctttgaagacatttagtcaacaaatttctaagtgatttttgtcatacgcgtaaaatcaccagatctatatagagattttataggaaagttcgattaatgtttttgatacggaattaaaatcaacatgtataagtataacatagaaaagtgtttgtaatattttaactaggcatcaacttgagctcgaaaatacatgtatgaatcgccttacaatgattgaatcgaacaaccaaaaaaataaacaaatatggatctgtcaaacagaataaagaattacgtcaacgctcctcgccgccacaacctcttggactctgcttgtggtggcaccaccatggtagtggtggtcgtgcttgtcggagaaggatggagggtggtagtacttacggcctgtttgggggcaattagagtgaaaccttgcagcaatccggaccccttggtcaagaatctcaaccagcttccccatgcagctattcttcaaaactcaaaaaaccattcaccctcttttctattcttctctcagaatttcttagaggggagaaaagagaaagggtgtgttacatgaagacaagagacatgaaaatggaaaaagagagattcttgattgttgattgttgtgttatgggaaaaaccagagtggattgacgtatatatagctggtgccttgccatttccactttctgcctttctgaggcagtgccgtttcttagtattttctttttttaatattattgtcgacttgttcggtcagaaccgcgtttcacatcatgcatatgtttgtgcatcctatatttgactaattatttgtcttttgatttttcttttcttttaaaacattgtatactttttaattttttttattgctttgttttatcgtaattaaggggggagaaattgaaaaaatagattgggtcaccgccaagcagctgacttaattttgaaaataaaaatggttaaatataatctgttactctataggtcatcttgaagattttttaacgtttagcacgacttttttgaaaatttggtcaatctgaattctaatttaaatgcttatttaatagttttataattccttctaaattaaaaatagtatttgaatttttttttcctaaacgcacgtgtcttctgacctattgagtttagaaattaatataactagttaatctaattcaaaagaatttttcacgtatcaaataaattgttttatcaataatatggatattgtgaaaccttacattattgtattagtcttatgtgttaaattatttgagctgaagtagattaatttagattacgtattatttatagttttagaataattattcctaattatttattaaaactataatatttgagtttataatggttaaaatcaaaagtattttcaaaattaaaaagagaagaagagagaaacagtaatagtgtgcattgatttcaaaagatatatctaatgtaatatacaaccttatatagtattgcttctaatatttaattaagaattgaatacgaaattatgaactaactaatcataaaaaaggactacaatcataaaataaaataaaaaatgaacgaagtcagttaattagcttgacttttaatgaaagagtactataaatttacgtgtttatttgttattattagtatataatgtaatatgtgtggaaaaatataaaaaagaaaaggttttctttagtggtgtattatttggagtccataaaattaacatgacaagaacttatgttaaaatatggatgttagtctttttcgtcaactctaatataagagcacaaattttatccaagctatttatcaaattgtatatacttatttatctattagaaataaattatttataagtaatgaattatgtagaagagttattatgtcattataataatatttacaatcaagtatccgaaatttttgttttttattttgcatgtccctccttatattcttttcgtaaagggtagatgtaatccaatgcaaaagattataaaatctatctttattatgtcgattttgatttcaatcaactctaaattttgataagtgcatatgattttttattcaaaaacataatactatgattatatatattttttgtgaagtaaatatattagcataagccacaaaatatgttataaaaagaagaaaaaaaaataagaactgaaaacctaaaaaagaaaatgaagaaatacaagctgattctgccataaggcgttaacaggaaagttatgaacaacatcaccacgcttggcaaaaatatcagcaatttgatttgcttttctataaacatgatttcacaacttgacatattgatgaatattatgaatagacatcaccaaattatagcaagaatagaaatcaccgcaacctttagaaagaaattaatggcattgtagtcaaagtaagcaactagcttttgaaattttacactctaagccagctttaacccatgtcaaatattccatagctgtgactctaaaatagaacaagaacctaaattaattgcgtaacaaaacaagaagacacggtctctgttaatatactcttccgttccaaaataataatttctttatagctttttgttcttattccaaaataatagtttcttaaaattaattttctaaaaatatgcctggatagtgtaattaagaagatccattaatatttgcattaaaaagagatatatatcataaaaataagtaataagtagtagaatgtattttttattggtggataatgagatgatttatgataaaaaatagttgaaaaattaagcgtattttatctaaatttctatcaattcaatattttttaatcagtatgtcgtaaccttaaaagactataattttggaatggaaagagtatgtcgtaatcttaaaagactataattttggaatggaaagaggacatgtgttattttttgtataagtaggttaaagaatataataaaatgaaaattaataaaatattcttacgcggtttctagaaagttacatgcatcagtataaaataaaaataaaaattatatgcaccaacctatttaaaagtaaataaataataggaggatactttagtggcttccggtaagccacacaccaaaccactaaaaaaaggagagagaagaaagtcaggaacacgaaccttatataatacacaaagcacgtcaaaatgtgcctttcctttcccttcataacccaaaccctaacgccgttggttcttcccgccggcaaccatttcagtggcttcttccgccgtcgccgctcattgccattcctccattttctgatcaggtccttattctttcgatttcttctatttcgttatctgcggtattctctatacactgtctcgcctttgctttctagttcctactgcgactgtgagtctgtcttcccaatttcccgttcccgggttttgtactactctcgaacgggaaattcaacggagttgtgtttgggaatcgcgttttatcatctcatttctctcgccattcacacacttcttcatttttgcgtttctcttttctgacgctattttgctttcattttcatttaacctaaccgcgtttatttttcttttcgttttcctcagttaattctcgtgtttcttcagagcgagcagaaggatttcagcattggagaccgaatcggggtgagttttaatttcaatgcttctttgttaggtcaaatttgttactcaatttgttttctgttgaaataaacaagtaacgtaatatattgcttttattttgaagtattttttattttgaaagagtaaataatcaaattagtgccaaaatgatacatcagtaatatagaattgtgaaatttacattcacggtccccaaatatgtatttaaagctttttgtttaacttacattggcctcaaagcaactctgttattgctttcttgcttaattgctttggaaagtgcaccagcagggaaccaaacatgctactattcgttgttgaattgatctctcgatatgtgttctgtcagagtcaaattagtctctgagatttgtgatatgaggactgatttgacccaagaaatacacattcaagaacctttaagcataatttctatcattcaggaactgatatgacctacgctatatcattgaaggactaatttgactatttacttaattctttatatggaaaagaaaaatagattttggcacaaaaaaaaaaaaaaaccccaagcctctccaaatggccattatgtttgaatggataaaacaaaattgaagcaaaaattgcattccgtttcctttagtatatctgtaaatgacctcacgatggtttgattttctgtagtttaatattatggtttgcattttttggtttgaccaggaagaatgaggcctacaatgatgcttagggctctaaccaagcagtttcttggaattgtaggcgatgcagcaaacactgtcgctaagaagccacccccgtctcctcctctgctgtcacgcaaaccagcattcattgatgcattcttgtacaagatgaagaagaacccaaatcttttgtcgaacaagaccatttggtcacggagatccactgtcttgccagaatttgttgatacaactgtcaagatttacaatgggaaaaccactattcgttgtaggatcactgaggggaaagtgggtcataagtttggagagtttgctctcaccaggaaacgcaagaccagagaacaagccaatgccaaaaatgttaaacaacttaagaaaaagaagtgattctttttccttttgtatttttggacaaaaaataattttgcggatattttaatttctgcaattatttacatcaatctgttctttcttaggttctctagattgtatttgaagacctaacaattttccctgtgagaatattggcaacaaggattttgatgaaatttgaccgcgattgtagttgaattgcttctttgactatctgaactattcatttcatgttataatttaacttgtggatgatagatcattgattgatcaatttatcctcatcacttgtgaggacctgaattttatcgtagtttgcttatatgctgaatgcccctgcaattgcatagggatgtcatcattatgtgatgtgcctttgtgaccaggaacatgattctggaatgctccactgcaagtaatatgaaagttatgccagtaattttttcatgtagaaacctgaggccgggattgaatgcccggaacacagcataatcattaaatggccaaatataatatgaatctgagaaaaactccacactcaaggttgcttcactaaagttttgcacttgacttataatgcattacttcttaattggtacagaaactggtgtccatacttttagtaaaagtttatcactttccttaccaaataggttctacaatgtcatcatggtaaatccaaaggccattaaatgttatctgtacaatttgacaacaaaatttaaaatagggaatgaaattatgaaaaaatgagatgtaactaataataatttaatagaaattgatagagaaaaataagttataaattattgtgaataagacaactcttaaaagttaaaaaattgaattaattataacgtgttgttatagaacaacattgaatttcaccacatgcatttgacaaccaaaaactaaaaaagaatgttttataaaagagtaatacgctaatcgaagggggttttgtcagcttaaagatcccctaaaccacttaaaaacttttggtttttcaccattgaatgatttaatccaaaaatgacttattgcacagcaatcagtaagcaatccttcatataaaggagatcacattttgagaccggctgttcactgtgggaaaaaaaaagtatttacttcaccaggatgtgtcctgtaacgctaacttcatatacagaattgcaaatattgttgtaattctatcaaattccacaacatcacaaaatgactttaattactctgcaacctagtgtgatcaaactaccctcatttgctttgttgctgtcacagacgtagctctcaacttacatttcattatcctttctttctgcaacacccgaggtccgtttggttggagagaaaatagaaggaaagaaatcagaagaaaataaaatacgattatcgaaacattttcttctgtttgtttgaagagaaaatgggaagaaaagttattttttagttacaaaaattttaatttttccttcatttcatttttctttcgattcaaattttaaaattttctttccattttctttccttctatttttttccttcctaaccaaacatagggccaaactctatgagtccgtttggtcggagagaaaatagaaggaaagaaatcgaaaggaaagaaaacacaattaacaaaacattttcttctgtttgtttggagagaaaatggaaagaaaaattattttttaattacaaaaatttaaatttttccttccttccattttccttccgattcaaattttaaaattttccttccattttccttccttccatttttttccttcctaaccaaacatagggtatactttcgatgcctttatttctccacgaacaaaatccgaccatagccctaaagaataacatttcacaactttctttattcctcaataggcatgggctacgaccagctctcctttaagaacaaagaaaagaaaataactgaatggaacagcaaaacgtagaatacgtcattggtgcattgtccaaaccaaagtccaaaacccgtaactgtcagtcactactatcaggattggacagccagtctctgcagatgctcgagcctcaaagacaacttgaaggctcacgttgtcagtgaagattacatctgaaccagcagccatctcatgtgcgttattgtatgttgctgagggattcagctttgctaataaaaaaaatctagccttttcaacttcagtgaaacccaactaaggttctcatcaagaaaaatctaaacctaccaagcaaaatggattaatgaaacaattttctgctcatacattatgaaagtggtatttcatacatcagcaacactcacaatactagtaaatttcaggaaaaggaaacaatgtaatacatgtacttacttgagaaccatgttgatcacatactaccaatctaggaacagggaaacgctctccaaatatgatttgagatatacccctgtctccattttaagagatgcaagtctggccattactactgcagcagtctcttggtcatatccttggaccaattcctaaagataaaatatatattctcttttctaataactgcattcttcttaaatgatgaaaatgcattaatggactgaaatacagcagcatgctaaatgacaatatagaaaagcataaccctaaaactattattttttcacatatattcaacaatttttgtggaaggagaaggctgcatacaattaccctccaccatacatccacgatgtgaggagcctctggcatcaggatacattagttttttttatatatatatatatatatatatatatatattcatcaattttcggcttgtccttccttgtttgttgtgggcaatgcagacattgtgtgcaatgcacgcacacttgcttggagacaccattttagttatatattatgccaggcatcctaagtttaagctgtatttgagaaaggaaagagaggcaactttaatttaatcccacacctaggtagtgtgacaggtatgacctcatgtaactacccactgaacaggtggcaaacatggaaagttatggtgggcttcagctaagagggaaaacaaaaagtggtgagaaaggagtaaggacagtatgggagaaccaggcctctcaaattgcctagatatattgtattttcttttctgttctctgaagaggaagtgaggaaaagagtttctacaagtttctctgcaaccgtagtcctctgacatcagcagtagaatttcagtgacaatgcagcactattcagctatttctgctccagttctatcacattacaatatgaccttgccaactatagttatttctatgccaattttgttatacacgaatttttatccaatacttacaaaatgcagtaactgaaacaggtctgtttctattaaatggatataaaaaattggtcattatttattaatcaatttaacaattaaattgtcacaaaaaaatggtcccaaattccatataatataaggtattagccataaaaattcagtttatattatagatgcatgtagaggtaaatcattagataactatgccaaagtttagaatcagaagtgacagcaaggaaagagtcaagagaatattatgataaatgtagaagctacaactatacttttgacaatgagaaataaactaacatttagccacaaatataaaaacaaacaactgaaactacctcagagcaaacagcaacatctacccatcttctagttactatggtgactcgaagcactgattgaccgtttgggctctggtaactgcaatacaacatgatcaatatattcaagtatcagcaaggagggggaaagaggcatgtcaaaaatagttatttaagacaactatataataaagatttaacacaaaaatatttatcaaactaaaataatatcgtgtgacttacaacttcccggtgaaaaatagaatttaaatataaatagattctgatatccaaatcaaattaataaaaataaaataaagaaaaaacttgctcaacttttagttagattcaacgtcaacagtatttttaattcgaagttaactaaaattagtaataaatgaatccaattatagataaaaataggataaagaaagagaaaaaaaatgtaaataagataaaaaagatgaaaaaatttgtttataaatgttagaacataaattatattttttataatttataactatattaataataaaaattattttatttaatatacatatttttagtaattctatttttcaataattattttttaatgattaatccattatttttagttaattaattttttttcttattttatttagcttttaacccttttttttatttatttaaaatatataaagaggcacccctggtcatcataaccacaataatagtaaaaaataaatggaacgaacacgataattctggaaccatcttgacaaccttggattatagaactctctagacacactctcctcttccactcctacctatataaacatgataaccgtaaaccatttcttgtgatcgtgtgagaaatataaaaaaattattttctgtgatcgtgtggttttctgagttctaagaactcacctctttcgtactcatttattcgcttgttgtgggaagccatggacgaagacttcgagttcccaagtgctggcaacatggaaatgcctgaggaggaagagtttgagagtccgatcctgaacgtcggggaggagaaggagattgggaaaatggggctgaagaagaaattgctccaggaaggtgaaggttgggacacccctgacagtggagaccaagttgaagtgcattatactggaaccttgcttgatggaaccaaatttgattccagccgcgataggggcacccccttcaagttcaagctgggccaaggtacgcattcttttttctttcttttgttttgtagaggcggattattgattttatatagagaggatttcaattgatcgactatataaaattctttgctgagtgatattattctttgcttaaaagtgaaaaattgattaggatcaatttagttatgggaggtttgagtaattgatgaagtattaagttgaaattttgttactggtattgtctgtactctgtatgtagatgaataatcattcattgattaaaaaaatagttgttaatgttatatttacatacataataaatcacaaatgtaatcaggatgaaagtcttttaatttatccttatgctggacatgaaaattaaactaaagtgattaatgatgaatgaatgaataactatagtatttaatgttttgtgacttgattaatgcagggcaagtgataaagggatgggatgaaggcatcaaaaccatgaagaaaggtgagaatgccctttttacaatacccccagaattggcttatggagagtctgggtctcctcctactattcccccaaatgcaactctgcagtttgatgtggagttgctatcttggacaagtgtgaaggacatatgcaaggatggaggaatcttgaagaacattattactgaaggggagaaatgggacaatcctaaggacctggatgaagtgtttggtacgaaactctatcctgtattgtctttgagattcatctgtttagcaacactttcagtattgtttaaagtttccttctttctctcttttctgcagttaagtttgaagctaggcttgaagatgggacagtcatttcaaaatctgatggggtggagttcactgtggaagagggtcagtctcatgcttcaaaagtttgaattttgtccttaccgtgtaacttgattctcgttgcaagtaacaataatatgacttttttcttttcttttatcatgcagggtatttttgtcctgctatggccaaggctgtaaaaacaatgaagaagggagaaaaagttctcttgaatgtgaaaccacaatgtgagtaagactgttgttatcagcaatacttatgtctacacgttttgcttgtgcaagtttattgacattcaaagtttttgcagatgcatttggtgagagtggaaggccagcctcaggagatgaaggtgcggtacctccaaatgcttctcttcaagtggatcttgagttggtctcgtggaagaccgtgtctgacattaccaaggatagaaaggttctcaagaagactttgaaggaaggggagggatatgaacgaccaaatgatggagctgtagttcaaggtacagttttattacaatattttcaatcccttctcttcctttcttcatttaaaggttttgtatatactggatgggatgctgaagagtttcattatttcttttgtttcagtgaaactgattggcaagctgcaagatggaactgttttcgttaagaagggctacgatgatgaacagccatttgagttcaaaattgatgaaggtacctctaacaatcatttaaacttcataagtcttgctttttctattactagttactaagttgtatgtttgatcgaccatgtagagcaagtaattgatggacttgaccaagctgtgaagaacatgaagaaaggggaaattgcattgctgatcatacagcctgattatgcttttggcccatctgggtcctctcaggaattggctaatgttcctcctagttccactgtgtactatgaagttgagctgctttcctttgtaaaggtgagaagtgagagaattatcatgtcttcttcgtcttaaactttgaactaatttgaaatgtaaaaccatttactgaaaatgggggtgcaggaaaaggaatcgtgggatctgaatacacaagagaagattgaggcagctgggaagaaaaaggaagaagggaatgttttgtttaaggttggcaaatatgaaagagcttcaaagagatatgaaaaggtatacctataaattccaaaagatcttatttatgtaacttggttactgacggttatgttgtggtaaaaatgaactaacaataggtgttctttttctcttgttgacaggccatgaagtttgtcgagtatgattcctccttcagtgatgaggagaaactgcagactaagacattgaaaatcacatgcaacctcaacaatgcagcctgtaagttgaagctaaaggactacaagcaggcagagaagatgtgcacaaaggttctttgtctgattcagcctaaatttgttctttttccttggctgaaggctaaatatattttcagaacctaaaagatgactgagtctagggtgcgtgagcgaaacaagtttagtgtgatgtgaggtaataatttttttgtcagttgtcaaatgcgtatcgcctacatgctacagtaacagagtcaaggactgcatttttttcgggaaaggtagaaattatttgaatcacctgataaagcaaaagcaaaaaaaaaaaaatgtgaaaaacactgaaaatttaaatagattaattatataaacacaaatagttttattttgtcaaattttatatttttttttgaatttgaatattcacacaaattaattattactaaaaattgaaagttcttttgctttttcaaaaagttaattagtttaataaatagaattttgattatgatgatcattttattatttttttattttattggtaagtctaagatacgttgagattatatactaaaataaaataaatgagacaaataaaagttagatatgaaaacatgagttctgatgaaggaaaagtcaagtacatattattctatttttactaattgctcagtctcttatgttgatggtatactttcttgtttgttaagcttaaaataggaatttgggtcaattgagttgaatgtagggtcatataggttttcgattatgtcaaaagtttataggttttcgattatgtcaaaagtttagaatatatatgaccctgcgtttaatttaattgacccaaattcctattttaagtctaattaacataaaaagagatgaaataattagtaaaatttgtacataatgagagagtgagccaaagtggaacattgtgtgcttggtttttccttcctcctaactcatgtcttcatatttagtttttatttgtctccttgattttattttgttatatgatatgacagtgtcaatgtaagttagacttatcaatagaataagaaaagataataatatgatgatcataatcaaaattctactaattaactttttgaaaaagtaaaataactttcaaacttgtagtaacaattaatttgtgtgaatatttaaatttgaaaaaaaaaagtatacaaatttgacaaaataaaactgtttgtgtttttataatcaagttacttaaattttcagtatttttcacatttttttgttgattttgctttgtccggtgattcaaataaaatttctacctttcccgaaaaattgtagcctgtaggcgatgtccagttatgcgcatttgacaactgaataaaaatcactacctttcccaacatatccgataaccacttcatcatctcatcttgatattgatgagatatttaaatccaacggtctaaattatttttgcatcagacgaaacttttcatttacgcaccctatactccgtcctaagagatttactttctttcctacgatatttatgttgtgttttttgtcctcgtattttatgaatgccttttttttattttttgcttgaagttggattcgattaactccaagcctacatgtgaactgactttgcaagtaagctgacttattagacaatgaaatatagacacgtgttaaaaactcttctacccgtttctctctcctaaagcctcttcttctccctcccgccacctcacttaccctcttcctaaaccatagcctcgccggaccaccaacaccaccgacgagtgcggcaaagtcctggtgttgtcatgattggagatttctgatttgggggctaggatttcaaattgggggtggggatttctgatttgggagggatttggcttggaggtggtacgtatttggttcaggtgtggtgctaatggtggtttaggtgtggtggtgatggttcaggtggtgacttgttttttttttttattattaatttataatttatagcaattaaaaatatcacaaattatgttattgtattttttattttttatataatttgtaatgattggaaacatattttagccttagccttagcgggattcaaaaagggaagagagtgaaaatagttgacatctgacttttgctttatcaagcaggttttagagcttgatagtagaaatgtaaaagcactgtatcggagggcacaagcgtatcttcatcttgtggatttggatctagctgagatggatattaagaaagcccttgagattgagccagacaataggtatgcttttgttctcaagtgttatcaacttgaatatatacagttcatatactttagttctaaataggtaacactgatacatggaatttctttttgtattaaccactgttcgatggatattatcagggatgtcaagatggagtacaaaattttgaagcagaaggtgagagaacataacaagaaggacgcgcagttttacggcagcatatttgcaaaaatgaataaactagaacaagcaagaacagcaacagcaaagcaggagcctgtgccaatgactattgacagcaaagcttaaatttggaagatacctctgtctgcggtcgtctctgcatacaagtaccataatagtacgtattccaattgttgtgtcgtctgaagtcttggtcacataaatagctttctcatatcttgtgtgattttcatatgaagaaatgcatatggtctaggttgtcagttgtctactgatggctcataagcatattttcatatgaagtacgtattcaagctatgtatactgatggctaataagaaatgaagtgaagcaagttttggcaattctaaatgtctccttgttccctgaatcactgagattttcaattatagtttagtttatgttattgtttattaaacaaaggattcggtgtcaagaattttctaaaattgcaatgcaatcaactacgctgacacggcaagccctcgtagctacgtatcatatatttttctccaggacttgataataggtattcaaaaatttaggaggcagcttgagtaacatactataggctcttttcgctactctaagcctagtttgtaaacaaattattagctccttcttcttctaccgctacaaaatcagaatgcaaccgtcttgtctaccacagaagtcatatacagggcttttgcgatcacatcacgagacgaagtggttttatgtgaaacttttcgaagaccaaggtgtgaggaaatttaggtcatcttcaatgggtattttggagagaattttaaggggaagattttgttctttcaaacattctcaaaatcttcatatattagaggtttgattcttataagataacttcgaaaatctctatgctttttaagaaaatcaattattattattctctttccctaaataattctggcaaaaagatgggaagaaatagatcaacaaaaaggaagaagggaatagatcaacaacaaccatgaacagtccagaaaaaagttgagtacataataatttaattttaaaataaaacacataacaataaaataatcacaaccgtgacaacttcgggagaaaaaaggacattgggttggtgtggatcaacaaccacaaggaatattgaatagtccagaagaaagtacataataatataattttaaaacaaaatacataataaaataattcaacagtgcatagagacatggtggttgattcgtgatggccgaagacgattccatggcctgatcggaagttccagagcaccgcgagaaatgtggattgaaggggacatagcgaagtgtgtgggaaagaaaatagaaataaaaaaagaaaaagaaattatattgataaataaatattttaattaaaaataaattttgtattttagttataaatttttaaaaataaaaaattatataattaattgtttttaattattttaaaataattataaataaatattaaaagatgagttttttttagattttcaaaaaagtttaagatcttaaaataatagttaccattaaagtaaaaaatttaaaagatgacaccataagatccaaaaaaagattattaaaatctcaaaatcaaattgataaaagactaaacagtatttttttattataatagaaaaagactgaacaatttattagcttcaagtcttccattttgagtcaagtgttaatctacgtagaatttgagtaaacaatttaataacacgtagcctcccaaacataataaatttggccgtttagcaaagcaataaacaagttctcctggatttctagcgacaatgctgttgtgctcaaattcttgcggaacatttctatgatcttccaccatgggatttgattttcctcacattttcaagctcctttcttgtacccgatagtctctgcaatgcatttctttcttcaacctcaacccgttccttcgaaactgctttctactgttgagcttcatccataaaatgctctgccgctgaaattttggaagtaggggccaccttattccgatgagcttcgagaactgtcttctcatcatttatagcaaaggtttgctggatggaatatataatgcatttctttcttcaacctcatctttaaaggaaggtcggacaaaagttaaaagcagccaaaaggcaaaagctgcatatgaaacgtggatcaggtcctccttataacaggcaaagtccttctgaactaagagcccaatcataatcgcaagcaaatatacatgtagtatccactgtcgccattaccaggttgattagatttatatgttctctagtcacaaattcctttgtccattattataatgccattcaaataccctagtatttctgaagcaggttagatctcatggagtttctactctctgcttatccaacttcaaatttcttgaggaacgggatccccatgttgttcattgaacttaatatttagctttgttttccttcccaacggatttgtaaaaatgcacagctgcactcatgatgaacctgtcgccttttgttgattcacaaatactttaaaaaaagttgattccttcttccacatatccacatttcaggtaaccattcggcattgttcggtaacatacaagatcaggaactaaaccaaaagtttatatatagatcctcataaaccctcttggcttaatcaatcaatccagcttttatgaaggcgtggagtaaaatattaaaatggacacaagacagtggaatgcctttgctttgcatagcatgtatggtttcctcggctttagaataattcaggctccttgtatatgcttggagaagggagagatatgtgaaagaatcaggcaaataaccttgcctctgcatggcctggaaaagtttctccatttgatgaagaactccagcattagcatatacattgatcatgatattataggactttggttaaatgaaaaactatttttctttaaaggaaatacatgtttatcaaaaatctcaacagatgtaaaggtaacattaattttttttttaaatatcaaaatgagtattttgaaaataaaaaattaaattgaataatttaaataaagaatatacaaaaaaaaatatttaacctgtaacatatttttttacgcaaaaggtaattatgtcatttcatccatgataaaagtgttaatacaaataggaataaattcaaaaacatggtggtggttaaaatacagtcgtgatagccttgcgagagaatgaggaacccgatttgcttgtgttcggattaaacgcacctcaaggttatgaaactcaagaagcttttgtctgcatctgtgaataatctgcacgtcttagctttgaattatcgggtgataaggataaataggagtcaacaacttgtttgcaatgaagctctataatatgagtatatgacgttttgcaaattcaattcattctaattttaatcaaacttaattttagtcccgataattttaaaatcaatcaatttaatcttataataaatttaatccttatgcatcgatttgttgaggaattaaacaaaagttaaattcacctattttttaaaaatatagaaatcaaattgattgatttaaatgacacgaactaaaatcaaatttttaatgattaaaaacctattttaaatcttgtaatccatatctatatattaatacattttattgcatgatttttactttcttttttatctccacgagatataaacatttaccaaatgtaatcacttatgttcatacactttcacatatctttgtgatacatttaatttatataaaacttatgtaccaagaaagaagaaaatacatctttgtaataaaagcaattgaggtaattttacctaattagaaaattatggtagtaattgccttttgtcattcttcctcatcagtcatcccctttactggctcaggaatggggctcgtgtaccccttggaattggctgagtattgttgaacatagccatgcacgtctctatagcctttttcagttagaattaacaatcgtgataataaattaatcattagtagtattaatgattggtttgtttttacagaaagtattaataattaggctagaattacaagttacaagtagcaaaaactacaaatattactcctttttccacctgatttatctctttcgtattaaaattcacctaatttatttctttcgtattaatacgaactttgttataaagtaatcattcatcacaagagtgaggcagaatacaaatgacatgcaaaattttactctaactttatatttgatagtttataggtcaaccattggatgaaacacaaaagatacgagaaaagacacgaaaaataccaccacaacaaaaagcttgagcggagtctatatatacacgaaaaaagtcatctacttattttattatttactctatctcataattatttttaaaatctgtaccatcctaatcaccgattgacctaataaggacagcaacggtcaacgctttagtcttatctcaaagtcatgtttatggtactggtacaaacctacttaggtggtagccgtcgagatctaaggtaacgactagatgataatgtgtggatagtcacgcatgggaatatcagaattaatgaccctagacacgataagggatataatgtggaattgaactcagacgaaagtaggttacacatgtacacttaaatgttctaactagttcgttcaattctagttctacgaacgatttatattggaataaaattaaacatgaaataagtattatacattattaatatttatctctcaacaacaaatctaatgcatgcttttctctcaaatgtatttattgttgtgaaagtatgagctcatatcaatttttaaaactttgatctcaattgtatgcaaactgcatgtggagtatacgtggaagcctctcagattagtgcgagcctatgtgtcagtttgtcgaaaccacaccaagccaactattttacgcttggcacactcgatcatgactagattcgttattgctcctgtgcactgtgctgactctctctctcgcattgccctatatcaatcatatcaccaacacaactcgattacgatgtgatctgctcccaaacctaacctaacaacaaaagcgcacacacacacacaccacaccaacaactcgaatacggcaataacattgaacaaactaaaaagaaaaaagcaatctcatttccgtccaaaactcgcatccgaatcgcgacacgcacgcggttttcgtttccccatgccattcaccttctctcggttagtttttcatgcgtatccaaacacctatttctccctttatataaacgacaccgtatatgcaactccatcatcgttctaaattaattctaacaggttcggcataattgagcgatcgatgacggcgttgataaggtcaccggcggtgacactggcgatcctgacgatctcggcatgcatcgcgtgtacggcgtcgtacgggggattggtcgggggaaggtcgaagatccctgacgtgaaggcgaacaaggaggtgcaggatttagggcggttctcggtggaggagcataaccggatgctgaggcaggcgcagaaggaggaggaggaagtcacgttcgtggaagtggtggaggcgcaacaacaagtggtgtctgggatcaagtactacatgaagatattgaccacgcagggtggcgacgttggagattccagaatattcgaatccgttgtggtggtgaagccgtggcttggttccaagcagcttctcaacttcgctccttccactcagtgaaatatgatcaatttcggttccctttcaactactattatttaactcataataacatgcttaatttgtttattatgctttaatccttctaatcgtagtaataccaatacatcttgtgaagagagaaataaatgtttgtagtttctgtttcagatatgaataaactagtttgacatatttccattgttttgaatatagagtttctctattttttttttttttaatttactatggacatattttattttagtgaagtgatactttgtacaaatatcatttctctaacttttattatcatttataaacgttaaacaacattaacatgaagtaatagtaagaaaatgcatttgtctcaagaaattagaatgtttgagaatcttaggcgtgtattcaattaagacgtttattttatggacaatctttttgtctcgggaatttatttaatttttcctcataatataacgtgacaatgacaatgttatttttgggttccttatatatgtggtcaaaattttttttagttaattattaaaattgactgtaaatgttttttatattctcataaataaaacacgtctgtttgattgagttattttttcttgagaattatattataattattaaaataaatctcacaatttctaactttgcataaatgttaattaagtttcctatctaacaaccaataaaaaaaactggaatttccgaagtcggtaattttcaatttcttgaaaagttaatcggtcggaaatttttgacaaatatatctgtcggtaaagtcttgggaaattttcagtaaaaaaatttcaacggaaaatacacttgtggatcagtaaaggataccatgaaaattttttacggttatatcggtcagaaatatacttgtgggtcattactgacacatttttcgtgtcagtaacttattttcattaatttctgtgctgaatacatcacagacttttctttcctctcaaaaacagaataaaataaaatagacataagtataataaggatatttatggatagtttattcgttcagattcagagaaatgctgaaatagaaacatatcaatgtatactatgaatatttattttattaaaagtatattaatatgttatttcatttcagcccattacatacacataacacctttcagtatgtaattgagtatctttcacgagtatatataaagagagagattccaatatatgcctattttgcgtgaatgtaattgggcacataggaatgaaagactgtagtaaagaatgaaatttgtggaaagagaaaattatagtatgtaacataaaggagcattgagagggtaggaaggagaatttgcttggatttttattcataaagagattcctatcacaagaaaatgaattttcatagttttacattcaacaatgaacggaataacttttatagatataataatggtattattaggagctgttttagttattgctcaacaaagaaaaatttggtaagacaatgtctcaattggattatggtattattaggaactgttttagttattgctcaacaagatattaagaaaaatttgatctattccaaaatgtctcaattggattatatgaaaatagctttagaatattggatcttatcaagtccgaaattaaatattagttacatgtgaattataacttaacattgaaatgaaatatgtttgaaattaattattttatcacttcataataaataacaaatatgagataaaaaaattataattttttttaccctatatttgtgggattacaaaaattatccgtaaaacaaatgttttcttagcttaggattattttttatgacaactaaattttggttgtattgcattaagatttttattgagtaagaccgcttctccatctgtcattattgaattgctgagaagatatatacaatatcttttggtaaaaaactacaggggatcaaaaaattgtacaaggtataatacttttaatgaaagatataagaagatattttattatttagtcattgagtaaaaactttttttaagaaataaaacttttaatgaaagatataataaggacctcttacaatagtgcaaatagcatttcacatttgagtataaaaagtatttcgtcaacttttcctcttcttcaaatcaaatcgtcctctagccaagtagccatacttttttttttatctaaaaaaaattcaaaataagagatctacaataatttattaattatattttaattttatttaaaaatttaaaactaagagagagacacgttgcgtcttcttttttctcccaatagaaataagaataataaacactaaaaacaaaataatattagaaaaaataagaattattttgaataaatatcattttggttattgaaaatgtgagatcacaataaattggtcattaaaaaataaaaaatttaaatttaatattttatgatagattaatcttataaataatttaataataatttaatattaaattaatttttaaaaatataatttatttttaaattattctttaaatattacaagataaaataatttcacaaattcaataataacaatgtgttatactttttatacattcactaaatttaaattttttattttttaagaaccaattttggtctcatccaattttatattattttacagtgacaataactttttttctcaatatagaaactagaaaataaatttattttctcagggacacacaagaaccgtacaggcgctgacattcaaatccctcccatttcccaacccccctaacggctactttcttcattctccgttcccttctcaacccaaaccctactttctcttctcttctccgttctgttctctgcaattgcaaccatgcttccaaaaaatccaatctttcggtgtcgggacactccttccgcacacgctttcagaaaacccagacccacgcgaaagcaaaaatccaagaacaaagagaaccatcctcctcctttcaattccccttgcccccaaaacctcccaaccctaaccctcttaagcgcaagctttccgaccattccgttcccccacctctggttccgccgtcaaggtcaacaaccattccaaattctactttcttcttcttcttttttaactagttaatttataattttatattctaatttctaggttattgtgagaatgaggcctgcatgcgatgacggggaccagggagattccatagttcagaggatttccagtgattccttgtccatcaacggtcagagcttcacatttgattccgttgctcacactaatgctactcaggcatgatacaagtttataattactttattattacatttaactcgttctccatgtctctctcgtgattttgtgatagtaactgggttgctgttttatcctccagttggatatttttgagcttgttggggcgcctcttgtagagaattgcttggctggatttaatagttctgtattcgcatatgggcaggtttctactttcttcccattttgcgttgcattgtgccgttatgttctcttgttactcgtgattgattatgtttatttttgaaaattttggatagactgggagtgggaaaacttataccatgtggggtcctgccaatgctttgtcagatgacaattcagcaagtgatgaacaaggccttgcacctcgtgtttttgaaagactctttgcttgcataaatgaggtagtgttgagttctattctatttgtgattgaatcctttgatggttatatgaactttgttgtgattttcattgttgtgtttcatgcacaggagcaaattaggcattctgacaagcaactcaagtatcagtgccactgctcttttctcgaggttgaattgaatgactgttgataatttctttctatgtccctgtcctgcttgaccttgttatctagtccttttgatgtgtgaacttgttttgcagatatacaacgagcaaatagcagatctattagatccaaatcaaagaaacctacaggtaaaatctattccattatagttttccctcgatcatgcttaaccaggttatactagaactggtcttttgatgcttattcagattagagaagatgtcaaatctggtgtctatgttgaaaatcttacagaggagcaagtgtgtacgaagaaagatgtgactcagcttttgataaaggtgtgcttcatcacacttgtataaacagttgtggtttccatttccctcttctatcactgttggctgttgcagtgttgcctattgcctatttagctattcaaccatttcattatgagtaaactatagaagtcaataaaaatataaaatagattttcttaaaggattaaaataagatccaaaaactatttatcaaggactagtttgtctttatttcttccctcacgctaaatggcaacaaaagtattagaaaaagattagaattatatattactactgcattagagaatcaggttcttaaatatgtggaagttgaagaggttatggcagcatataacatcagcaacaatgcttcatgaacacctagcatgtgttgttttcttaacatttagagtttcacgtgtcagttgtcaaacatccatcaatcaacaggttgaaacatttattttttaatgttctttcaccatagaatgaaaagtaaaaacaacatttaagggtcatatgttgtacatgcctcacttgagtaccccatgtttaaactaaatttgtcatctttgaaattacactgaatgagtacttcattactttttttaacaagtatttttgtaacaaatgtggcagagcttcattttgagcatatatgactcattacataaaaacaaaaatttccattaaggtagaaccagttgatttaatcagtagtaggagaaatgaaatgctgaatttctctcagtctgacttgaatagctctctctcttttcgttttttagacaattgaccattcttatatgcttgtaattatcaagtttttcctttccattctgttagggccatctcttctgtaaatgaatacagcccaatgtaactatctattctagacgaagaagagtaggtagttagtgggtattatttggtctgttagtcagttagaagaaataaacagagagctgtaattgagaaataaattatatatttgtcgagttgcacctgaggcagtgttgctctgtggaggaagaggatttcctttgaggagagtcatcccctgatttcaatttttcaatacagaagagctatattttgtttcctattctctatctccattctttataattttgtttctaaagatctcaagagcctaacacattctaaagatctccaaatttcataattgccatggttttcctttgtccttttctcttgtgtttttactattatatacctttcattatacagggtttgttaaacagaagaattggtgcaaccagtataaattctgaaagttcacgttctcatactgtttttacttgtgtggttgaatctcgatgcaaggtgatgcactcttctcttgtggcttggagatagtttttaataatattagataggaagggcagacattttacaatctttaactagataaattttaggagaaactacatatgcaatattgaaatgtggaacctagcaatgaacttttgcttttcagttcttctgtttttcaaaagaacttctgttggcaagatatttttcagcttcacaatagaattgtaaaaagagaaaagaggtattgaagcgagtccatattttcactttgcagagtactgcagatggtgtaagcagatttagaacaagtaaaataaatcttgttgatctagctgggtcagaacgacaaaaattaacgggtgcagcaggagaccgtttaaaggaagctggcaatattaatagatccctttcacagcttgggtatggtttaaaatgtgtgtatacattgatgtttgatattggaattgaaatacaaattactagcaatcacaaacgaaaaatagcttaaatacaaatacaagttgattttagcttataaagaagctcaatgcattttactttcttatttttttcctataaatacctatggagaattttatccaaacatggcccattttgtggtgatcaaagaagaaaaatttggtggcaaattccaaagctgattatagaagcttggcccaaacttcagctgagattctatggattcggtcattgctcaccaaattgcattgcatttttcagactcctaaaaatcctgtgacaatttgagttcagtggttctctcacaatctgctgcttcactcttgcattaaacaaatggagttagataccttttttgtttgggaaaggttctaagcaagagcctactactccatcatgtcccaactcatgattactgggggtggatgctttcaacgtgcctctctcttcactgcattttcatgttttcagaggcaagatcagagtgtgtgacaagtttatgtaatgtaaccttgagcttaggagagaggggggggggggggggggggggggatgttagttggtgggatacagtgtgttaggtcaatctagctcattgggaatggacagggaccagttttcctttaggtagttaacccagctggaagctacgcgcagcggtttggattcggtaaatgaatgttcgctatcacattagttgcaattgcattgtaatcatataagtacctgtaatctagccattttaaatcagaataaaatattactgaagtttactcgttctaaaaaattctctctctttgcatcttcaatccaaacaatctcccatagatttgtgattcccattcaacattcccctcaagctggtgaatagatactagtcattcccccatgatagatgaaatatgaaatgggcataaaacctagatgtgaaggaaagggaaaaagggaagttgttaggtggcatttattccatggtctgaaaattcctgactgccaaattctaatcatccatgatccaattacttactgaggttgaattgtactgcaggaatttgataaaaattctagctgaagtttctcagacaggaaagctgcgacatataccatatagagactccaggttgacatttttattgcaggagtctcttggcggaaatgcaaaattagctttggtttgtgctatttccccagcacaaaggtagatatcaaccattagtgatttgaacttctggctcttaatgtatgctggattatttctcatggcttaacattgcagttgtaagagagaaacttttagtacattgagatttgcacaatgtgtaaaggctatcaagaataaagcagttgtcaatgaagtaatgcacggtgatgtgaatcaattacgagacgtgatatgccaactcagggtaatatctcttcgaccatgatcaatcatttctttatacctggccagtacatttttttttcaaataacttataactgtaagcaatcaaacaggatgaacttcatcgaattaaagcaaatggttacagtccaagtgatggaagtcgaggtcattcagcagcgttgatcagaagaagtttgaatttgctgaagcctaccctcaatcacccattatcactacctcatgttgatgaggatggtgatgaggagatggagattgatgaggaaggtgttgaggatcatgctgtagttctccacaactcaaatggaggttttgctggtttttcagcccctactggatctattggttctcctagtgctgcaatgaatggtgacagccctgctggcggcatggttaaatgcaaaacatcccccatcctcaaaccccctcctcccagcctttcaccaacaatcagcagcagcaggaaaagtttgaggacctcattaaagcagtctccttctgagaataattttcatggtgaaagtgatttaggcacaaacaccgttaaccagaaatgcttgtctactgctctctccagccagacagctccaaatttcctaactaaaactgaaaatttagcagtaagcatccaccatggtcttgaaattattgatagccaccatcatggtgcatcgttatcgagtctctcattgagacccaaagattccaggctcattattcctgtggaaaaagttgatgtcggagtccagactattcttgatgataatgccgaaaaggaagattatgctatgcttacctgtaataactgtaaaagccgaatgcagcttgatgtcaatgagattgacaatagctcaaatgtgcagctggtacccattgattgcccggagtcaactgataaaccaaagaagcaaattctgaaagtaagtgcaaggatctcagcttcattttctggtatagcttaaattcaatctattacttttcatttctttctattataatgtaggcagtagagaaggttttggcaggatcaataaggagagaaatggcattagaagagttctgtgcgaagcagacttctcatataatgcagctcaattgcttggtaagattctgtttactgacaatcatctgtggtcattgttttgtcttgtattgtgactattttcaatcatatttgtagttgcaaaagtacaggcaagagagggaatgcaatgccacaataacacatacaagagaagataaaatcctacaccttcagagccttattgatggtgttttatccaccaaggagttcatggatgaagagctggtgtccctcacacatgaaaacaaggtagaaataaattattttaaggttttatttttatgattactatctttgatgcttatatttaggacttgcctgctatcaaaattcaacagcatttaaaggagaaccatgagcatcatttagaagttctgaagatgaagatagagttaaaaagagtacaagatgagttacaagagtatcagaatttttaccaatttggggagagggaagtgttgatggaagagatatgtagtttaagaaatcagcttcacttttatgttgactcttcatccacatccgcaataaagcaatatactccattgcaattgacttattcatctgaacctagtttggcagcaaacctaactgccattcctgatttaacagaggctagcactaaggcaaatgcaaatccagaatcaactgaagacagtgccaaagtaaaacttgaacaggaaaaaagtcaatggactgaggcagaaagcaggtggatttctctaactgaaaaactgagagctgaacttgaagctagcaggtcactagctgaaaagaggaagcaggaactagatactgagaggaagtgtgctgaggaactgaatgaaacaatgcaaatggctatagaaggccatgcacgaattttagaacagtatgctgatttagaagagaaacatatccaattgcttgaaaggcatagaaagatccaggatagcattgatgatgtcaaggaagcagcttccagaggaggagtaagaggtgcagactctaaattcataaatgcccttgctgcagaaatttcagcattaaaagcagaaaaagaaaaagaattggaaatcctaagagatgaaaatagaggacttcgagctcaactgaaggatactgctgaagcagtgcaagctgcaggtgaacttcttgtgcgacttaatgaagcagaagaaggtgtcattaccgcacaggtatataaagaatcaatgtgtatattcaaatttcaactgagcaagaatcaatgtgtatttacacataccattttaatccctatacataacatttttaatctctttgagtctctatcgtctaaactcataaggactaaaacagattaaaaaaagtatgtatattcaaatgtgtatttacacataccattttaatccttttagtccctatacataacatttttaatctcttttagtctctatcatctaaactccataggaactagaagagattaaaaggtatctataaggactaaaagagatgatttttaagtatagagattaaaaggtaaagtttgtacaactatagggaccaaatgaataaacctttattcttttatgctgaagtctttcactctcacaaatgaatttctagcaaattttatgtaagagaagcaggtcaattttattttgctacagctgatgcatacatatagtttaacctggtagtggagatgtttttgaaagagctgggtcagctcagttctacttgagctaattctataagatgtattaacttgcagaagcgggccatggatgcagagcatgaagctgcaaaggcctacaaacaaattgataaattgaagaagaaatatgacaaggagattagcacacttaataagctacttgccaaaacacatttgcctaatgaagaaatacgacctactttggatgaccttgtcatgcctacttgtgatgacaccaaggtgccgaacaatgttaatggtcaatttgagttattttgtaacgaagaggatagtgaacttgcaaatttggcagaccaatcatggttctcttcttatgacacatgcaacatatagattaatcttccagtttgtgttcattgttcatatgatttgttcaagaagaaaagccttattccactaggtgttcatatgatgatttgcgtcacaattgtctcttctttacatcaaagcctattttgatttagcctaccggggaacttttgcatttatctgttgcggggaatcaatatccttcagactttgggttgttgacattaacgaatcattttaagagcttgggttctaaaatgaactatgtgaggtatcaataccatttaggacttcgggttataaagaggtacacaaatgaactaagatgataacaattttagtagaaatgtcaaatattgtcagaaatttcaataatttgagctaacgcccacgatatatcttggttatgtttacgaacatttgttttgactcattgtagctcaattttattatgattttattgttaattcattttcttttaacctttcatttgtcaagaaaccacatttccccacatttaaaacgcaaccgagatttgctaatctatgaaagtaaaatgccaatcctcaaaatttgatttacattaagttatacaattgcgtgttcccgagaactttgaagtataaagtgaatcaaccatatatatggtaaaactgaaatacaactccgaccttgacaactttcaaaatttccagatcttcatgaaatctctccatcatccatctcagaatcatccccaactaaaagatcctcgtaatccaaagtaccccgaggctcaatctgcacatgcaagtcccccacttcagaatccctctgatccaaaaccaaaccatcatgatcctccacatcagactcatcatcactgcatacctcaagcttctcttcttcctccctctataacccacaagccccaaaaccttctccttccacagcagcaaggggcatttctcaatgagctcagaaccctcataagcctcagtcataacctcttccccctctcggacacatagaagatcccacagtgcttgagcagaagcctcatcggcttctgaggcatcacaagctcccaacgaaagtgtctgaggtgatcggtgaccaacctcttctcaatagtgaaactaagcagttcatgcataacagcaacagcccttttatatcaaactccaatgatccagccttaagtccacgagcatcagcatagggagacaaataagacatctcctgaaaattctgaatcttttcaccatagtaacgatacaccctctaagagttcgcagggaacttcaaaggaaatggaattgaaagcattcctggggtattggtagtttcactttcggtagtttcagttgtttctgtcaccacctttttctctaactcagtgattgcccaatcagggttccaagatacaagctccaaaaactcaaccccttaaaaagctgaggatacttatgcgcccaatggactctataatccacggcaacccaaaatctcttctgaaatgcgcaatcttctccaagggaagccttttgtccagcgacatcatgagaaacctcgtgacgtgttcggcggctttgtcggcgtgttcttcgatgaccctttgttgttccatcaagttctcggcttttggggtcatgccgcaccagagcacccccttctggtccttgtagagttcgaagaggttgggagttttgcggaggaaatcggagacatgatggggcttggggaggttgatctggcggcggtggtggtcgagggagcgaacgggaatcaccatttcgggatcttgcttgagaagctccattaggtagatgattttggaggctatttaccatttctcggttgtgacttcgaggtcttgaaccctcttcttcttgctccttctgtcttggaccctcttgctgctcactgtggtaacaataacaaacccttgttctccccaatcaccaattagtacccatcaccattaccatcaccatcaccaatccaatctagttctcattctcaatctcatttgccaaggtttgaacaagaaggccatatgttactgacggttgttgcttcctgcattcccagtgttccttactgcacttcccataccattatatttcctaatgtaattagttttacccgttgctgacaagtgaaatgagcccagcactaacattgttgggcctcggcaggtccggagtatgagctttactattcacacctcaatagttacttttggaatgatggagatgctcgtggttggcataccactacatgggaggtggacggtggtatggggttcaagaagttgcatctttacaataagacttttatcatgaagatggcttgggagcttattgcccagccggaggagttgtgggtgtaggtattaagggccaaatataagtgctgatcaaccattatctcggttgttaattgtgggatgcatgattcctaaacttggaaagctattacgtggattgtgggtaatggttcccgggtcaatttctggctagacaattggtttccatcgagtatgttaatagctctggtgggtggaaagttttggagttgtaggacttccttccttactggcctatccaggagattcttgcttatcctacccctctccctgctcatggaaggtttgggggagctactactaatggaagttttactgtgaaatcaacttattcaatctcaaccaattatcacagtattcatggctctaacaggttgcagacgatttggcagtggaaagatcctcatagaatttggactctcatttggttgattgctaataaaggccttaaagactaatgtcagaaggcaacattgtggtatattgatgatcctctgtgccctttatgcaaatctattgttgagactgaattgcacattctgagagattgttctgatgtcaaacctatttgggaagagcttggcagggatttttttcccttctatgcacagcttcttctctatgtctcttgtcgactggttgttggggaacacggcaaaggggcttcacagatggagattaatgtttggtattacggtggcttctctctagtatgccaagaactctcttatttttaagaatcaacagtggaatatgcagggagttactaatagagtgatgttacagaccctgtgtagccattggttggaccacgtacaccaactttataagtggaattccaaagatatgtgagtgaacgtctccctccaaaatttcctgagtttcccatgctcttcatcatagctttcttgttgggtgcggtttccttttctaaaaggagaaagactcaaatattgtaagccaactatgtgtctcatttatcgagttgagaaggtcaaattaaggcatatgaggaagggttaatcaagtaactatgcagcagctttaaggagagagaagagaagagtgaaggtttattattgtttagttgtttgatttactattagcatactttgtgcttttgattaagaacattttattcacagttaaccataatggaactcttagtttagtttatattagtcttaaaccgtacgaactcccgaagtttttatcctttattttgattttcaggttcttttttcccctagtctttcattatacaattctttttaatcatatatttatgggtttatacttacgagtatctttaaaatattgattaagaaatttttaaaaatattcattatgtaaaatataaaaaattatgaaaaacacaatttcacacattcaaatattttttttcttttaatttttaatcaatactctaaaaacatttgttaatatttacctatatttatttagttacacgtcacatttcttgcttgagacaagaaatttatccacaatgattatcattattcccatgatgctgaatacttttctcacctgtaataattatcttcacaatatcatcattttctttcacacttgagtccacaaaacttcctcgtcacattttgaaattgagaaatctcctcaatttttattcacttcaaaattatcgaataaatcttataaaaggagagagagaaaaagagaatcatcgaacaaagcgatatgacaggaataaaaatgtgtcactgcccctactcaattatttattcagatactgtggacagcctgtgaatcacgttggagtatttctagatattttatttttcacggccataatgattaagaagcacatatagatacagaaaaatgcagttaactaaatattatatcttggtgctttcatggcgtgcaacacagtaggatgtttctctttgtttttccaactcattcttttaatccctctagtcactttgggattctcaattgaagaggcaactgtatatgatctccaacttgctttccgtagaaaccaattaacctctaggcaactcgttgagttctaccacaaacaaatacaaacccaaaacccagttctgagaggggtgttggagttaaacccagatgcactagaacaagctgacaaagctgaccatgagagaaaggctaatgcaccagggactcttccagcactgcatggaatacccattttggttaaggacattattgcaaccaaggataagatgaacaccaccgcaggctcttttgcacttcttggctctgtggtgcctagagatgcaggtgtagttaccaggttaagagaagctggggctatcattttaggcaaggccaccctgagtgaatggtcacattataggtcgaatgatgcacccagtggttggaatggcagaggtggacaaggaaaggtgattgatttacttgctttttctgactttaatctgaccttgttcttgcttttcaactcaaatctatctgtctattcttgatgatttgcaaaagtccatagtaaagtaatctattatattattatttgtgttgtgcagaatccatacacaatgggtgatccctgtggatctagtagcggatcagcaatatcagtggccgcaaatttggtggcagtgtcacttggtagtgagactgatgggtctattttatgcccttcaggttctaattcagtagtgggcattaaaccaacagttggcctcactagtagagcaggggtagttccaatctccccattacaggacacagttgggtaagtctatggactatggtaatttcaccattttcttttgaacaaattacactggaatcttttgagctttttccgaaatacatacaatatcatttttttttctcttattaaactaactcctttaatgtttaaaagcattatactcatattctccttatatattacaccaactcccttaatgatttaaatttgaaaacaacactcctataatgaaagttgttataaacattaaacaaagaatagtattttgtgtaattcgaaaaattcttaagaagtattaatgtaatttgctatttctttatatcaaaactatatgcactttgcaagcattattacttttcccgtcaaaatacattttgttgcattaaatgtgtgacttcttgtgggctggtacagaccgatttgcaggactgtatcagatgctgctcttgttcttgaaaccattgcaggaatcgacatcaatgataaggcaacaatcaaagcatcaaagtatctcccaagaggtggctatgctcaatttctaaagaaagatggactgagaggaaagagattaggtgtcgtaagaatattctacggttttggaaatgacacttttatgcatgatactttcgaactgcacctgaaaacattaaggtaatgaaaattactatttgtgtcaagtattaattattgattgcattattcagtatcatacttatatttttcaaactcaggcaaaaaggagcagtgttggttgacaatttggagataaacaacattcaggaaatctttaatgatcaaagtgaaggcattgctctggcatatgaattcaaattatccttgaacgcatacctcagagacttagttacttccccagtgagaagcttggccgatgtgatagccttcaacaagaaacacccaaaattggttagtatgtaacaaagcccctcctatttacttgttgatgattaaaatagatatggtaaaaaaatttgctcaaaatacatcttgttgatgaatttcgtccatcattcaaatatattaaattctataaaggaaggcgaaattcatcaattatcaaatagaaataccaacattatgttctttttaacacgttctctactattatccgaattttatcagactaagactaattttaactgaaaattgatcacttaaatctcatttctgttggatatggctcatctttcgcagtcagatgacaacccttcttgttggcggggtcagcagaaagccaactggtcttttaatcctatttatattccccttgtaaaccgagtgacttgtaacgagtgacggtgaggagattataatacagacaaactggacgtagcctacattggataaaccagggtaaaatactgtgtcatatttctcttccctattctcttttctgtttttagatttgtgtgtgattgtcgatttccaacaatttcactggaatagatataataacattggtatggaaattgcaggagaaacttaaggagtatggccaagatctcatgttgatagctcaaaagacaaatggagttagggaactgaaggaagcagtgttaaacatggcaagattgtcacatattggatttgagaaattaatgataacaaataaacttgacgcggtggtagtacccttttcattctttgttagtatacttgcaaggggaggttatcctggaataactgttccagcgggatatgaaaagggtgcgccatttggaattatctttggaggtttgaaaggctcagaaccaaagctcatcgaaattgcttattcctttgagcaagctactttgatcaggaagcccccaccacttctaaagttaaaggtttaaccgttaaaaaaaaaaattgtcagaattatgatggaattgaatagccaattaagtgtttgtttaatgatggccgagactagttatgagttatatccatctaagaataaatttaagtattgtcatgtccttctatcagaaactctgacaaaaaactataatgtggcaataagattcgaagtgtgtctatttagctatctgagttcattgcagtggggatttttggacttgtattatgcttttaccatgaaataaaataaatcaaaatcctgaagtgctatcaaggctcggtttaataaggaaaaatggtctcttagattccttaaaagtatatacgagaaagagaaaaagaaaaatgtgaccaaaaagaagagaaaaatctctaaaaaaaaagagagagaaaagagaaatataaagatgaaagtaaaaattaaagtatgaaaaaaaatagttttaaacattgaaattgaattgtttaaatatatgagcatataattttttaaattttgttcacgaaagtttatattcaattaaccttcttcaaatatatttatgattaaattatactaattacttttgagtttttgtaaaattattcaaattctttttttaaaacatatacatcattcttccctattttttaaacaattagaagaggttagttaatatataaagaatattggtgtaattttgttaaaaaaattaagagaattattatagtgattgaaaaaacagtaagaatttatataatttcacaaaattttgtcattttcattcatataaatttatattgaaggtttgatacaaccttcataaaacttatttaaatttctatttacaataagatgtgaaaataagatacaaaattatctttcaataaatctatacgaatgactttttatgtatattaacattttaacatttaaaatattaataaatatattattttattttaatatggtatgaaaaaactatattgttataatgcaagtttgagtcatattcaattttataaaactaacttataagaaattattttttagtgattaaaaatgggttgaaaatatttttatacgtataggaataattaaaacatgtgtttgtttaacattttcttatcctaggaatgtataataattactaaaaatatctttattgtgttaaagtttgtttaaaaaatatataattgtgtccaaataggtataaatataaacaacgcacaggaaagttccaacaaataatgccaaaaaaacgtcactacaactcatcacggtccctttaatttgcatcctcacgctttaaaactccagcctcgttgttgccacaaaagtacatgtacacttgatgcaaatcaaatagtaaaaaaaaaaacgtaacttcaagagaatagtcaatttagagttacggtgttaataatataaaaagttagaatacctttttaaaaattattgtgaataacacgcatgaaattgacacaggaaaaaatgggtgaaaatgagaaaaattaaaacacatatataaatggagttgagtagtggatactaaagagaatatatgtatatttttattcactaatggggattttatgttttatgggaataaatattttttatcattaggattaaatattgatggaatgtgagattattatttacccatatacaaaatataggtttaattactttgtggtaccttatacaaaatttttaattaggtccctcaacttatttttcttttaatttggtccttcaacatttttttttcaactggatccctaaacttttatttatttttcaattgaattgtttcatctaattatcgttatgaaaaactaaccacaaatacttaattataggtactgatagtggactaatgcttttagaatgtgttgtaagtacaattaagtcaattgtgtgagttttttttataaagtttcaaccttttgcaaaaccaaataaatataaagaaatatctaggttgaattgacattaaaagatagaaactttgcaaaaaagtctcatagactcaattgtgaatataacacacccaagaagaattgttttcctgtctggagttctaattgagtctttgcggttaatttttcataacaacagtgaaatgagggatccaattgaaaaactaataacccaattaaaagaaaaaaattaggaacctaattaaaaaattggtaaaaatatagcgacttataggttaatttaacctaaaatatatctaagattaattattttattatttcgtaacaaaggggagataattttttccactccaatattctcacgactaaaaaatttagccatgaaacaaacataccctaagtgcttatccatattatatttgggccagttttaagtttaaataagtattttaataaatatttttcaataaacaaattagatttattttttaaaataagtagaaaaattatttttttaagaagaagtagtttagacaaacacaaaaaaaaaataaagatttttactttctaaacttttgtttgactagttaagatctctaaaattttagaaatttcagtttatagtttctcaacaaaagtttaaattcattatttttatttatttattgggattttaaggagtaaagactgaatttttaaaagttatgggactaaaaaaaatagaaaaaagttgaaaaatcttcaccaatcaaactaaattttagagattaaaatcttaataaaaaagattaaagaaccttaaccaaatcaaataaaaatttaaaaataaaaaacgtagttaatccttaaaatatagttattcttatcataatacaaattatgccaaaaaaaacatcaccaaaactcatcatggtccctttaatttgctgcctcatgctttaaaactccagtcttattgttgccgcaaaactacatgtatacttgatgcaaatcaaatagtcaaccaaaaaaccaaaagtaacttcaagaaaatagccaattcagaggttacagtgttaataatataaaaatttagaatacctttttaaaaattattgtgaataatataaatgaaattgaagcacatatatacatgaatgtagcattaagagaatagttggattgtggataataagaaaaataatatttattcctttcgttggaattaaatattaattaaaagtgagattattgtttatcaaaatataaaatatcaacatcaacaacactttaaatctaagttaattgagatcggtgatagatgaacccaataataaataataaaagagacagaaagagaaagagagaggggaaaaaaagttaaaataagaaaaaagagaaaaaagaggtgaaaaaaagaaggaaaataactaaaataagggaataactggaacataaaactactaatggtttaaccctctactaaacttataattttttttcactccgtcctaagacataccgtccaccaatctatatctcactccattaggttttatttaactacctttccccaggtaagtttcggttgatctctaccttttttgtatcaaactcttggtaacaaactcttgttcttacgggagcatccaatgccagtctcataacgtactcaaaccacttcaatatatgttctctcatcttttcacatatcggtacactgatacatttttttgaatattctcatttattattttatccatcttcatatatccacacatccaccttaacatcctcatttttgctatccctatttttgttcatgttgccgatgtgttggtcagcattatgctccatacagcattgccggtctcataacgtactcaaaccacttcaatatatgttctctcatcttttcacataccagtaccactgataccttttttcgaatattctcatttcttattttatccaccttcatatatccacacatccaccttaacatcctcatttttgctatccctattttttgctcatgttgcctatgtgttgaccggcattatgctccatacaacattgccgatcttacaattgttttatagaattttcctttcagcttaaggagaattttgcagtcatacaaaaactccgatacattccaccatttcatccatcatgctctaattctataatttacatgttcatcaatgttaccaccttttttgaacattaatccatgtatcatttatattttgatatattttctaccaaaatataaaatatattcaagataaattgtgttattacttcataacaaatacaagataatttttccccttctatatttccaaaagtaaaaaattgacccataaacaaacatttattaattatttatccatattatatttgggtcaattttaaacttaaaataagtgttttaaaaaaaattaataagcaaattggatctacttattaaaatcagcagaaaaatacttttttcaaacataaatatttaatttagacaaacacattaaaaaaacaaagaaaaatacttattttattaaaataaacttgattgtgatattgtttttaattattttagtaaagtgtcttatgtgatccgttagatatgatctatggctgatattactgcagtagggagctcgccgtagagtattatttgccgtagagaatccgaacgccaccgtgaatgtaaaaaaaaaaaaaaaaaaagtcataataagatgaaaaaaaaaattattatagaaaaagaaaatagttactcctccaatgaccttcatctacatattccataatttgacagatacttattgaattatagatagtagacacgcatcgtactcgaacccagtttcttatgacaattgtcataagataattactgtttaaataaaatataacaactctattgtataataatgggtgaaattaaaattttataaattaaagtcgagttaagatcaactaagatagtattaaattataactataatcccaagttaaaataaaaaatattactaaatctaaaatcgtagatatatatatatatatataaaagactgtagaaattatttaaataaaaaaaaaaccctattgtataataatgtgtgaaattaaggggggctaaatatgtgattttataagatgggaataaattatggcattttatagacatttaagaattaaattagattatttttttagagattaaattattatcaatttatatattcagaaatcaaaataattatttatcctaattttatattcaatttgttgtcacatatatttggtaaatttaacttataatttagctgaaaaaaaaattataagttaggaagtcaaaagttataaattaactgatttaatcattaaaagtgtttgataaaattaacgtataaatatcaaataatgtagagaacctatttaatatgtttaaatatatttttaatttcttacaatttaacttttttggttttttgttattataaattatatttattttatttttcatccttataacatttcagatagtattttattgtccttatatttattttatttttagtcgttacaaattgttttttaaattattaaattttattatataaatagttataaactttaaccatttaaaaaatacatttaagaatgattgtactaaatgattatgtgattaatgtgtggttatgttaagatgacttaagaataaatttttaattcagttgtaataattttaattaattatgttactaatgtatttttttattgacttgataatgttttttaaccgtgacaaaaattaatatttttttttattgcttttgcacttaataagtgcggaagtgatcgtgagtatgaatatatatgtatgtatgcagtgggtaagataatgaggtttaaagcttctacatgtacgaatttgggaataaatattataattattaaaattttctttcaaagacacttttatgattggttaaaatttttaattttggtaaattttagttctcaatttaatataaattaggagaaataatcagaagaaaaatctaacaaaattataattttcaataaattatagcaaaacatagaaagtcttagaaaaaaagtattagagaaaaacattaacatttatcatactataatctcatactggttatcatccttacaaagatttaatgcaaaagggtattataataaatccctttttggatacaattaaatttcttaatatgattttcattctcacaatgaagtgtatcattaatttagagaataatggagtaatttcttaattctctctaggtataacataagcaaagaagttatttgaatataaagataagtttttttatgtgttggtgtgtcttattatctcttttgtttgtgattattaaaacaaattgatttttgttttagatccttaaactttttatattaaatttatgatatattaaaatttttattttaaattttttttgtccattaatgacgtgtaataaatgaacttttatttatttcctttcatttttttttcatgaaataaagagagggttaaaatttgctttcctaaaaaaagagggttaaaatttatttccattaaaattttaatttaaagtaattaacattttgaaattttaaaagttttctaatatagtatatttttaaatacatttatattcttctgtaaaaaaaaacatttatattctgttttgtttcaaagttatttccgccgtcacttttctctaataatatatattggttccccattttgccgttgttcactcctctcttccaagttctgtctctgtatattcaaatccatactatcactttcgcttcggtacttctcttttcattgtcgcacagacacaaatcagcaccaaacgaagcccgacactacgtgaattaagcatggtaagattcagcaaaacccaatcacatcttcaattttcaaaactatttcatctctctgtcttcttttagggttttcctccctttttcatttacgttttgttctgaatgctctttatgatatgtaaatcttttttttttttttttgtgcattttataattgacacagtcgggcagaaaagaaacggttttggaccttgcaaagtttgtagacaaaggcgttcaagttaagcttactggaggcagacaaggttaggttacccaattcccttctcttgtgattttttattttttaaaatggttaatgatttatgtattgattttttaaaatgatggcggaagtatgaaattcgtttcgttttgaattgcaagaactcaattgagagttagctttcataattaaaatgcaaataaactcttctacatgtatattttttgttatgttttgttttgtttgattgcagtgacagggactctgaaagggtatgatcagttgcttaaccttgtcctagatgaagctgtagagtttttaagaggtaactaaacaacgcagagatctagtttttctgtttatcattttaatggtatatgtactgcagtagctctatttgttactttcttattatgttcgtgacttcatgatactgcttttccagccttttcagcgaattttgctacaatctgctaaaatgcaaaaaatttctttcagggctagggggcaaaatatttgagttttcatctatacttttggttgattccttggattatttgctcattatgggtgaagtttttttggtgtgatgatttacgccatgaagctgcttgattatactttaactttacagaattaaatcactatttgggtatttagcaaattagtgaaaactacataaagggacttataccgactgagagtgaaatattgaatgaataacaactaaggagctaaataatgccatttttatcatcatttccactgcttctataattaagggagcgttctgaagggcttgtttaagcttatgaaagtagcttatttatctatctatatgttttttgtatttgtagtttattcaataagcttaactatgatccttatcaaaataagcactttttagcttatttcattaagctctgtaaccaagcctatatgggaattctcattttataagagtttagtgaataaatgcttaatcaagttgtttaccctaatatgccccaagtgcagatttagcactgaacttttagttccaaataacataagcattggagtggaagatcctatgatatttaaatttttttctcactttgattaagcccttgatttactcattttcttaattttctgaatgaattcagcatcattttacttatttttgtttcagcaccgaattcaaaatggaatttccattcagaatttgttcagtatagtgcagaaccgaattattgaacactcttagatgaacttggcatgtcaatacaactatgcatattattgtaccttctatgtgtcaaaagaacggatttaatttcatagttcaaatgtttgtgtgactctacttagtatcagcattatgcttgtttataaactccaccaacaaaatttaacatattagcttattcttaaaaattatctaatatttcatttctgttgtttgaaagtagattttatttgtcccttgtgctgcagatcctgatgatcccctcaaaactaccgatcagaccaggaatcttggcttaattgtaagctctcctcttcaacatcatataaaaactaaaaataattacgtacctcattgctcagaggttcctcgctatgcgaaggtaagagggagagatattgtacgcaaccttacccttgcatatgcaaagagactgtttccgtattcgaacccatgaccaataagtcaccaagacacaactttatcgctgtgtcaagactcgctttcagaaaaactacatatcccattgtccagaggctcatcgctatgcgaaagtaagggggaggaatattgtacgccgccttacccttgcatatgcaaagaggctatttccggattcaaacccatgaccgacaagtcaccaaggcacaactttatcactgtgtcagggtttttcctcctcttcaacatcatatgagtgtcataattgcaccttctggctcataaaaagcttgctttgctgatgtcgtgcttcattgaaattttgcatctttgcttctttggatactagggaagtttaataaatcaacaacatcaacatcaacaacacctttaacccaagttaattggggtcggtggtagatgaacctaatgataaatcgaaaataggacaaaagagagaaacaaagttaaaataaaagaatggtgaaaggagaaaagaagaggaaaagaactaaacaaggaaatgactggaacatagaactactaatggatttaaccctccaccaagcttaatatttattttgtatttgtaagaaaaatatcaagttaattaattagaattacagtccaagtacataggagagatcaattatatactcttgcaaaacattaagaacatgtcatctccttctaaaaaacattaagaacatgtcatctaagtgcattaggagagctacaagaaaaggaatttaaaatatgtttctgtaattttctattaagaattcttatataataaagcaattgactgattctggccatgttaaattgttcatcgagggtgaaaagttgtactttaactctattatcagtttttttgttttggtttatagatgtgtatgctgattgtttaaattttatagaatttaaaatatgcagtgcctctagtaaatgtacttatgataggcccttaacacatgtacaagagcataggaaaatatgatttgcccaatggtagcaaaggcctgctggtttatgagaggaacataataataaccgaaaggggaaatttcagttaggagagagagagagagagaggagggagagggagagggagaggggaaattataactgaatggtgactggcggcatgagtgtgtgggagtgaggagattcaggaatcagtattaaataaggggaaacagaggtgagaggataaatgttggtgagggtctttgagggttggttgcactacaacagtgtcagtcatatttctttccttttcttgagtattctattaccagaggatttttcattttttcctcagctgtagcctgtacggagctttgctccctgatttctcagttgatagtattcagtatattttaatttctacaacctatcactacataaaagcatttcctgcaagaaaagaaaaagttgataattcacatgactataagcacttcatccactagcttttttgaattattttatcattatctttcaacaggaactattttggcttagcaatgaatatttcattatcctgggaacttattttattgcaatgcaggtttgtagaggaactgctgtcatgcttgtgtccccaactgatggtacagatgagatcgccaacccctttatacagccagatgggtcctaagtgtgaagtatttctatcttaaaatctgtatgctagctgatcaatacgtcgtcgcttagctgctgagacattaatgtggagcttctgattaacgttttgtctattgtgtgtaagcttggagattctgacccatttcatgttcttgttctgatgaagtttatttctctgtgatgtgtcttcagctacactttgaggacttaatatttatcatggattacaattgcacataaattagaagctaattctaacttgaccagaatgaaagttcttcatggcactttatatgacacttcccttcctcaccattcttgttaatcaatcttaccacacatacacgcaatctagtctagctgttacaggttagaagagacctagtaatggagaatttggatagcttccacaaagttttagattctaaccttatactgtgtttaaaaaaaagttgagcgaacactaattccaaaggacgggctactctattgcaacttgtacattttcagttctttatctgcttgaagtgtggaaatgtctattactattaggtttggccagaggagaaaatgaataattgagcaaggatgggtttgaaagaaattttctaacttttatccgtaaagatttttttaagtaattataaagatagtgtataaaatacgcatttttaaaaaaaattcaaaatgtctagttgaaagaacaagagaatgaaaattttaatctctaaattatatattttaatttgtaatatttagttataggtaatatactaattaaaaagatgaggattgagatttctttacctatatactctttttggttgggttgaaataccatgaaaatgtagaagtgaggaaatagagtggatagttaaaacttaaaactcatcctggtttggcaccaatgaaatagtaaggaaagaattgtaggtctcatgtacaaaaatttcatccatgaagtaaggaaaaatagctttgaaactgggagaagtgaggagaaatggcataaattagtaatcatgaaatatatcaagcaaattttttttatctttttcttttatcttttttatttcttctttatttttattaaactaaacaactttaaaatttactttatttctgtttttcctattaattctatccgttgtatttcttttcttcctaccagttaaatcctacatgcatttataaaaaatttcttaatttaattacaattcttagatcttagttaggaaagtccactttgctccctactcctaaacacttattaagcaaggagtttggaagcctggtgactggtgcgagttgaaaacggtgaaaccacacggtaccagagaacagaacaacaacagctgcagcagcaggacatcatgtgttggggatgttgactttattgttagtcatatgtggttggttagattccattaagttgcaacctgtgattattttttcaggtcgttttacttacgtgcatgcatgcgtttgttggcgttggaactaatggtattcatgagataaaacttatcaaaagagtataaaactaagctacaatgatccgtttccaacctcttgactattcaatatcttgacaatatataatgtttaggttcaggcttgaagtctcttatagtttgatggagcaacaaaagaaaggaggtgatggagctggagaagcgcaactctgaacttatatattaagatgaaatttttatgcaaaagagttagtacttaacttcataataagggattaaatagaaaaatgtttttaaacccatcttaacccgaaatcatatttgtatgaaaagtatttagtagacaaaaacttaccttgtcagaagtaacatatacctctgcgttccattttccccttggtcaattctttcttcagaaagaaacacgtctttcttcgtttggacattcttatttacaagtgaaaatgacgtatggacagtctcacaaacaccaatgacggccattgattgaggagagtaaaagaattgcatatcatacttgcgtgaaacttgaatgtcaatcgatcagaagctaagctgtttatgacaattataaaaattctaatcttaccactccctagtcttattttattttagaggttttagaattaaaatttgagcaatactattcacgaaccagtacgataagtacttagagaaactaaagtgactatatttactcatacaaaatacatgaataaaactttaatgcttaacactattttttaaaataaatattacttaaaaatttacaaaattgttaaacaggtttgaatagaaatcagctttggtacatatttgacaaaaactattcctactaaatatcatttttcttaagatttttacactctcaatcaacatcctctaaaatatatagtgaaatttaaattaatttattaagtatatacatatatatatatatatatataataaagtacacattaaaaaattattactttaatgtttactttattatttatatgagatataagaattaaattttgtaataattacactatttaatagtgttatttatatatatggtttcatttaaaaaatttatacttgatgtatattagcattatatttattaaattcaattcaataccatatattatatttagtaaatataataattaatactccctatgtcccattaaaattatcgtcctaaatttttttacacacaaaaaaattaataaatatatgtatgagatataagattaatttttgtaataattacactatttaataatgttatttatatatatagtttcatttaaaaatttatacttgatatatattagcattatatttattaaattcaattcaataccatatattgtatttagtaaatataataattaatactctctatgtcccattaaaattaccgtcctaaatttttttatacacaaaaaaaactaataaatatatgagagagttacaattttactatattaacatgctattaatcttctttgttggaaatgatgcaagtcaatgatagttattagaggtataaatgaaaagaataattaatactgttatggttgtcgtgttcagattacgtagacgttatagtttgggtctggacccaattgttatgaataatcatgcaaataacttacccatagaacgtggaggctgacttggtccatactgaactttgagaacgtgctggatgaggccgggaatccaggaagcagttctaatgcccgttacgaggtattttgtttataaatacacagtaattcctggtgaaaggtacacacacacattctatctctctctttcaattacacagagcacacaccccacgtcaattggtgtatctctgtgatctcctgccccaaggtatcaccttccattgatatccttgaagctgcagagttagagtgatcaaacagcaactccatagcacttcggtgttatacatttgtgttctggaaagaaccagaacattggcgccgtctgtggggaacgataaacttcgagtcccacgcttgtcaataatggtaaacacaagaaacagccactccgtaccacattcagagatgccgaacagagagatttgcctaccggagaatcagaatgtggcacggagggaagaaatacatgtgacggaagccgtttccgacgaagcttcctctcccgctcagacagaccaacggaggaccccaccggtgtgaaggatgggccaagaaggggagctcgaaggacagcttgtcagcaatgttctcaattcaatcctaacccgaattgagaacatggagaaaagacaaaatctacagagacaggaagacatccgtggcattacacgccaaatagaagaacgtaatgaggagtggagacgtgccgaaatgcaacgaacggcacaattggagcagcagctgcggatgatagcagaccgggtacaactttcaaatcctgagagggagacgcaggatttgaggacccacttgaaccaaagaagaagtaccgacccggaagaccaaaggtggatagaggagccgcaagatctaaggacacacctaaatcaaagaagagataccgaccccggagatcaaaggaggatagacgagccgcatcagggtcaaaaccgggcacagaaggaggcacgcgatggagtcgacacaaaccagagccgcgacgaaaatccgaacattcgagcaaaacatgacgacaatcccactggtagggcaaacaacgagaggaacccgacgggagaacagaattttcgcgagaaggcaggaccagtgtatcgtcggaaatatagcaggggacagcaaaacaacagtccattcgtggacgacatcgtaaatgctcgatatttggatgactttgatgggtcattcctatcaaagtatgacggaacacaagacccacaagtgcatatcgacgaattcgatctgcagatgtgtgtccggggcattgaggagcccataatatcaaggattttcgttacaacattgacgggcccggcgcagacgtggttccatactctgccgcctagatcaataaagaatttcgaagactttggtcagaaatttttattgaacttcgcgactagtaaaaagcagccgaagtccgagttcaccctgggcaaaatcagacaggcacccagggaaacactgcagagttatttggatagattcaaagaagccgccctgcaggttgatgggctagaagaaagagtccacgtatacttgatatcggccggacttaatggttcgtcaagatttgccaagtccatttacaaagacccggtgaaatctttgatggaatttcgtgcacgcgcaaagaaatacttggagttggaacagatggaggtcgtcaacaactcgggacgaggaaaggagcgtcatgaaaggagaagcccacccccaaaaaataggggatacccggagagtcgagctcggaataatgatccaaaatcccgaccaggaagatacgaaaacaaatatgagaaatacactccattgaacgtatcccgttcacaaatctggaaggaggtcgcactcacagagatgaagaaggttgaacgaccccgcccagttttcaacaagggtggattggataaatcacgattttgtgaattccacaacggacctgggcacaccacagaccaatgttgggatctgcgggatgcaattgagaagttcatccgagaagaaagaacaaacggaaaggagacgaaaatcaacacatcaacgaaggaaagagacctcgggaagataatgacgagttcccggaacccgagtttgaatgtaacgtgatttccgggggaataggcgatggcggggatactgccactcaaaggaaaaaatatctgaaggaagtgctatcggtccaggcacaacctaaattcaaagctcggacaggagagccagaacctccactcttgtatttcacaaagcaagacatggagggggtagtacccagacatgaagacggactggtgatctcagcgacggtgggcaattgccgggtaagaaggatgtatgtagacaatgaaagttccgccgacataattctattgaacgcatttcggaagatgaagttggacgttaaggaattaagaccgtgcaaaacgatgttgatcggcttcaacggcggaaacacgaatgtaatggggtctatccgcttgcggttaaccttgggaacgagagaagcttacaagcctgaggaagtggaattcgtcgtggcagattttccatcccaatataatatgatattggaaagaccaaccatacataagtgggacatcttaatgtccacaaagcaccaaaaactcaagtttgtgggcagcaacaggcaggtggtaaccatatgtggcgatcagaaagaatctcgacaatgttattatgatacggttcgaaaaagtgaacgagaagctaacgacgacattcataattgtgtacgttcagtaaatgtggtggaattggatatgcgagaagccacggatgagtggaggccggaaccagtggagaaagttgagcagattctaattggagaccaggttggtcaggtgactaatattggtggaacattagaacccgaacagagggaggaattgatccaatgtttaaagaaaaatcgtgatgtatttgcatggaaggcgtcagaaataccaggcgtcgatcccgaattctgcagccacagactggcaatgtacccggggtcgaaaccggtggaacagaagaaacgaaaattgggaccagacagagcctaagctttgcaggaccacattaatgagttgctgcaggccggcttcatacgcgaagtacaatacaccacttggctgtcgaatgtcgtaatggttcgcaagccgaatgggaaatggagagtgtgcacagattacacggatttgaacaaaatgtgccccaaggatgcataccttatgccaaacatagaccagctggtggacaattcatccgggtacagaattttgtcgttcatggatgcattttccgggtacaatcagatacccaatgcacccggacgatcaggagaaaacgacgttcataggtgacaaagccaactattgctataacgtcatgccatttgggctcaagaatgcgggggccacataccaaaggatgatgaatagagtattcgagtcacagctcggacgaaatattgaggtctatatagatgacatgatagtcaaaactgcaaaggtggataagcatgtcgaagatcttgaagaaacctttggccgactatgcaagtttaacatccggctcaacccattaaaatgtacctttggggtcggggccagaaagttcttgggtttcatgttaacacacagaggaatagaagctaatccggataagtgccgcactgtcctggatatgcaattcccgaccagcaagaaagaagttcaacaactaacgggtagaatagccgccctcacgcgctttatgccaaagtcagcagagaaggcattgccgttcttcaagatgttgaagaaacaagctgtcatagaatggaactcggaatgtgagaccgcctttactgacatgaagaaatctctggcgtcgcccccagtattgtcaaggccggaagcaggagaaattttagtcatgtacttatcagtaggcgaagaagccgtaagtgcagtactaataagagaggtggagtccacacagaagtcggtatactttgtaagccgagcattgcgcgactccgagtcgcggtatcaaaagttggaaaagctggtcttcgccctgattgtcgccgccaaaaaattgcgtccatattttcagagccataccatagtcatacggacagaccagccaattcgacaaatcttacataagtcagatttggcaggaagattgaccaattgggcagtccagttgtcggaaatttgatttgaaattcgaggctcgccacgcgattaaatctcaagcattggcagatttcatccgagaactcaccccccacgcctcgacaattggagaatggtggaccctatacgtggacggatcctccaacaagaaagggagcggagccggaattataattgagaatccggaaggagtggcaacggaaatttcactgcaattaggttttccaacgtcaaataaccaagccgaatacaaggcattgatcgccgggcttgtacaggcaaaggagcaggaagctaagaacgtgaaagtctacacagactcgcaattagtcgcatctcaaattgaaggccgatatcaagtgaaagggcccttgctggcaaatacttgagccgaataaaagaattgatgtccgaattcggcgaggttgtggttaatcacatccctagagaagaaaatgcccgggccgatattttgtcaaaactggcaagcactaaaaaacctgggaacaatcgaaccgtaattcagcaacagacgttacagccgtcgtgcataatgatgatcaccaccgacaatgattggcggcgtccaatagtaagttatttggagaaggggtgatgtgttgcaaacacatcttagttttaggatagttttaggttatgttttgattaaataattaggatttagattaattttagctagtttattaatattatttcattttatctaatgtcaataccaattatgcatttcagggcttaaaagaggagaataaaggcaagcaaaagaagaaaacaaaatctggagttccacgccactcgcgcggtgttccacgctagtcgcgccagtacctcaaggattaagggtattctcttctgccaagccgcgcgacaagcgccatgtcccacgcgacaagcgccattctttcggccattccacgcgactagcgcgagatcgcgcgcgggtcgcgtgaggttgaaattgtttccttatttaaattatatattttcagatttggtactatattaggattagttgccttaattaaaggattctataaatatatttagtttccttaattaagaagatttgattcagatttgaaacaagaaaataggccttgttaccctaattagatttatctataaataaaggcctctaggaagcatccaaatcacaatctctctaccatctatcaaccccttccatcactctctctttctcatattttcaccattggaagtcaagaatcaaggcaaggtcaccaagaatgtattatttgacagcctttggtttcttgaagcctatggcaggctgaacttgtattgtgggaaggccatgaactgatgtaactcctctgtaacttgaattggtattgattttaatgctgttttgattattttattctactctgtgctattcaatgttttattcttatttggaattggctattctatttaagtattgagggttaggattcgcaatggacacgttggggttctaatttttgacctgtttagaataatagttgttcttcgcctagacatagggatgcatggctacggattttataatatgttctttttcatgcttaacttaatagaattcaccaaggaattgggtttttgaattgggttaaagggttaattcactaaggaattagggattaactaacttaggaaaggcttattctccgaataatcttaacaagatcacatgaaatatattctttgaatacttagtttgacagattcactaagggtttaggtttctcgatcgaattaaagggttaaatcgctggttatgactctagtagttctaggatttacgaatttaggaaagatttatcatgtgtgtaacttacgataataaaccaatcaagtgaaggaggtaggaacaaaggggattgtgcctgaccacaattgtttcttccattggtaacttcttttatatttttactgcatttattttctatttctattcaaacaacaaatcaattcaacaattatatcttattttctgttttattttccaatcatttagaattaatattattgtaaaaattaccccaatccctgtggagacgataactcacttacctactttattacttgttaacgatcggtgcacttgccgtaagtacacaacaaggggacattaccagacgacgagctagaagctcggcgtttgatacgaacatcgaccatgttcacgatcatcgacagggagctgtacagaaaaggactgcacaaccctttgttggtatgtgtggccccggatcgagtaggatatatcctgtctgaaatacatgaaggtattaacgggcaacacatggggggaagagcactgacaaggaaagcacttcgagctggatattactggccgacgatggtacggatgctgccaagcatgtgaggtcatgtgaaaattgtcagatgcacgcttcaagggtattatccccgccggaagaattgcaatccatttcggctccatggccgttttataaatggggtatggaccttttgggtccattcaagctggcggaaggacagatgaagtggctgatagtcgccatagattattataccaaatggattgaggcagcccccttggctacaatcacttcggcccgagtgcaaaattttttcgagaggaatataatctctcgatttggaatccccggagaagtagttactgacaacggcactcagttcacggacaaacaatttcaagagatgatggctagtttccagatacgacaccgttttgcgtcagtagaacaccctcaatccaacggtcaagcggaggccgcaaacaaggcaatcctaaaggctttacggaagcgaatgtacgacgtcgggtcgacctggacggaacaactatattatgtcttatggggatccgaacctctgtccagtcgtcaaccggggaaactccattccggatgacttatggaaatgaagctatgatcccagtcgaagtcggacaacagtcatggcgacggagtcaaatgctacgagacggagaggaagcaaacaacgaagttttggcattggagtcggaacttattgaagaggtccgaataacggcccatgcccgggaattaaaaatgaaacaacagatggcgcacgcttacaataagaaggtggtcccgcgacagtttgaagagaccgatttggtacttcgacgtgctgacatcggaaataaaaacgcccgggacggaaagttagcagccaactgggagggcccataccgggtcattaaaaaattaggcaaaggggcatatatgttggaaacgctacaaggcaaaccagtcaagcgaacatggaatgccgacaaattgaagaaatactacagttaaagtctcgaccttccttttaataggggtatggattcggaaaatgttgcatccgagtccgtatggtccctgttcatcgaaggtacatgaggcagtagaagaaggcaacctcgttattgagggtatgggtccggaatacacatatccgagcccatatggtcctctttcacgatgaagacgttgttaataaatgcgaactcggaagcctaccttctgagcatgtcatcgtatcaaataaattatatcgttgtaatttctaagtgttagtctgatcatattcggacacacatattgttattgtaacaacgaatataaatgcaagtactatgaattaccacgatattgaatcattttatgcggttttgtagtacgatgactgtgaatgatacgctaaacggccccgatcaggccggataatggaagcctcctttagcgtagttgttcacggtcagacaaacgacaagcaataaataaaataaataaatggtcgttggaaccaaaagatgcgcgcacaagatattttatgaatcaagtaaaaagcttgaataatcactaaataaatatttgttccgggcaccaggcccaacaaagaaaagaaatacaaagataaaacaataatgtctgcctccctaatcctttgaaggaacggaatcgggagtcggctgagatggatcgggaatggatgtggggtcggcaacagaagtgacgacaggagcaacggaggttggttcttcggttgtcaaaggttccgacgccactaccgaaggatcttcagctgcaggaggaggaaacagttgaccgtcctcgacataagccaagaaatgcatcccggcagtagtcatccctacccgggggttcaagaaaataatctgctcaagggcgttattgaagccatcctcagcagcatcacgaagggttgctttcatagcagctagccgaccttcgtaatcctggacgcaggcttctttgtcggccttggcagaatcaagggaagaagtcaggagggccaccttctggtcggcagcttcaagggagccttgacaccgcgccaaatctacccgcagggaggcagaaacggcttgggacttaagtaattcctcccgcaaaagcttaagctccgccgccgactgcgtttggagggtagcaagttgagccttaaaggaaacaagttcctcacaggctttgtccttctcctccaaagctttgtccttttccgccaccgcaaacccgtacctgcgacattaacacttagaaatatatacaaagtataagtagagttaaaaatgtcacaaggaagatgcatacttctcccgaacagtggtaagtgctcgaacaagagaagcacagcgaacggcattctcctcgatccggaccagctcggccagttcttcatccaccggggcactcggcttgagcatatatgaagggggtttggtcaaacgaaccaactcttcagtaaccccttttttccatacattattcgacgaacccgcacctcaaggtgctcggagccagcaacgggggtagtacgtgggcggccatccgccacggtaagatccacagtttcgaccaccgaaaccggggtcaaggttgccgaggaggaaggcagtggagcagccggagtagctgacgccgccttttgagcaccttcgtcaaaaaacgccctgtaaggaggcgcaccacgttttttggacggagcgctaagtttgtcagtcgccggcctcttgcctttgcccttcacttcagttggtttggaaatatgggcgatgtcggccttggctttaggaggaggtcgggatcccattccggctacaatcagaaaacatcataattaatacaaatgcagtgataaaccatgagataatgtagtcaccaaagcagaccatttcgacgaccaacgccaatgtagtcggaagttttaggctgaccatgagcgcttataaactcagaaatcacgaagacagaagaggcatccgagtcggaaagatcctcttcgataaatcgatagttggaatgatcctgcttgtaatgatcatccgaccagtacaagggaaaaacccattctacatcggacgactcaggaccggacaagaaaaagggtcgccgatgaggttcggtggcaactttgaagtatttgtccttgaagccacggaaggagtccgaaaagggatcgaagagtttccgtttactctgactacgaaaggaaatccacctttttcggtcagaaggttctttgcccgttctaggggtatgtggagagaaataataaaagaagagaggaacggtgcaggggatccctaaatccgtacaaaataattcaaaagtacgaataaacccccagctatttggatggagctgggaaggagctacccgtagatgatttaaaacttcgatttcaaaagaggaaaaaggaaaggtaatacctatttgtgttatgacatcttgaaaaaagaagaagaagttggggttattaccctcccgttgagcgcaaatgggctcaccgggcaggggagcttgaagggcgaacccatcttgcttccctactgaagtcgacactatactaggaaggtcgaggatagaagaagttcgaagaatttcataagtgacccaagggaacttagacgctaatgctgggggcacatctgaataggattctacagaggcagattcgtccacggtttccgaagtaacacccattatacctacgaaaatgaagaggggaaataaaagttagtaaacatacctggaggcaacgcatcaaattcacaagacactaaggccgaaaccccgtcgacgacagaatgagtatgcgatcctggttgcaaacccttgaaagcaggacgcaaaatagggttatgatgacatgaactaagaatcgaatcggcaatatcgtcggagcctatttgaacataatgaatggcctcggacacacaatccatacaggcatcataatcaacctccattgcttcaaccgaggatgaagatgattcctcatcataagatggagaaaggccaactggagggatagggtgatggcaagagaatcctagagagagacctcgtggactaccagtatcaattttgggcccaagaatcgaagagtccaaagaagataaagttctagaagaggctggacctaaggatgggcccaatgtccttggtttaaggtttacaggaatcggaggaggcaggggaaataaaggggctaaaccgccaaggtcggcggcggtcttttgttttccggaggaggaagaacctccagtatgacggcgaagggggtcactttcgttttcccccgccgaaagtggaaggccaaacaataaccaagcggccctagggccaaactttttccttatctctgcctcctcttcaggggtcattcttagggcaagttaaggaaaatcaaaggagaatcgaagaaaaggagaatgatatgattacaaaacgcgaaggaaaacccataaaccaagaaaaagtcagaaagaaaatatgatgcaaccctaaaaatcctgatgctgacagagtcacggtaatgcaaaaacaccaaatgatacagaaagaaaggagaaagaaggtacctgcggtaatgaggaattaaaggatgattgggagaagaacgaagggggaacttgcagaaaatacgagaggatgcttgaaaggttaatggaagagaagagaggaagtaatatgaggaaataagcagaagtggcaagcacagaaaaaagtaggcacgattacggggttttgaaaataaaatttgaaatgtgatgataacttgcagtaaccaccaggcgcagggaaacgattcagtcaccacaatgaaacgacacataggggtatcatggtaaaagcacgtccaattatgagggcaagggagtaaagttacgacaatggtaatcattaccaggcaaatgaagtgacagatcctttaaagacatttattgccattaagggcaggaaaagtaactgattcgaatcaggaaggtcaatagccgtttcaaatatgttataaacaatctgggtacattactcgtccagggcaaatccgaccacaattattgggatgtggtcaaatgcagttacattcagcagaatccggatacgtgtatccataaaagtctagtcggagatgtttttctatccggacagtcatatgcctccaagagtggacagaacaaagcatagtcatgggaatacgtctccaaaacgatcgaagaattgtatccggatgaacgtagccggataagttactcggagtattgcggacggaggattatccgaatagtattctacccggaagaagccgactaattgtagtcggattaatggttaccctgaaggtagcaaatcacctgatgcatcccggctaccaagtatacttgataaccgggctggggggcaactgttatggttgtcgtgttcagattacgtagacgttatagtttgggcctgggtccaattgttatgaataattgtgcaaataacttacccatagaacgtggaggctgacttggtccatactgaactttgagaacatgctggatgaggccgggaatccaggaagcagttctaatgcccgttacgaggtattctgtttataaatacacagtaattcctggtgaaaggtacacacacacattctatctctctctttcaattacacagagcacacaccccacgtcaattggtgtatctctgtgatctcctgccccaaggtatcaccttccattgatatccttgaagctgcagagttagagtgatcaaacagcaactccatagcacttcggtgttatacatttgtgttctggaaagaaccagaacaaatactatattaaaaattaaaatgataattattttggaaccgaaagaatattatttaagaaaactatagtttcatttataaatttatataataccattgaatgcttaaattaattaatgcaaaattgttccaatttagatggtactagtatttattatctctggttatatatataaaaaataaaagatattttcttggttctaattataaaaatatagatatattttattgctaaattttctttttactcctaatttgttaggtctattaatgatatgaacgaatctctttataaaagctatcacaaaataaaacatatttatttgttgaatttgaaaaataaccatctaatttataaaatttcatgattatttttatcataaaattaaaacttgataaaattaattaattaaattacttttatttatcttgacaaactacgtaattgtttcttatagtatttagcatcagagatagtactattctttttatcaattttggtagtaggaaaaattgaatttgtaacttttttttcttcttgtcttctatttttctctctcttaattttgttaattttatgatactatttatatttgatgggaggaagatattagtagtactgataaagttataaacatataagtaatgtaaatcatagttaagaaaacgtggctgttgcgttgggaacatcatatagatttgtataaaactcattttccggattggcacagaaaaaagggtccggtgtccttgaccagacagacgaagaaactagaaaaatgtgagacgggccccttttcccttacgttgcatcagcatcttgttgttatgggagagcaactgatgtagtaggtaaagtccattgagagagaagagagtaaagtaacggccaaaataataaaaaaaaaaaacatcataatcttcagtttttttttttaacccgaaattatatacttaaatacaagattatcttaattgacagagcgatgcccattcttttctaacactgatccacacacgcagatagatataaaaattattctttccccatccaattacctttttcacaataatatcactgacacagtcaaactccaacaattacattcaacccgttacacttgcattacataggagcaatagctattttagctattgcctctcttctcttccaaacaaccaaaccaaagtactcttttttatcttccctcattaaaagctgcgtaacgttcactgatcccatcttcttccccgaaccttcaatccacatctaacaatacccatttccgcaaaaccaccaaagccaacttcttttctgttttggcccacaccccacatgacatagctaacccatttcaattggggttggttggcaccgtcctaaccttaaccaaagccaacaccttttctctttctccctctggggtttcttttttggaatccctgaactgaatttgcgttgtgaagatggcggcggaaaaggttgttgagatggtggcattggagtctttaggaaaagggttcgatttggccagcgattttcggttgcggttcgcaaagggaattcgtggagagaggttggtggtgcttgatgaacagaacaagagggatattttgattcctggaactggaggtgttaccattgaaggggtttctgagaatattcgttgtgataaaggggatagaatacgcttcaagtctgatgtacttgaattcaaccaggtcccttttctcctcctccttctttatctgttactgtagatgagttaggaggatttcgtttttgaattaagatctgtttgtttgtgttgcatttttggtaaactctgcgtttttctccttgctgcagatgtctgagttgcttaatcagaaatcagcagtgcaagggaaagttccttctggctattttaatgcgctctttgatttgagtggggattggtttcgtgatgctgctgacaccaagtaccttgcttttgatgggtatttcatttcactctactatttgcacctcactgcttctccactcatactgcaagaggaggttaagaagtctgttccggctcagtgggatccggcttcgttgtctaggtaaacactaagctgatacaacaatctggtagatagacagattatggtatctttgttttcctcatgttaaaatagcttcttttagctttataacttcaatttgttggtgtaaaaatagtttcgtttcctggtagatagacagattataatgggattgaatttgatagattcaatttgttgctagctttttgtgcacttatggttatgaccatccctgcaaaatctagtatgtttggtagccatgaactggttgattaaaggatttaatatcttcttaccttcgcatgaagcttgaattaacttttattagttgatgttagtttgtgtgttcatgtttgaatgttttgtgggtgaactgtttgatgcagtaacttattttgacagtttgaatggtgcataattttgggttgataagtatatgatgctaatcaattttgttaggcaggttcatccagacatatggtacacacataatagtgggtatggctgtaggaggtcaagatgtaatctgtgtcaaacaaaaacattcttcaaagattcctcctggtgatctcagaagacatttagaggatcttggagattttttattctcagatgtcagaagcccttctttactacagaggaagacagtagatggaaaacagaaggtatagtgctatcttttgtaactttaaggtatttattatttttctgctgacgcaatggctctattcatgtaggtccctgaggtctttaaccgtgtgatgcaatcaaacacaatgcaattcactagtatttcagaaacatcaagcaaggatgtaagccctgaaagggaaataattttcatttgaaataaataatttttctaggttgtgaatatattgctttatcttggaacagggcctcactattatttgctcaaaaagaggaggagatatgttcaagcacagtcactcaatggttcagacagtgccgtctaaccctgaagcaatcctcttcaagtttgttcctatttcctcacttctgactggaattcctggaagtggatatcttagtcatgcaatcaatctgtatctacgctgtatgttctaatctgattaaacaatgatactataatctactacatttatcctaatccattttatgtctattactatttatatattttcaccatggtgtagataaactccgaaataaaaattagggaagaggaagagttcaagttacacccttcaactttatgtccacagtttattccttaaacataaacaagcaagatggtcaattggcttcccaatgtgtgcataatgctcctcttgatggatgcatccatccaaaatttaacaaagatgtcatatgcctgtcatgcaaccataaaatccagaccaaagatgtttcacatgtgttaggaaacctggggaatcttgtatgtcttttgaactttaaggcataagccgtatgtagtgtgaagttgaagggtgtccactgaattccactcccccccccccccccaaaaaaaaaaaaaaaacaaaaccaatatgttttgggcttttggctcttagattgttcttgtatgttttgcttttctttacatgaagtttccaagccatcgcttcttgcacagaccactgtttaatttctttactgttgaggtgcacaacactccattgatttacttactctctgcagataagccttctcccggagatttacaatactttctggagtttcaaattccaaggcaatgggcacccatgttttgtgagctgcctctcaggcatcagaatagaaagactgcttccccttccctgcaatttagtttcatgggtccaaagcttcatataatctctacacaggtactgttaaccaaactctttgtgtttgagcaagtattgtatgtgttagactttactcttacatttgagtttaatattttccttgagaaagtttttgcttaattagtgtcaggattttcccgttactcacttctgttatgttacaaatttagctggggtaaaaaatttgttattctttaacctgcctaattctttaatcagttactttacctgttagtctgctacccttgagttttcttgtacaccttatttcatatgtattgtcagagaataggaaggagtctgaaataaatggcatcaagttaggattaggattcaggggttgaacaaggtgtgggatgttttcagaccgaaagataactcgttgtgagaaacactgttttattgtccccccccccccccccccccccccaaagagaaatttcattatagattatgaaagaaatactagagacgaggataagatatcctcctaaaagaaatcacaaaataataacaaatgaaaggaattaacaagaaaacccaaatacattgagcaaagaaaagatataatctctttatatgcaataaagaaacccttctaaaattgcacaataaagaaacccttctaaaattgcaccacaaaacaaaaatgaaataggtgacatctaaaagtatccttgaaaatactggcattcttccaatcatagacaccaaactcaaacaaaatctagtattactttaacttaataatcctatctgaatagctaattaggtcaagtactagtcctactagtattagcccaagcctacaagacttgcattcttccaatcatagacaccaaactcaaacaaaatctggtattactttaacttaataatcctatctgaatagctaattaggtaaggtactagtcctactagtattagcccaagcctacaaataataacactagaactatagaacctataggaacatatcaagaaagatattctaagataatctaaatatatcttacatattttcgaacaaattgtcgtgagaaatatgtaaggaaattcttgaaaacactacgaagttttaagcccctaggttatttttgcatgccaattgtgttggatttaactatctatagcattttgtctgcagttatgctatacttacaattttattggttttttttttggtagtaagctgtagtttagggtaaaagaaacattaaagaggatggacaattgtaaagtagttggaccaaaaaatttccctgttatgaactgagtcaactgactattctcaaagctcaagctactagggaaggcacatgaatagtttggttgctgtttgggggagaaaaggattataacctggttcacaaagttgtttagcaagataatgaggtctaagaagatgctacatttaaggaggaacagtattactatttataagaacaagcgagatattactaaatttttctaactaaagagcaattaagcttgtgagtcatactatgaaaccatacataagggtaattgaacaagggtcatagaaagaattctcccagctatagaggtattaagcttatgagcattattatgaaactgtagcaaagggtaattggacaaagattaagacgagatcattttttagtgtatgtttggttaagagataacatagttaactatgcattttctttatttggttaaaagaggaaatggagagaaaaaagagaaaaattgactttaagaaacaatttcaaaattttctcgcgttttgtttagtaaaggagaaaacacatgtaacaatgcttatagtggatcagcagcttcaggaccttgtgtaagcttctgctcacctctaataattttgggatgtgattcttttggacagaactcggaaatacactcaattcgaacaggtcataaaatgtgagcagtgagctcatgtgaccttatgcgagctcctggccacctatgagttatttatctgttttcttcattctatgtgctgcatagctttttagggattttcactgattttattttctcctctcaacgatcttgaattattgatcccttattcttaagttcacacaatattctcttgttaattatggtattttgtacaaaatgtcaggtggtaagtgaacaaaaacctgtggttggcatgcgcatgtacttggagggcaggaaatgtgacagacttgctttacatataaatcatctttcaagcctcccaaataaaatgatcctctcttcaggaacctcaacctcaagtacaccatcgatgtggcgaggatctgatgataatgaatccagtgatcaatttctggaacgaatcagatggaagagattctcaaatgtgtgcacagcagtggttaagcatgaccctaactggttgaataattctggaggtgtttatattgtaacaggtgcacaactccttagcaaagggagctggccaaggaatgtgcttcatctgcggcttctctttgctcatattcccaattgcagtatccggaagtcagagtggactgctgcaccagaggcttcaagaaaatcatcttttctcacaaatttgagcacaacattttcattcacacagcacggtaacactgggcctccaaaacagactccaactgcacttaactctggagtttatccagatggtccacctgtgccagttcgtgccggtaaactacttaaatatgtggagacagctgaggttgtgcgaggcccacatgatgctcctggccattggttggtaacagctgctaagctagtgactgatggtggtaagattggattacaagtgaagtttgcattgttagattattggtgatttcaggttaccgttcattctattcatggtatattggttgtcatgtgttgcttaaaatggtttcgaaaccattgatcacttgtatatattctttctacaggctgtgtacaggacagtatacaaaatgagtggctgttcacatcgggcaatagaaaattaaaatttgacaattctgttaattctggatacatttaaatgttgagtatttaaatcatcatcgtgaataagttatggggaaaatggaaaaaagaaaacacaaattaaaccatatatttgcaaatatataaatggggcgcttgcaaatcttttgtatcaagacactaggatgtgtgtagggaacatatttagtggcttagaaaaattaacgttgactgtataattatacatatatatggtcaagattatgttatactttttttaaatttaatatgggtgatgccaagtcctaggacaactggaaagttgtgtctaggtaattgataggtttgaattctaaaacggttgatgtacatatgcaagcattaaagttgcatataatgatactttctcatttctctagatttcccatacttttgcatagtgaggagtgtaatactctagataaatcacacaagaatgagatctagatgatgtgtaggtataatattgtgcaattgaaaatgatttaaagatattaattgatattatctataaaaacaagatgtatttactttttgataatttatcacctaagaatgtcataactaagtgtacttgatttgaattagttatgatatgaatgatcttttaaaaaaaaatcaaaaagtgtctgagtaaggataaaactcgttaaaaagtcttgtgtttgtaatctatcttgagaccagttaagtgatgtcagagctggttgttgaggtctggcaaatggttacttactgaagagtctgatgaacaaaaatgttaagtgaagtgtcaccgtgtgaaacgttatattatgagagtcgttgataagttgataataagagatgttaagtcttttgatattaagatactttaggtgacacttgatttgagtgaatataatttttttaatattttttgaaaataattttcattttcaaattttaaagatttagaaaacttgaagaaagtattttaaggtaccactgtgttttcactttttcaaaaaatgcgaaaaatgctaatttgttgtttcaattttggacttattttttaaaatattttcaaattttttttaacttttaaataaaggtattgccacttttgttttctattttctttgaaaatgaaaaaaaaaactatcaaaccaaacattatcttaattatttagttaactaaaatactaaattgaccttccattttaattatatggtcaatgttagttcttctcaggcactgatccttcatgtaatatgctaacataagagatgagagcagttaatattagatatccaaacatatatgaatagtgaagattattttcctaaatttgatcttggtcatgttagaatttttatacttaatgatctaatcattttcacaaacaatattagatcaatgcggaatgaaatagaatataaatacctccagccattgctccttgtattgggttgtaatactgcaatgtgaagtgatttcttgagtcttccaaactcttctctcaatttgcactggatggtgtatatgcactttatttgtgagtgagttcagggacactagaaattgaagatatacacctatatatagacctttccatcaaaggtgttttgtgtgtatggttatgatgggaagttaacagcggttaacaaccattgagtagttatgactatccataatgaatagttatgactacccataatgaatggttatgactacccataatgaatggttaaccaattaaggttggttacaaaataaaaccaacattctcccacttggttaacataacccatcatttacataatgagaaataaaatacatgaatcatggcgataggtcctctaatgtatgcgagtattatcttccatgtatcacattgcattatatttctcaattccatataacttaatgaataaacccaacgtttattctaggtccaaactttattgatgtttctcaaattaataactttagatgcgcataatctgaatgagaacatcacaatagagctttatcaaaacaatatcattatgatccttaaatttaaatggtggcatgcccttagttaaaggatcaacaatcattaattcagtgctaatgtgctcaacaaccactgtattatctttagcacattctcttatggctagatacttaatgtcgatgtccttgcttcgaccacaacttttgttattcttagccatagccatattaacagcatctgaatcatcaaagtatttctttaatgacttagaaatggaatccataattctaagcccataaatgaaactccttatccatacaccatgtacggtagcctcaaaacaagaaacgaacttagcctccatagtggaagtagcagtcaaggtctgcttgatacttctccaagagacagctccgctggctagcataaatatatatcctgaagtggattttatcaaatcaatgcaaccagcgtagtctgaatcagagtagccaattacttccaaattgtcagtccgtctatacataagcatataatctttagtcccttgaaagtatctcatcaggtcattcattttgattgtatgatatttggttgtatgatcaaaattagtttctttcgtgctctcatctcttaatacaatgcctatgtgtatagtctgtcaggcttatcacttacgatgaaagggagctaaacagtatattacgtgacttgagcagtaaatttatatcggtgcttttacgtttagtcaattgggacaggtttgcatgcattggctgcgggttgcactagatcaaaagacacagataactgacttgtgtttaaaccataaaatattatcaaaccaactttctttgtgcacaggaatagtgtatctgtagggttaggagtttaggacagtttctgtatatctttaacttgacatttgccacctgaaaatcaatgcattggcaatcattttaaggaaaagaaagaggaggtaaaggatacagtggaaagatggaaaatggtgaccatatctattacatgctcttgctaatgtatagctttcttcatattgttatttttttcaagtaaaaaaaaaaaagtgaaaaatagtactaggagtaatataagtgatgctacctacacaattatatataattatacttgattttacatgcccctaattgattattataattaaatttggatagataattgtgtaatgttacggatcattgtgatattagtagataaaatcaatgaaaaaaaagttataaattgatactgtcattcaataataattttatcataaatgataaatttattaatttttatgataattattttaaaaattatattaacgatcaatgttttacctatctaaacgatcactaacctcaaaatgtattccaatctcctatatttcgtgtattgataagtagcaactgtaattcctgcaagggttgtttcctattgtcataattataatagtaaattatgcaactttacttggaaagaaaggaatctttgatgggatgtccactaattgcgttgggtctaaactttaatgaccaacaagactagtgtacagcaaatgagcagaaaaagttaacaacggaaacaccattggaggactcaattgacaacaaaatggtcaaaaccattgcttttattattttttaaataatttttcgctaaaaatggctacctgtaccataatgaccattgaccaaattgtgatctacaagagaggagcaagtggagacggaataaaaaataaagaggcgggctttcacactttgcaggatagaaaaaaatggcacatgtagaaggtaggacacattggtgtttgttaggacgagtttttaaacttgattttgaatggttttgattatgttaaaattagttttagttaaaattatgttttaaagtaaggtaatacatgtttgaaaatttaatctcaataagaagtctacattaatataaaattctctccgaaaagttgtacttttttttactcctaaccaaacatgttttaaagaacataatttaactacaactaaacataattttcaagtcaagtttggagagaatccaaacatgcctatataggcatgatgcatgcacggtttcacactaaacatttctgtaataggagtgctatgcgaagaggggtatcaacgcatcgtgtaacacttcaagtgctaactaaccttaacgtatgtctcgtttggtcagcgagaatatactcgagttacttgcacctgaattaaagtattttcactatttttttttttttgtcttttgaccaaactcgggtgtgaccactggtaagtaatattaccatcttgcatattaatattataagtgtaaattttgatttccatctatcacctgagattaaaattttgaggataaattatatttttaatttttcaattttaacatttatgattttaatccttaaatttttataatcaatcaaagtcttcaaactttatttacatccaatgattttgatgggacgtttaattttattatcaatttattatgtttttaatttttaaagatttttagtggctacaaattaattgattttggtataaaactaaagatgtaaatattgattgaacaacgtagccgtgaatcatcatgcctcttttacattccaatttgtgatccacattcaaacaaatcaattgcaaccacattatgcatacaaaggagtaaaaatcttatcaaactaaatttatgtcctcattttttctgggtttcattttccagatatgcttcacccctttgtgccctcctctaccccctcaacccagccgcaactcccaccaacaccacgcccacaaactagacggtgaatctctatcttcacaacatttgcttgtaaaccccttctcaccaatccctacatttgcaacactgttttccctttgaattgcgaaaaccacccacgaaatcttactccaaaaagatataatttttgcacttcttatagctacccaattcgcaatatgtcaagcccatcgaatccctggatctccttcgcttggtgtcgctgccaccataggcgcacctgttgcctcgtacaaccactcgaagcttcagggaccctaacctctattattctttatgttttgggattctgttgtgcttaatttcggcactgaaataaaattgattaaaattggattcaacgtgttgttcagtgaaatgaaagaggaaaggttgcaaaaaagaaaaagaaaaattaagttagggtcgctggattgttcttctcggtgatggagaagaagataggttttgaaaaatatattcgaatttgggatattgtaatttttttcttcaaaattttgactaataatcaaaaaatttaaggaccaaaactataaacattcaaaaatttggaaactaaaaatataattttgtcaaattattattcaagaatttaagacaaatgtgctaagagtgaaaatcttggtgccggcaaaactgaaataaattgactttcgatgatcctttcagaataaccttctgcagtatgtttcatagaaagaaaatgaaaacagagagaaaaattcaattgaaagataaatgaaaggatatatatttttaaaatatttgttcttttcttttcaattaataaaagaaaataaattattactatatatttttcctaattttttcttctcatctaaatttattgttctttgcacctcacttataacttaaaattaagatattttatttggatgaaagaaaataatactacaagaaaaaagaatatgaattgaaaattgaatttttgagtttcaaaatttctctctcctttatattatcaattaaactcttaagaggcttagcttggttagctaaataatatatacgaggagaatttgttgtaaatattatgatatttaaggttaattttttctgtaaataaatagataaacaaaaaaagctcttaactctcatcaggctgagaattgatatatgatataaattgtacacaacaaaagtgaaaagtgaaacaaactaacatcaactaccaagaatagagaatgaaaattgaaaagttgattgttcaatcctcgatcttgggttcagtactttttttttagttgaagtcataatctgcagaaactttaacaatacgttttagtccaaagaaggaaaaagagaggggggattttaataaaggtaaggaaactgctttgtttggttcataacgagagacgaaaggaaaaatacgaataatatattgctttagctttatcattaaaaaaaatgatatcagagataaaataatatcacaggacaatttaatatgtactgtttaaaaattataaattacttttcttctcctttaaatctctaatgtaacagaggagacaaaataagggaggttttagtttcttcatttcttctttctttctctacaatttttttaaccaaatacaataaaattttctccttgatttcctaactagcaaacacaatgtaaacaatgctaacaaaatgcgtacaatatttgatttcagaatatagaggtcaatattttttttttgagttagaaataacttacggctttagttctagaattagagttggtggagaataaaatactattaaaactattacttgacaccaaaacaactcaagtaacagatacacgatagtcgacaattttttttggtttacttaaattttaaaataaatgttttaaacaagagttatattgaaatcacacatataatttggacaaatcaaagattaacaaattactgaagaactcagaatatcaaatttaagcccaaaggcagcttcaaaatgtttataaatgataccttttacagtatattaaaattttggttcatggcctcaatcttcttaataaattattttaatggaaattttgcttttcccttcttttatatttttcggatttccaccgttagcaaacagcatgtggtcgtcatatgacaaaagcttctggaccatcaaagaattgatggaccttttggctatttgcttgagaaagcacaaacagtagttgaagatatttgttgatttctgttcctttatccacatggggtccatttccacccccatcccttcacacctcacacccttaacagataataacaattaactctttgaagcatcataggtggaatgagtgcgattttcacgagctagcgtttccttttatgtgaattatagttattagattggagaaaaggaaccatagaatagaaggagaggattaacaccatcatgtagcatgcatgtcaacaattgactatctagattaataaacaaaaagttggattgcaatctcccccagaaagatacatgacaaaggaagaaaatccaccaataaattagttaagattgaatcttagatgggtgtaggccaattcttctgaatttcaaagtggtaactagtatccaaatagcatttgcgatcatcatctacaaactgaaacaaaaaaaaatagttagttcttcctactaaaaaatgcaacaatactaacattttatccgttccaaaataaatatcacgtttgactttttaacgtaatattaattatttttccattaatactcctaataagtatcagattagtttttcaatgtaatgttatattaagataagttttgtaaaattgttatgctcttttatttgtttattaatttttttggatctgtataaaataacctagaaaacaattattttagaacggagggtattacaaacagtgaataaatattgtatgatgtaaattaatattcttaccttggttcttgctgaataggttcccctagcaaacaaccccgaaggggtagtttcttcttccaattcatatgtatatggttcctggcttgggctataagttcccaacatcttttttgtgttgtctactatttcaataaattcatgaaagccacatgtaactaagacaattcgatcaagatacggatgtttaactaatctaaaacataaaaggggttttatgtctcacctctaagcccagttttccaaacaacattggtgtatttgaggccagaaacaatgttgttggagacagtgaaggagaatttcaagcggtattgacttccttccttaagggtgaagatactcttcttagattcagaagtaaatggaattggcagaatgaggtcaggcctccctggacatattatggtgaggctcactatcttcacttctggctccttgttttctgaagtacaatacaagggcttttgcctttaggttatttaggactcaaaaataataaggagctgaaatcaaacttaatgattcaaatatgcttaaaacaagaggtaggattaaaatcatcctagaccaacatttttcatcaaaatttgtcgtctccaaaaaaaggtgattcaagtgagtgaaaaaaagggatatcttgtaaacgaaaaccaggagaatgctgctttatatgaacaaagaaattaaattggatgaagaggacaatcttcaagaagagttttcaatactgatgcactatttatgtcacgtcatctccacttaattaataatcattgatactttgatagagttgttccagaagaaaaacaaaatggaaggaaaacaagtacctccaacagcagacatatcaatacctcccagaagttgctccttccattttctcaaactctcatcatcctttgagaaacaaaagaaaaattgttaaattgttgaatccctttcatcatagaacagttggaaacataacaaacaaatacaaagaatggcagggcagtgaagaaacatttgaaaaaaagaatgttactttatctttctcaagctgttccttgagggaaaactgaggaccaagatccaattccaacttggggtcttcctctgcctctgaatcagttccttcagcatcatcattgtaaggaagctggtctgcttccccaacaaccttgttgcttcctttgtttttgatatcttcctccaaatgagcattgaagggaaaatccttggttgcagacacagcagcagacattgtcaacctcaaaatcacagacacagtggtgtctcaaactctattggtagcacttccaagtggtgccaaaataagacctcttggctattctttgaggataattctatatgcctcttgccaatgaaattgagccttacaagttacaattcagaggtttattatgtgtaagcaattactagtagttgaatttaagataagggaacagtgtgacacggtgaatgtgggcctgaaaacgaaggtaacgaaaaacggttggaataaagttggtagggaaccacaactaaaggtggagaaggtcaatacaacaaataaactcagatctccattatttttatacatcatctacattgtttagtacgacagttttaacttttaaatgttacaagtctttgaccagaaaaagaaagttataagtcaacaaatcaaaattactaattaataattagtgtccacaataagttcattcagttgatttaaattcacttgcgcgttgacaaaggtaaaaataaaaatttactacgattaatgcctcttttaacttgttaagaaagttgattaatttagttaataatattaaatttataaataatttgtattatttttcaaaattactcttataacatttattgtttattgactacaaaaattataaagtaattaaggatatttttgtcaaaaaataattaatgtaataaataatttaaaaggagtcttataaaaaaaataaacaatataaggacaacaatggtatatgaaactaaaaagaatttttatattgtcaaacgattataaattaacatattatatttgtattgatttttagaatagttatcataaaaatcagtaaatcataattttttattgattattagtacaaaaaaatttacaataaaaatacataaaaattaaattcacctatctctatatattttataaaatttcatttatggtaattcacgtgacacttattcaaaattttaaatttttaaatccttctaatttaacatttccttttttattaatattctgattttgcaattatgcctttgttgaattataatattttcaaccttttagttttttaatcttttgaaattaacttttggcttaaatatgatttaaattcctattagtaaattttgtttggagtctctaatatatttttttgacaattttttaataaaataataattttattttaacccttctaatatatctatttataattgaattttattgacaatatcaaagacattatacaatgataaaaaaaaaaaaaacaacggctacatattacctgtctaaaggtacaaagtatgtaatactacgcagtacccaccaaacaagtatagtgatttcccctttttttatgacaatttttcatacatccttatcctagtatactagtatacatgtgctgaatcattccaattgcctcaagcagattgagcttgtagaaaatgtttcactagcaattttgaggaggaaatggtgcccatgacccaagaagaaacccacatgtgatgacagagaggtttaggacaaagagaggccaaaatatttgaccccaacaaatctttatgtagaaagcacatgggaaaatcaaacaaattgcaacacttagtagagaaacagtgaggctgaatacatgctcaaaactgaaagagcaagggatagtataaccaaagcaaaaatgaacccacactgcccctaattatcatttttgtcctgtcactgttaaacttgggaagccttttctccaactgaatagcgaaaggtgcaaattccagggcatatttggttataggcgtcaccacggttgcccacagagcaatctttgttacaaaaagctttggtggcatgctgagggttacctcagaattgacatccgccccaaacatattgccacccatgaaacccaaggtcgtgtaaagtaatgtaactaatgtgaagctccctatagatacctgaattcccaaattgaaaaattagaaaaataataattaataaaaacatctcattaatcttttcattttttaagcataatctcactcgttgattttttttctcatcctattcttaagcaattgatgaacaactatactgtctatgcatacatcatatgaatttaattttgttagtcaatcatagatggtaatataattgatttttttttttaacttttgtactaattactttaaagggttaacaaaaaacaaatacttcaaagaatttaattttcttgcaataagaaattattattaacatgatttttttaaggtaattactataaatgttaaaaaatttaccatacattaaaaaaaaatcaatgaattttaataaacttttactttaaaagtcatataaaaaaagttatttttaaattagttaataatgtaaaaatattcatcaacattaaactcatataatatatattatttaccttggtaaactttgaggggtctttcatggctttatacaatgtgtcatcatagctgaagatgtaaaggccagaaattgaaggaatgttgtggaggtggaggaggggtatcttatgattaacttgaacacgtccaaaaattggagtggatgctactgacacaaaattgacaagggacatgagaatgccaccagttggaaaggaaagatatggaagagagatctctgagccacaaactaggcagagcaatcaacactgcaccaatgatcaggagctatgatttagatagttttgccaattgcagcttcagatgcatccctgagaagattgaattcaagttgtcatgcaatgagatggtgtaggaaacaagggccatgaagatctccatgcagatgaaagttgtagctatgaatcttcctttttgcaccaaatgcatgaccctcaatgtccacgtaacttcttaacttggtgttcttttctagtcatttcccaagtaaatgagaactatatgcacatatcacaccgagtcctataagcaaaaaagcagatgtccaccctccttgtctagagcatatggagttgataattgccccagacctgcaagatattataccatatgttaaataaataaatgtgtgtgtacgaatgcatgtgtgtatatatagggatcgaatagtatattggagtaaacatacaaaacttccaactaattatttacagtgtcagattatatgtgctaaagtatacttaaggtgtttttcctatatatgctgcgattcggttttgacttttcaatactgagcgattacaattaattatgatgtcactagatcctttattattcttaattttcaattagtgggtgattatagaagtttctgttagattaaagaaaaaaaatgataatcttgccatgagcatcattgaaagagttctctcgtgtatataagtagtctgtaggggaatctcatgttacttatcttcacctagtggttatatttgaaatttgaaataagacttatattatatgatgctcaaaggttgactgaaataaatgtaggctttatttgtgattctaaaaatataatatgatttcagtttcatacttccatgcaatttttcaatccttagcaaatgtaatggccaaatggagattgaacatgctaatttattcaataatatgatataattgaaagtaactagctaaaaagactaaaagggcacattcatatatgttcgttcaaatggtacgtaagcaacagtgcaaactttaccatcccgaccacattgatgacagcatgagtgaaagaacaattgacttcagagtcatgctgtgtatctaaattggtgcccccttctgcactctttgtatcctcaattttgttttggtcatacttccattgtttagtttcctccacgcaaaaaatgcaatttgccaggtttgcaccatgcactgactcagcgttatcaacttggttcttgtgctggagacatttctgttgaaggcttaggcttttccgcaaagatttcaacatgttggtcaacatatatactgatatcaagttcccatagtttaggaaaagcaatagcaactcaagcaaggttcactaagatgcttgctgagacttgctaaccaaatggcatgaaaggtgtgtatttatagttgaataaatattctgaaagggtcagcgagatggcttcaagtattggagagaatcttatattctttcacctttttaatttttgcaatgtaatgtttttttttttttttatatcgaaaaatgttagttgcaatgttagttttgttagtagaggtgatcgaatccataactctttttcacttcctttttccattaaccatccaacccagattttgatttgattctgaattggattatcaaattgctagatgcaaagttaattacattagttaaatgtaacaaaaaagagttgcattagttacaggaaaaaatatgatggccactgtgagagattcaaatcagtaatagcggtgatattcgattctaaaatttcaacataaaacactatccaagtttttggcccgaaacaacggtctgacattaaagtgcaatatatatatgaatgattttaatgttataccattttgcctattattaggtgttccacttgcaatatataacgtcataccattttgtggagttatttataccttagtaaacacgatacgatttgaatattaggttccacttggaatatatatggcgtcgtcactgtggctgaggaatgcttggcatgcacaaatttctactcactttattcgcaatgtcggatgttgttttttgttctatctttttgtggggggagtccctggagaagaaaattaatcaatgggagatacaccgcacaaacggcgcctaactgatcttaattataccattgcaagatacttaattgtgtgtttcttgctttgttgacccaactaattacactaaaaaagaaaaagacgactgattgatatagctaaaatttaagcaggtgatagtatgatgttatttctgctcttgcaattagggatgacggagttgggtgtctcgttacgtggacgggtgttcgttatgcggctatgtgaattttttcaatactattccggaatgtttaaaaaaaaattaaatatacttttatctctaataaatatatatatttttatttatttttaatgattttttattttgcgttgagtctctaataaaataatatttttattttttatttttgataatttttttaatctaggataaattaacaaattttatattttctaatagaataatagattttgttttaatcccgactaatgacaaataataataaaaaattatcaagattaaaaataaaattcattaatttattatagactaaaaacaagtgataaaaaaaattattattttattagagactttacataaaataaaaaattattaaaaacaaatataaaaatcgaatatttattagagattaaaaaatagttaagccttaaaaatattttattgtaagattctcttttgaaaacagtttcaaagttaaaactaaaactattcaaatagtatatacaattactctacacaattatactaatcaagatacttcattgtaaaaactaaatttaaatgttaaaacacatcagtattgcaagttcaagcaaaagtcaataaagtagaataattcagttcttattatttagagagagaaaattcaatccttaagtataaacttaagtataaacaaatgttaataaaatatccatataatttttatttttttaaaactagaaaatttaataaataattacaatatttttaacaaatttctatttattatcgtaaatataatataaccaacttatgattttttctattttcaacattaatcactccattatccagcacgcctaaaaaataataaaaaaagtatacgaccaatttagtccccatactttacacttgctcacaattttgtctctgtattatgaaaattatctatttagtccacaaatgtcaaaggccatgacaatttggctaaaccgttaaaatccttgtgtttctgctaacaaacatagcctacatgtctcacattcatccacgtgacaagtacaatgtgtacagtaactttctacctcattttggattaaattatcattttttcttaatgtattgattttcaaattaacaaacataatgaccacatataaatgaactctccttctaaaaaatttccagcaaaacatatatacttactaaaaaattaatctctaacaaatattattaactaacaaactagtccacaaaataactaataatatgcactcagtagtagaatcatccatgaaataatataacatgcacatagtccacaaagctaaaatgagcattcatagaacataaaattgttattcattacacataacatactcaagttcccaagtagtagtaaaatttctaccatgattgtacattaccaagaaaacaaaagacaccaaaacatgccacaatgtcactgacataatagaattttccaaaaatatatccaaaatatgtctaaacacatgtcaatgcaatgttccaaaatatgtctacaacattgtattcgcaagtgaacacccggtagaagtgcaatcgacattgggaaggatgtgcgtcgtgttcgtattctaggtcttgggtggtggggatgacatcgtgttttggtcgcgtggcaaacctctatactctcgcaagtggccattagaggaagcgcaaccggtgcctagaatggtgtgcattgcgacaacaagaagagaggaatgagggatggtttggtgggtggagttgactttcagaaaagaaaacgtccaaaaaatgactttttgtgatgttttacactttttaattttcatgacaatttagtcccatatgttatatatttgctttatcatgtaggctataattgtaaacataaaaagaatgattttaatgaactaaattatcgtgaccactgacatttatagactaaatatgtaatttcataaaaagaaggaaattataagcgaatataaactaaatgaactaaattgcatttacccaaataaaagtaaatagtttcccgccattttgtgccccagggccaaataatttggcgcggattcagaacctgggagggaagcaactcgcacgctcactctagtctacagtcgattgggagtgttgcagagagaagaaagaaagcgatggagatcgttcgtcctcagagtcgcagaaacttgttgtcctcctccaacgaagccgtttctgctcccaccattctcctctatcgctctgctcccccacttgaagtcaggctcgaggatttcgagtccttcgccatcgatcgcctccgaggtctgttttcttcatctctatacttttactgttttccgcttcttccaattccagagatctgtttcaaatttcctctctgttcgtgcctagtgtttcgataatctgctctgcttttaactgtgtccgctgctccacacatatatcctagatttaagaaactagtgtcatgttgaagtgaaagcctgaaatctgcaagcgatttgtttttttattttattttaaatatattaaattagtatgaaatcgtgtgtgtttgcatgtgtttctttaacttccgttgacatcggacatttttcaagttttgtggtctgtttttcatggatattattacttgttgcagttctcaaggggatttctgatggtatgtcgcggggaaaaaaagcggaagaaatggagaatttggtaaaaagctcgatttgacaatattaatttattagttcatgtcttgtggttgacaaaaaagaaataatgctgtgtggtggacttttccatgtgaatcaccccttgtacaggtaaaggacctgtggaaagtgaatatgagacatcaagacgcaactcaggttctgaacaaggatattatatctcattttgttctacgtctggtgtattgcagaacgtaagagctcttatcttctctctcttttgtgcattctcttttactgttgttccatgccattgaaaagaatcctcggttgtgtgactaataatgcctgatcaaaataaatggaagattactacaaattgaataaattggtaatgatgagagtttaagaccattggcaccaattacgtatattgatcatattttatggttgtgtaagtgtattaatcctgaatgatgctttacccagatcaaagaaaggaaaaagacaaattaataagaaaactgttgtaagaaatatttctaaattattccatatatactaaaattacataatatatgcctgtattcccagggaggacttgaggaaatggtttctttccatggaatctgcactctttcgctaccgttttcgtcttctgaatgctgaagctcaggtaaaatctggttactctatattgtttttgcatttgaagttaagtacttattcatcatatactttgtttatgagtgcacagagggcagtcatggaagaatttgaccttccttacagggctgttagcaatgtggaatttgaggtagtcacatcatttgttttattggtttgctctggactcttgaatctgaattttaccatgaagttgatttgtgcaaaactaattttgttctgagttacaaatacctcttagtacctaaagaaatgatgttttggattttcagagcataaaagagaaattgggacaagttgcacgttctatgggtcagccttcacctactggtaggagcacattgctttttctttttgcaatgattatttagcatattggtatgaatcagcagaaatgatttgcatgcaccatgctggaggttgttgaatgaataggaatataactagctgttgctacctaagagcgaaggcgcatctttttttagattttgtttagtatgtaattgtaaatccactagtgagctagcagttgcatgggttaatttctgaagaaagatatctagggaagtttttcaagtggtatatttgcactactattatacaagaaaaaatctacagtttttgaaatttatgcctcattttttttcttcaagttttatttcctggtttttattacttttccaaatctaacgtgcctatgttttgcttggcttcatttacttttttttttgcagctgatgctatcttctacaaggtatgtgttcaatcttttttttcgtacttatttattgtcttgcaagagagatccatgcaccgggtgacatgcagttctactttaaatattaactcggtgactgttttaaatattgaattctaatgattcttccttgttcacaaaaaaggaaaagaaagcagttaactagttaaaaatatttgaatctataaaaaaaactgttaggaaatagtaattaattatcctttggtattttttatttcaaaagcttgtttttgtgtgagagagggagtgataaacagagatgtcttctctcacgacctctagttgtgagagaagacatctctaacattctccctcagtttttgggttgcaacatttgtatattttttcttttatttccatataggtaccgtttgaagaagttccagagcttgttgctggacggaaagtgtttataaatcaaggatatgcatatgttgcaatgaatcaggttgactagtgtaattacttactatttattcttgcaatgaatcgcagagtattggttatagtaaatcttgtttgtgtttcaactttgcctccttcatagattgtttcacttgtagccacactattccgcagtcagctgtcaaaggcacttatccttacaaacaggttttattggtcatttggatctcaataaattttctcacatgcaaaattgatttctttctttaaatgcaatttgggatttaagatgcttagagattcatctaattgttgcagaaaatggacatcttcaattagagagcaagagaaacataggttgactcctgtacgtgtgggttttggtcttgtatatcaatatatcctttctttgttataaaagttgactagctttctatgtagattgtggaagctctgtcctcaagttatctgggtcctgattattctcaggtaattcaaatagtatattctttcatttttatttctgttattaggtatttatttgaggattgacaatgttcattttgattgaaaacctctgcagtcaagagaatatgctgatatatcattaaaggacatagatcaagttgccaagagctcatttcctttgtgcatgcgtcacctatttgataaggttagagattgggaaaaattatgctcatgtgtttcttcctgcttgattcatctgtaatatctttctttttacttatcttttatctttttcatattgagtccttatattgtatttcagttttgtctgacgtcttgatttataccactttttatgcagctgaaagaggataatcatttaaagcatggagggcggatgcaactaggcttctttctgaaggttgcgtttggcttccatctgggcatgataaaaatactctgtagagtctagatgcttataagtttgaggtgttaaatgaggcttgacacttcacatgtggtttatttacacatggtttggagaaaggaaaatgattgtctggaattatcgtgacattcaagttactttttttagtttcaagtaattaacaagatataagtggagaaaattgaaatttgtgttttttatacccataaatttatgataccctgagtctgaaatttatgtcagccttcgacactttgactcatttcgtctgggtaaaatggcacaattaaagaacacgggtttatggttgtatgattatgctgggttagaaataagtcaaagtaatacattttggttcacttttattctgatttatttttgtgattgatgagaaaatcgatgagatgtcttcttcatccgtttacttcttgattactgtttatctattttcctccttttgtcttctttattctcttatcttttgttcttttctcgataatgtaaatagggtgttggcttaaatctggatgatgcacttgcattttggaggtcagagttctctaaaaaggtaagcacacttcttgcacatgatctacgatggaagtattcgaaattatatattttcagctacatgaatagtgaattagaatttcaacagttttagactctgataatttttgcacattatttcataatacttttaaatcattctgaagatgtatacctggtctagacaatgtattccatatctctctagacatctttatatggtctttgaatagattttttataagcttctttcttttaaaaaattacatcaattaattaaatgtaagatctcgttgtaggttggtttggagaagtttgagaaacaatatgcatacaacatacgccataattatggaaaggaagggaagagaactgtaagttttgaatttccccaccgatttatgggatgtttcaaatatatttctgttgctgatttcctttttgaaacacaaactttcaatgtttttgtatgcataatgcatgtatatgatgatgagtttcaacaagtaatgttttgatggatgttacaggattatactccctattcttgtcaaaagattatttcatcaactcctggagctggagatcatcatggttgcccctatcgacatttcaggtcactcttaatactcgtgctatcaaatggatagttttgctttctgtattggagatgtgaaatagataagttattgtcgagtatattttacttgataaatgctttaataaaattataactctgccttttggtgtcacaagtcttgctttctaaagactatgatctgtagtgaaattgtgatgggaaccaggcaaatcctcggttcgcaaaccaggcaagccacccatttggaagatgtacactagcagacagcaataggaaacggcaggagtaactgctgcgtgagagttgtaaatagaaaataattagtaaaaattctttattaggagcatagtggtaataggaaactgcctaatggcagttattcatagaaaataactagtaattagttatatattaagagtataactgatattaaggtctgtaattaggcaagtgtgttattaattgcagtttgtggacacagtattctgtaggagacttttgtctatggcgttgcaagtgcaactatagtattatattttattaatctatatttgattttctctcagattatttgtttctcttgactgtactacaatatttatttatctctctttgctgatgagtaagttatggttttactataaactaaagcacgtaagcatgctacaccttatttgcattctgtttctgctaaatacattttcgggattattattattaataactcaatcattgtaataacaaatttttgtcattgacgaacctaatagtggaatgattcaagagcaatttaaacccctgtattatgcttacaaatttttacttcgtagtttgtaggcagcaaacaagtgcttgaatgatatatttagtaattttatgttgaaaatgataatgcacttaagaaatagtattttcatgtaatatcttgtatctcatgttaaaatgctaattgtttatgggtattagtgtctaggacgttgcactaaatcaatatcagcttagtaataatccccactgcatctattaggagtctccctctgtccgtgtctgtgtgtgtctttgtggatcacttgcataacctatgcactacagctctcttaaataagaaagcattcatattctgtattctctccaaaactctgttctttcttcatccttctctccctctctaaattcaacgtactacactgttttagaaataatgactttcgtatgtctgtactctgttaatgtaatgaatattttagttgtaatttgggcatagcataaagcttggctctattcttggtcatgttctttgatcttgatatgcatgcatagttgtgaggggtagatcgaaccacagggagtaagctgcacatctgacaaagttgaagggggttataatttactaatttttaattattgttggaaatgcttattctgttcggattccttactggacagtattttatttattttgtacggacattgggatatgacatttaattgacgctatttgaatttaatagtgaagagaatctaagagctgctctcagcagaatgggggtaaacagccgagcgatggaagatgtgatggacaaagtgagaaatagacattatcaggtaggtcttagcacaacccgctgaacttcaataatcaattttcaacctttggatttgatatctgattatatggataacgtttgagcagttggcttgcaccttgacatttgaagctcttcatggcatgccgtgtgatgcagggattaaccatccaaatcaatacttcagtgacagtcaaaagatattaaagccaaaggtagccagtttacaaattgtgattcaaaccaaatacttgttaattacagctgatatgatgcaatgtctttgttgaatacatttttttttctctccataatacagtcgacaagtgtaatctgatataagcctactacttgtcgcctgtattgtgattatacatttcttattagtatgaatgtgaaaactgaaaacgatacatcaagttatcaattaatcatgacgacagtgaaagcagtcttgcattaaaatataatacaagaatcataataagctactggcatatcctggatagataataaattgcaaactgcaaagtcccccacctaatcttttcgatgtttaatgaagaatggcaagattatatacacaaaagtagatgtagcaatgcatatagcaatccagatagacacgtgtcctggttggaagacaacttttctcttttattcttgcctttcaacacactaaacctgaactgaaggatatgtttaatatcaaattataacaatttccactattaaaagagggagatagtcaatatcggtggataaatgcaattgttattatccccaagagttctgcaataccccttggttagtcaaagtttctaacggttttggagtatgtaattccaacataccacagtacgtgcaacatataggtggacccttataatacagtaaatagtatcactaacgtgatatttattttttgctgatgctgactttgctgacctgaataccttgtaatctgctctctgcttactcacataacgtgatatttaattatttattcttcatcattattatttttttaatgcagaaggattcttcaacctaagtaatttagttattgcagaagactggtgctggggcctttctcaggttgacttttgagccttctgtcttctttttccacattgttttcagtacctttcttgttctgtttccttctggttgtattcgaagctgaaaaaatatgctacttatttttgtaaatcgaaataatatatgtttgcattcattaaaatatatgttgataaactaacgaacattttgcacattttaaatttcatataggtgtcacacgttggtgcctctagtcatggatttgcagagagagacaatgtggtaaaatcttaaatgtagcttccaaagcagtttggaggcaggagttggaattcgagtcatgtattatcctgaaagtctggttgaaaatacggcacaactagatattctttgtagtatacttttcatcttttagccaaacacttgcatgtaaccctgttaattcaggtaggcgtgaaatgggaagtattgtagcataattatgcgatgaaactgtacagtataaaaatgacactcatgaatcatggtggagtatcggatcctaaggcaatcatttaagccttcccaactcaaatgaggcaggggaacctttcaaggaagataggtgcaattaacttttgatatgggttatatgatgccacaaatattccaacttccggatgttatgtacttataatacccagaagatttaatcatttaatttttttagcccaggtgctggcagtaaaatgttcattctttaatctttttccgtaaaatggttatgaattataaatggttcattctttttccctgagattcatatgcctattacatcttttatatgacttagaataatgagtttaatgattatatattaagcattgtaaactaattttatattaacataattataatttatcgttgaaatgatttttaagatatttattgtaaaataaataaacttattatatatgataattggtattagatgacaatgaattgttttaccctgtttaattcaataaatcaatccggatcccccctttattgagccaacccataacttttcaaatctaacttgaacttcttatggataaaaaaaattaattctttttctgtttcaaggaagaaaaaaaaggataagttttgcttaggtcaaaataagcattaaataattctcttcaaaataaaagaacgaaaacataatatagttctttttaaaaaattgaaaaactcttttttttttaaattttagctgttcataacaaattttaatagcaattatttattcttttcattctcattttcacatgaaaaagagtcctctcatatatatataaaaaagtaaatcaacccatgtgtaatgtgtggtgacgagttaagtgactttaagtctttagcaactctaattatgtaccccagaattttttttttacaagtacacaaaaaaaatcctctaattttgacatgtgaaaaattttgtggattgcaacaaggattgataggtttcacatgttgataagtcaagcaaccatgtaacgcatgtgattcaatatggtgaatcgaggatatagagggaagtcatgtctactattttcgtggctggcaatcaaactatcctccttcagccatgcataaattgcaggtaaaatttatcataattaagaaattttggcaacacgctctaactttgcaatttatctccatccattgatctggcgcatgccatagatgctgtctttgtcaagtacctcaccacctcataaatggatggagaaaagtgcaacagaataatattcatgaaaattccatgtgcatggagcatccattaacaaccccatcatcaaaagcatatgaagcctttattattattattattattattattattattattattattagttaaaaaaacaggcacttcataccttaattatctttttttagttagatgtagttgtaataactgttgtgttgaaaaactaactatttgtcattttagatggtttttaagagtagttaaaggataaattaggaataataaatatgtacacaaaatgagataattgtatttattaataggtatagattattattactactgaaaaacaaacactccgtgtcttaattatctttttttacttatatgtaattataacaactgtactattgaaaagttagtatacaaaaactacttgtaattatggatgattttaaaaattaattgaagagtaaattaaaaataacaaatgtgtatataaaatgagataattgtctttattaataggtatatattattattattattattattattactaattatttttaaacataaatcactaaaataaagtttatctttttcaacaaaatatttttcattcacataattaaaaatcaaactcctaataatatacttaaaaaaattcagctatctgccaacttaagatggttgtttatagggacagtgacaaatctgaagagaaattcttgagtgggtataaactcaactcctcattcttacacataatcaataaacaattataactgaaaaataaaaacaaaaataattaatccaaccgtctatcaggatcaattacaaaagtaacaagtaatgataagattattttaattattactttatttacagaatgccaatttaattttatatactcataaaatcataaaaaaaagtcacctaagacgtttaaagtggcttttgtttaactcactaatggaattttcgatatatgaactctttggttcaaatttcaataattttattgatttttatgatatttattataaagtcatattaaggattatttctaattaattcacagtatttttttttacaatggcatgtctatataaattaaagtaaaaagaatgacttttgtttgattaattttatacaactaatacaagtttaaattgtgcatgtaaatttataaattaaaatccatttaaatatttacatgaacaattaaaataagacaagccgtaatgtcaattttagagtctaaattaaatgacgattatttaaattagtgactaaattttgttttttcgtaagaaaatatcatgattcaaaacgactgataataatatttactaaaaaaggaactaaattgatattttattctattaaattcactcaattaataactattttataaaatcatgaaataaaactgatgtaacagtagttttaatgtttatgatattaaccatccctaatttttttttttcccgcatgagtactctttaggaataaacatcgtacttacgacagtgagtgagagagagaggattacaaaagcttgtatattccaatctatagtctagagttaaatagggttccttgttgtattcgaagatccattgtattgttggtggtagtggtagagtgaggaccataatggagttttggattcacacagcattattgtggcacttttctccgttgcacgccaatttctttatgtgttggggtttgaaccctttgttttctcttagttacaggcaagttgagagtgactttcatataatgcatatgacatacacatacggcttgcatgtgttatgtaataaacctccatacataaataaatgttgtcacctcacatatatcatccctcgctttccataccaattaaatcaccttcttgtctttgtgtattaaatattaatcccaaataaaattataagattaatttggtgattaaaaaaatcaaggaaaaaatcatggattttaatctcttctattaacaaaactaacatattgataattaacatcgatcttttaaaaaaaaatgaaaaatcaacaccaacttagatgatttatgaaaggaattttatgtgaagagaaacgtttgttattgataaaacttactttcaattatcaataggattttctttatcaagttaagtttcaaaacattattttacaatttaaagaaattagtttctgaaaaatcaagaataattttatgaatttaatgatcatgcatgcattgtcatctaatcatgattcattgttaatataacttttaaaataattaatgagttgtaaaagttaataaatttacataagataattgtgattgaatcaatatataactctttttctctaattttatttactcacattaaaaacttaaaagtaaaaagtaagggattttattagtcaattgatcaattaacactgataaatttctgctgctctttcaatatatttttggaagtagccatttagaaatgtggcaatagaagcgcatttattttagtcatcactttcaaccagcttagtgaaaattggaatcactttacggttatggctgcagtagaaagtagacaaattgaaattgtatctgacgtaacatgtgataggctaacaaaactgtaattctttcaaaccagttaactgatatatgttaatttgtaacattgctgatgggtcaatgacattccttgctcttcaataatttctttaattatggtgttaataatttcatccctgaaattgaacaaatttgtttaacgctttaacctcaatgaacacctaaaaatgatcattggcccagtatatttatattctccaactaaggtagtctcaagtttaattaaagtctcatctctctaccaagtgtacttgaatttaatctgctctagagcctcacctacttttgtggcatgccaacaacagagtaattaatttgcaataattaaaggatttgaatccatatccaagtttgataattgaagcacttggatgtgtacctctctcatcagtcatcactagcatgcactatgaaacatgatgtacaagatattttgcattgggcagactttggtgcaggatttatatacaaatcagagcttctaaccatgaaagacctcaagacaaaattggtaaaatttaatcttttatatatgttggggtccgctgttatcaacataataatggagctcattgagtggggctatatgcagtcgcttttcaaactctgcttttctcgtgtgtggtggttggaacttttcaagtacccataactttgtttttccatcgtgaactggtagtacagcatcagtcgtgttcctcctttcacaaagtcctttttattagtttgaataacaacgaggtacaatgatcatgaccaaacaggaatcactgatgaggtattgatattaaaattttcaagttataataacttgtatatatatcccatttgttttatacacacgtacgtgctttttgtttaagtagcttgtacagttgtacttgtataaatttaaagcttatttgagactactactagcatatctttaaaatatttaatgaaaaacttgtaaattatttaggctaattaagattatcatctttttttttccgtaacgtatatataagagataatgtgagtcgcaatcatcttagataatttacagtaattttaacttggacaattatttaaagaattaacaataaaatctggctgtacatgtttttcgatctttatttttttatagatgggttttgtgataactcagtaggaagttcattcaagatgatttggattcaatatagatcatgcatggatatgatggttaattatataaaagatcatgacatgaccattttaaaaagtaatcacatgactatgtgatttaatctcaactcgttatgattttatcacttggataagatttactcatttcattttctcctaatgaaagttttattctcacttgatatgtcccctctcgttattgtgatggtagggtttgtgatgagatgaaaaaccaaaaaaatcatttttaagttaagaaacatgccggagtagccaccatgggtttattttatatatgaaaatcttggaaaaaccttttaaaaggaaaaaaaatctctaaaactaccatgttgttggaacacaaggaatattattagtcaaaacaaattttattacttttaaaacaagagaaaaattaagaaaatatttttttaaacaaagatggccctcttcctcctatcgatctatacctgagtttaacaaattatattcatgttttttgtttgcaaataaaaaaaataagtctttcgcgataatcaaacaagaaatgtatctaaaatgactatcattaaatctttatttttaatagacaagtgttgcttgtctgatggaaatatataagtgatcagatatagactcacttcaagggctataaaaaggaaatgactagaaattaccatatgcttcacctattcaaatttggatgacttagatgatgatgcatgaggcttggagattttacagcagtgcaatcaatagacaatgaagtttgaaaatatatagtaaagcccatttgattcatatcctgggcaaatcgtttatctcataccctgatcctgtatacaaaaaaaagacttattagtaaagattaaaaataatcaagagtgtgaatgagttgattgattgagagtaaattgaaaggaggattgggtactaagacaacaaaatgtaaatatattacagatttatggcttgacccgtgcttgaattgtgaccttagctatatgatgagaaattttgggttgtaataattttgagaaaaaaaaatgagagattgctataccatcaatatgattagaagcaacagaatcccaatatttaggatatgacatatgataagtaagagagacaaatcacagaattaccagtttatgcaaagattactaaaatttacttggttgcttgaattagtcgagatactcatactcaacatatgataagatgttcatcagactcattggcatggatgtgaacttagacacaaatatgaacggaataaataatttgaactaatattcgcatgtccatcagtccatttacatcagtacattattggtagacaaggaatacataggtaaaaaaagaatatcataaatcataaatcataattaatcctacaattgagttaatgagaaaagcctaaatcaccgtcttaattacgataactagaaaactaatattaatgattgtaaaataaataagaaaaaagaaaacatttaggactaataaataattataataaaaactttaaactagaatctaattttttataaaattaagtgtgtttgtccacatgttaattaacacatataaaccaaaaaagtgataaatatgatcgatgtaaaaagaattttttatattaattataattacaaccaatgtaagaaataagatcacccatatacattatttttatattacaacttttatgtaaataattttttatcttatttgtttcttatttttgtgaaaaagtcccttttgattcatacactgtcatcttgcgttagcacaggcgtgtactcaggaatgccatcgagctgatcttaacttttcttttctttttttaaacaaatcatagttaaaactgaaaataataatttcaatcgcaaaggaaaaagaagcagaacgaaagtttgttcgatttagttttagtccaatttttactagtcctcctcctttatcaataggtagcaatccattgtagaacaacttatatatttactcttacaatttttattatatttaaaacgaaagagacggggtttcgtatagaaacacagcacaagttataatgtgagcccacttgctaattacgacgtgacttgtttaaagggaagtgccaaatttggaataaggtccacgtgctattatgttgatgcagatgttgttcgccttaaaatggtagagtttctgacaccccctatgtgctattttgcaatggacccacgcattcaactctatttactcatctacgtctttttcccttacccatccaaccatggtccccaccacatactacaaagttctacctccatctcatttgttcaactttctttgtctttcattcatcatcatttcctatttctttcttcttcttttttaaccataggattctggaattttttattttacatttgattaattttctttcattagaccgattcattttgaagtaaaataatatctttaattatgaatttatatttaaataaaaattaaaccctagttagacattaattaaaaaattcaattatcaaatcccttgtttcaatctcttttcttaacattaattttcctcctatcacttatttttaaacttgaacaaacaaactttaacttgcatgtaatgcccttaattatttgtctgatatttaattatccatttttcttaaaaatatatggtaatttatttttataaaacacatgcacatcataagtgtattttctcatttaattaagggattcaaaatagtttagatcgtggacgagtctagtgcggcatgacctaaattaggctaaaatgcgtgctagtttcgaagaacaaagacgtacgtagttgtcttccctttaatattgtttctaattctatacatgtggtagttgcatagtaattgctaatatatgtattccagatgtgaggatttgatggtctgattcaacataaggacttattgtggcccaacacagaaacaaaagctcttccacttctagcgtccttccctagttgcgacttgcgatccagagaaaaaatttcaaaactaaaaagaagctatagaggtaatggcggttgaaagataaatgtaaaaattagaatatgccttatattgactttatcacattccttgtttgcaccaaagacgcaaagttgtacaagttccatccagagtttattcatgtccgtgtgtggtgatttttcccactatatatacacatataaactacgtatataactatataagtatattcatttcacattatatagtttcaacatcttaaggaggtaactttcgcaaaggaaaatatgatgtcttcgataaataatacgtaaatataatacgtaaagtatgattatacatacgtaaatttgaagtataaaaatggctttattctcatgacttttgtaatgacgttactctagcctataagattgtaaaagtattggaaatgatttgacattgaccatcacagttccttctcttccacgggtggaggacagagtgttaataagtctttgacggttgggtagattggcaaattaaagccacaccacgtgggccactatgactaatgacaagagtgttgaattgacaaggaaagttgtatttacattaattttaacgcataaaaatatgcacagtaaaaaaatattaagataaaagtcataaagcgattgatgtggtttaaaaagccaacaaaataaaattatagtatcagtagtataaattaattgaaaataaaggcacatataaaagcgtattgagggttgatttcgctttatttgaagttagaattaaacaaatcaaattaatcaaactaactgagttacattggttcacacattagataattagtttttgaattttacggatgattagttgttaataattattgatgattattttaaataatttttaatttaattttcattacattatgctaaaaaaattaagaagtcacgtaaattacatttaaaaaaaacatatataaataaaaaaataagaaatcataatatatgtaaaaaaaatcattattacaacaactaaaaatatgatatacaattatataataaaaaattaaagacctaggtatttatcataattctcatgaaaacagttatagttgtaatcatgatgataggtggtgccattgactataatatcggccacgagttgttccctgcttcatggactctatcacgccctaagttcaacgatcttttaagattggtttgatcgaaccttagagttggaagaaatgtgagactctagttgggtggtatggcttggtactagtgtcatagatagatctcttcgtcttcccaccactccttttttccgcatgttcaagcacactcactctaatttagggatttaagggagtctcagttcaatttaagatagagcaacttttttcttttatatactatagtagtgtataaaattaaattcttattgtaaagaataaatatataattgaatatatggctgtttaaaaacttttatactttaaaatattttaattaaattctattaattattgttcatattatatctttcacaatttcattatactttaactagctgaaacatattttattcttgaggttatttaattagacaaatactaactaatgatctaagaacattgattaaaggattcaaagtataatttttttattgaaaagtaaaaaattatgttattcataatctttcgtattttcttataattttataataaatattttttcttttaaatttcttaattatttgactaataacactaattaattagactctttaatttaatagtaaaatacacaaaagaatctatagtactaaagacagtttctcactcgttacagaaaatctttcgctctcactttcaagaaagaaggagaggaaagagaaaaaaacgtgggagtctcgatcatcaaagcagagccagagccatatttgtatgaggctaatatccagttgattggtcaattccatggtccaccagccagtagttcctgttacgttggaccacaccacagttttccccgaacgaacgagcccaagtagtcttgacatatatcttgctccatggcacataataaaatcatagttaattattgttggtgcaccagtgtgctgggtcccatgatgtttccatcttcgattcgatgccccaattcagattgttcatggttcacttcatttccactgttcctcccctcctcaacacaacaacaacattgtaagtggttcatcagtatatatatatatatgcatgtccatatatatatcatatatgtataccacatgggaccttgttcagtgttccagctaattcttaaccttatcgttttaaaaaaaaaaaatctctctctctctgggatgtacgatcaagtgcatgaaatgcaagaatggcccaacccacgttctattttcttgggtagtaaaattcaaagaatgtggagtgttggtcgttggacatatgcttttatttgggggatgaagttgaattaagacatagcactccaatacccatatatatgtggtactattggagatacggtaatggatagttttagaacacagaagaggactggattggaatcaaataattattatggatggagatgatgtgtatatttaacatttcattattttactttgaatccaatgaaagctaacattaagcatccataatcaactcgtcagatttagcgtccagggtagacttaaatacacatacgaaacttccctaccactatcacatatttaggagttaggagatctgtaaaatcgaatcttacccatgtgctgcaaaggagagtgataaggtgccttaacttttgaaaatctatgaatatttgtgtaatattaatcatgccaatatcacatacacaaattgtatgttgtattattgaatattttatctcaaaatctactatcaattgaaatttcgtatcatatttataaattttattttaattcaaattgtttaatattgtactaatatacataaaaaattatgtaatatttacttttagaatataaaaataaaaaaatgtaattacatatttatagttgttcaactttgataaaatttatagaaatagtttagtaatatataattaaaattcaatgattagattgatttataaaataacatcattgtatataaaattttgatggtgcaattaatatagcaaatgtgttttatgtcttattaaaatatatgtttttagttgttatcattaattttattttataaagcagtgttttggtatataaaaaaaagtttcaagttgtttaggagttaaaactaatgataatctatagacacacttatccttaaattcgttgaaatgtggacaataccttgaatatgttgagcaaatgatgcaaaggttggaactatttcaatatatataaaaagtctcatgacgattaggagtcaaggtcttagtttataaacattcttctttgatctattgagatgtattttaaaaactaaattgtaagaaacatgtgagtcaaaatagacaatgccttaaatgtgataagtttaacgatgtagtcgatttcaagttagagccttaacattaaaaagagggtttaggtcacaccataaactatagacacacactccctttagcctccagtggagggttaccattccgctatgttgcccttaatccattatgcattttaaggaaaaaatcatgagacttatgtcaggcaaaacgaataatatatacctctaatacaatgaatttaatgatgtggtagattataagtcaagaatagaggtgaatataaagtaatgatactttgctactggctaattatatcattactcataaaaattaaaatggaaaaataaaaaacatgtattttaatataaaaataaaataataaataaaaaataacaattattttagacaaaaatagtttttaaacctatgagattgaacaatatttattcttggcacattcttccacttataacaaggcataatttatgatatctacacacacaaaaaattcatttatttattaataaataaataactatcaagcattagaactacttttattagtataaccttatctaatggaatgagatttgttgttatataaccttttgtctattgaaaaattaaacaatttgtaattgaagccctataatataatttatcatactagcatttggtgtatttgatagtatataatgttttataccaatgaaattattttatagtattaatagaaacttgaaatatctccaatttaaaatttgtcaaaaataaattatactaaaaaaaataatcacaacacttaacattttatttttaataaatactctagctagttgctaaaatatatttcttttcaattaacttattcattgaagcaaggttagaatctttgttgagagagaatatccacatctagtgtatcagatagtttcgaataaaattgtcagaaaaaatacacgggaaccaaaaataaaacttatcaaaatgagcaatatgaatatccttttaattgaactaaatcatgaataagaatagagtcaaatatgaggactgaagttcggctatatacttaaatataaaacgatttgaatcggtttccgttagatattaacccgttataacatgtttaactactagtgccaaaaacatatttggctaaagttaattatttcttcaagctaaaatagttcttattttaattgattttggtacacaaagaccacacattactttcattgtaagcttctgacaaagcaccgatttggcatatcatgaattgcagccatcatgttggtttccaaaattttccataaaataaggtatcaagaactgcaatccaagaagcgcatgatttggcaggaaaggtaataatatgtctagttgataggggtacgtttttccctcctcatatgaaacagaacatgatctccaacccttttcagaactcttctaaattagttccaagagctaggtcggtattcggtaaatgtcccttcgcaggaatatatggtggaattagtttaaaagcttttaattgttagttccgtaaaataaaacttaatgtggttacggataccaggcatttatttcaaaatttagaaattgaagttaatcataatgaattttttagataaaccattataaactactatggtagaatatgtaaactactaaacttttatgtcattttatcccgtactagtttctctacagcacacatcaacggaagccagcatatatatatatataaacacgcaacacaacactggataagataaattataaatgcatcgcagaagaagggatcgaaatcagagtttagtatatatacattcacttaaagaggaggtgtatgataattaagtaccaaaacaaaaatagaattttgcagtcgtgttgaaattaaatttgcttgttaagttctaataggtcccgcaaactaagtattatctagcagagattttctattttatttcttaaaactgtgataattaattactcatatttaaagatttaatgataaatatgaaaagcataaaattgtacatatattttaccgttcatttaaaatttaaagataataaaagtcataaaaatataattttgttacttacgtttttctaaatgtttatctactttttgttaaataatcattactttatatattattatacttttttagtatatttataatattatatattaaattttccctttaaaaaatatatgttgttatatttttatcctaaaacaatacggatggaagtcaagtggtcccttgttaatgggttagaagtaaagaaaaagattcgtgaatttaaagtatcaaaatattttggaggaatatcttaaactaaaataaatattcactctttcttatttaaaattgaccctacacaaattttaatatgatattaaaaaaaattagtgaaaaattgacccccccccccccccggcccaaaaataaaaaagttaggaaaataaaggcttagtaaatcaaaacaaacttgtaacgttaaaaattcaaggaacaaaaaatgcatttaactaaacaatagaagtagttcaactttttcttttcttttctgaataaccccaagatgttggtaaagcatcgagataatgccaatcactacatgacagacgtgtcagacttgtatttcgatctccattcaaacttaattagaaagaaacaatggcaaaagaacccggaaacttgtatgaaagggttgacaaatgacaataagcttgcatatgaaaaaaaggtatgagttattgagacgttatttgtgaaaagaatctaaatatgttgtttcatgtttaagaaagttaatcttataacttgagtataacttgaaaaagaaaattcatagtttaagcatagttggttttaatgaatcatttataatatgtcatttcctaaaccattttatcttctctttaattttatgtgtttttccaaaaacattatgctaccacattttattatagaaaagagaaaaaaaaaggtatgctgtaaatttatctttactttgtaattatttatctttgacatgataaaaaaattataaatttgagtagctcatctatactctatttcgcctcaacgttaattaaaaaaaaaactaagtttaacctattcgagattagatttttggacaatttttcctcacacccttgaagttttatttatttatttatatcagccaacaaagacaaataatatatatcaactggtaccagaagtaccaacaactaccaagtaaagaacatgcatgacagagtcatagttacacactaagaaaggagcttatacacctcttatcttaattataactatactctgaaaccaaaaatagaagaatataaaacatataactactgtctccctccaaaaaaaacatgatatattctttccctcccaccaagaatctactatatatgtaaacttataataaaaaaatcagcagagtatttccacaccaccaaatcagataataaccagaccctgaaaacagcaattccaatgatccacatacatcagaaatgaagcattttgcaagtgcttagttcgtcccttgtagacatgcgcaccttagttcatcagaaatgatccacatacatcagcaattccaatgatccacatacatcagagtatttttattactattaaattaaagtaaattgaagtagttaatggtgagattactattatcctttttgtgataacgaatgtgttttttattaaaaaaaacaatttatccattttaggttcatccaagcacacatcttgaagtttaaaatttctctcggtatatccttttgttttttgccccacacacaaactttcctcaatttacataataacataacaacatatgtatacccttcccattaacacaaacaccccttaatattttaagcagttatatagataaagaaaactcaaagtaatgtgaaaaagaaaataatactaagtgtattttattgaattttagagggcatgtataatttatcatagatttttttttcttccgaaatttaaatggaggtgcaaaagtaaatttgagaatacagataattttcaattaattcctgactctaaactcaaacttgacctgataacactaactataataatatttgaataacaccttacaaatttaaattagtagtatgatttgattcttttaaacctaccttttaatttctagaaaatattattatatacttttatatagttcgaattaaaatatgtttttattataatatttatttgaaaaaaagtggactgggtaggggcaagtttctttacccacgaataattttgcaagaaaagagagcgggggcgtgtttctcttatctctcctgggacgaaaatatatatccattctccaatctaacgaaaatgagaacaagtttagaattgaatattgatctcgaatagataaattgaaaggcataaaagcaaagtgcactagcgacttctacgcaaattaaaaaacgcatttttttttaaaacgaatgaataaaaaaagtttaatagagatgtattatcagcgtaaaagtttctttatattttaatattagctaattaaaaattattattagtataatttttaaagtgattattattataaatgttagttggtccgcgaaacaaaagttgagtaggaaggagtcaacctaaatgcatctccaatgttctcttattttatgaacattagtgtccagtaagaacgactagtaattcgatgttatattaaactctctcttaagatatttatatagaagaaaatacctccaaaagatgattaatatgcacaaaacaatactcaatcagtggggtgaggttgtacacaatgtgaatggaaaagagagagagaacgagaatgaatgtgtgtatatttttctatgcaaccatctcttatttatattgtacatatctcttggttagttgtagaacgttcccaagaattactgccacgatcccttaatggaccttagcactaggcccaattgcagaataagtaacattagtaaaaaagaattatgtgttttttaatattatttgataatgtaaaaaattaagacatattatttataaaaaaatcataaaaagatttttttagaggagttgcattactcaacaaaggatctacgtactattgaaggggtatgtaaatgaaaagttatagatggacatctagtatgtaatgaacaattagtgagaaaaaaattaaagtaaaaaagtatagattttataggtaatatgatttatagatagatagaaatgtttttttgataggagtttaatttattataacttgtgtcccttctaataataaagttgacataataatgacttttgttttttaattaagttctttagaattcgaatcttgattaatatttaaatttaaaataaataatgttaaaaagaaaatatttatttatatgtgtttactgttttctacaaaaattacaaaaattaattaccacttctaaccaaaattatttcgtaatggtgagaaaaataataatttgttaggtacataaaaatatgaatattcatatatatcatagtgatcgtaaatctattggggaaagaacatacgagctatgagtacgagatgtccagatacacttcttaagcagtatggtatggtcacatgattgtacgaagttacggacccgagattgttcaagtatagatcagcttgtcttcatcttttccttttgggctcacctcttctctttgaggtttcgccaagatatatctaactatcaatagagcggggaaaaaataatacataacagagtaaaataaattaaataaaacaatacttttatagctattttataatataatgaaatgattttttcattctattgtttggcaagttaatgaagtataattagttaccttgtaatatcttcaacgcggatatttacaagttacaatccatttaagcaatcatgttccgttcatactcttataagttaaaagtaacaagctagctgcaagagtaattaagtaggtagacgtgtttgtaaaaaatgcaacgtagaaatgataattgtgtctgagtttttaattttaaaagaatagaattgcgattgaatacaagtaaaaagtaatatatactatacttttatgagggttggatgaaatgagatgaattcatttcatcatttatcattctatttcatttttaaaaaaaatccaaatgatgaattaacttgaaattttatttcgcttcgttctaattaatcatattttcatcaattctaacataatttatgatttcttccatttttctttaaactttctacgatgtaattttgaactaatacggtcttgttaagtagtgtcctgctaattaaggatagtgggtaataaataacaaatacaccatattagagattttaaatcacttagcaaattatgcattaattagactagtttatattaatttttgacataataaatgctatcttttacaagaaaaactttgtacttttatttccttagatgatatatttagactctccttgatagcaatcctaacactattagtacatcattaatattaaactagaggcgtaaatttattcattaaaaattaatggatgtattattagtgctttatgacataacacggagtcactcaattcaacaattttgttaatttaataccctgaaattatatttaataataatacttccattttaccagtaaaatacaattttgttaatcatttagtattatttttagaagccttatgtacagactcaatatcacttgcataaaaaaaaactcaatatcactgtctaaactaaaacaatctaatttcaattgatatgcacatttaacagtattattgagattgagtaattgttaagaaataagttttttttttttttttgtaaaatttaacatttaattaatgtttctactgcatcttatctatttttttatttgttgatttcttaatcattgttctcaaggtaattattagtacaatcattttcttataattatatgtaattacaattactactcatctctttatgtttttagggatactattcatctcttacaaatagttatttagcacattttttttaaaaaaagaacagagtttaagaagataataaaggaaattgttttatgatacgaagaatgtctcacacgaaaagtacgaaaacataaactaacggttgatccatgattgaatccatcccacaatgaaaatatgtttagagaatataataaaatctactaggattgaaggcaatgacatgatactatgtgcataagttgtggcaaccctttacccaagtttaataaattttattttgctgataaaaataattttagtttgcttttaaaatttgatattgttactcacacattaaaatgtacattttaattaagagaaagattagaataaaaagaaaaaaaatagatatagctagtgatgtgatagaaaaaatataaattataaaaatttattataagtatatccttaggtccactttacgtgtagctaggtcgcagaaaatgccttccccacttacaaaacgaaacttttgatttccttaggcgtgtcattgtcatggagttagcagtgtgttaaacacaccagagggtgatagcagggagaaaaggacaggtacaaggggttttgattttggagtttgcattagggcttgataaagatggttttgctctcacattcatacaaataataataatttcacaaatcataatatatataatattccccctttattattatttttattgtaagatcttgatatcgtggctatataaatatatatgcgtgtacaagcatacacgaagcgagcgagccacgaaaatattcatcacagggttttggttcattattccaatttttgtttttcccttttattggatattagagtgagtaagaaagagaagcgagagaaatgggaaggggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctgcagcagttcaaggtatatgtatattcactaaaatgtaaacaaattacacacacaaaaaaaaaaaccttctttcttgttatcttttttgcttttaaagatcttcaaatctctctctccgttgatttttttttttttttttttgctctttgtttccagacagctggcgtttccccccgcttattttagtttggtttgagaaaacacgagaaagaaagaaaagtggatttatttatttatttatttttcattttccactgttgaggtttttccgtttccgtgaaatgtctcggcgtttttaggaggtttgagggtttctgcaaacgcgttgctgttagatctgcaactggaaacgcgttaaacccgaacagacatacataaaataaattaagcaagagaggatcactgttttattgtatccactctatttttgttctttttttctctgccctcgtttctcttcttctttttgggtgagtcttgagctttctctttctttcccatttttggtgctaaacccagcatttgagattgccgtttttctgctccgtcaaacagatcaggttcaaaagcgtttcccaaaagtaattttggagtctcgggtcaggcctcttttcggtgtaattaggtgttgtgtaaaagaagcatatatatcaattattttgttccatttggaagtttagcacctagcctgctttcggtttcagtcttcaaacatcgctccaacaacgtaactcatctcttattcactgtcaaattaatacgcccgtttttaaagaaaatatttatatgtatctcatccacatctcttggggggggggggggggctagggtttctttttttatttctagatagttttttttcccctcctgcacctctcaccatatatcgatctctgtagtgttctatttttctcccatttaaaatttattttatgttttgccttagcttgcgtgattttctattttggtcaagcccttcatttacttacagacactttggggtttgtttgttttcgatccacaatcatgaccaaaggttctcactgttgagtcaatcgcttgcttgattaatttctccatgttactactgacagaagatttttttttttctttttcatttgaacgtttttcatgatagagacattttgttaaatcagagtggacattttgttaaatcagcatccaattcatgtttttcaatcacctcattattcctatctgcatagacagacgatttcttttaattggtttggcatttcaaataattaattaatttgcgtcttcctaaggttcaattcgtatattttctttgtggaaacaacactctggtcatttcagatctgattattgtaccgaaaattctgttagtaacttggtatgttccgtcctttttcttctgggtttataaggtggcactccatgcaaatgatcttacctcacctacattcaataggacaccagttttcttttctataactgataattgatttgtagttggctccttttgatggcctaatattatcacgtttatcaacgaaaccagtctcatgtctcatcgtcaaatccaatactacccattttgtacaatttattaacattagtaattgggaaattgtatttatataattagtttttacaatttcttttataatatacagactaaatagagatataagaagagaagataacgaaaattgtgagataaaatacttgatttagaagagaaaaaaatatagtattactataaaaaaattgttgtgtaaacaattttatgttgaatggagacaaaaacaaagagattttttcttttctttttattcaaaaatgaaaactttagaaaaaaaacttcaaaattttcttataattttttttcttcagtttaatttttttctcctcacatcttgttttctttctgctcatctaaatagaggattggtcccttaaattctgtcatcggtgaccttctctggtcctggtcaagaaattcagaggttgatgtcatatgatgtttttcgatagtagccctaaaactaaaacgttacttaattgtcataactcataagatcttccaatccagctcgtttaccgattttctgcaactcttatagtttttcctatatttatggagcattcccatccttgcctccaaatgggggtttcttcgtttctaacttaagttgttcctgttctttgcttggaaaaaatgtgtgccctttttcttgttgatgttggacttaaagcaaaattgaagtaaaaagatgtcttaataaatgggataatttgtccttgagcaataatttatatttgtagaatgtagttttactcaatttatcttggatcattttgtaagtactaagtacctgacatctaacttatacaaatatatatttttttctcaaaacgtgcagcatgctcaaaacgctagagagataccagaaatgtaactatggtgcgcctgaggctaatgtgtctacacgggaagccttggtaatggtgaatagtcccatctatcgtatttaaatgcattttttgcccattcaatttgcctaatttgatggctgattttattacctcatccatttctgtttttgttttgcttacaaggggattggggttcctgggctgcaactatttactataattatccttaacgtggggtatagctgttttatattacgtttagcattgtcaatatatgctttgtctcgtggttgatcagaggtttaccttgttgattacataaacaactggcaagtgcagtaaaatcaccttatagttccagcttgaaaaagaatttcatggatataaataaaaatactgaaatcgtaacgtatttttttttttctttagcaaacaaaagttctgctgatttttgttcattgactgatataattgaatttgttatgctgtaaaacgtttaactaataacctaacgcaactacaaattctgaatccagggatttgaaaaaaagtctttttttttttaaaaaataaagcttaatattgtcatgcaaatctactatcataatatacagtataatcaatttagctcattgtcctatttttgaaaaaaaagttcaaaatacaatgtgtttgttttgacttctattcttattttcagttaatacactcttaataattataaaaatattaacttgcgtatatattgttgtttgatataagaggttttgtcaaagcaacaaaagtcaagtgtttcgtttgacttaattcaagtgtgcattaattaatatgcgttactttttaattgcatgtggacaaaagtatcatagagaaacagcacatattggtttaatttcgaagtccctttagtcttttgtatcatggaattcattttttaggcaccctaaactttgttgtagctgtatctgcatctaagacttcatgctcatttaaaattgatcctacagtggaccatagttttggtgatgttgttacaaagatacatgaactttaaggacaacttcatccaaaataaaattaagtcatttgccttcaacttgttttctttgttaggctgtttcaaatacgtttaagattattcatgatcagtataactgctccaaatagtttcccacacacaagaacttttgactgtatgtcttctaggcccgtttagtgcaatggctagaaagtatccagtgtttgaggtgggtatggggaacacagaaattggaagtattttcggatcatcaaattggcatatggagcaccatacacttacctagttttatacaggaaatcaggtttcataacgtacacgaaagactaagaattaatttgattacataaatttgatctagttcctaaatttatgcataaggtgcccatgtccttcataaggacttttaaggcgagcctccaattatagcctaacgaaatactagtaaaacactttgtagcagaccctttattattatttgaattctttttttaagcattatttgaaaattttaaaacttagataatagtgtaaataataaaatcttaatatatatatatatatatatattgtcatttatatctccatatagtagatgacggatgtaattttttgttcttatagtaacttttattgtgtgagcctataattttatttgtgtgtacgatcgtgtgccattagtatcatgtgccaatagtacttccttctctcagttctccgatctaaatgtgatgagccgaatttgtctagttgtttacaaaaaattgtatatcaaggtccattttttgacacaaccctttaagttttgcagaataagcattgctcttatagttttggttctatccagcaaaaaatgtttcatgagccatcgctattttgtaattagaaaatttcataaatatataaatctaaaataattagaataatcaagtttgactttccctttgataagtaaattaatttaagcaataatagagccaaattaggaattgaaaatgctatttgttgcaataagaaatgcaactatgatatataaccgcatgctctggtctgaacgctttgcttatactctagctcactatatactcagtatttgccctttttgtaacaacaaaaaattggcagggattgaagctatgcatgaatttggccatcgataacatatgtgctgaaatgtagctactcgcaatcgaagtagaaaaataaaatttaatttgagggtggatttaatttgccttatgttattaatagtatctaatttacgtgccttattttattattgattgctaattaacgtaatttagtgtgtatgttcatgattgtgttttaaacttgtgttttcatgttttacatattcacgtcatcccgtcattatcatgtttatttatttatgtatcagcataattttatttgttgcaaatatgcttatattattattgtaacaaaaccctatttaacaataacaatcatttgcgacgtcagttgtttaattgaatccattaaatcttttattcttatggttaattttttcctcaactcgtgtgaaagaatcgttccttaatttttgtgtattccatgcatgttttctctctattttctactcaactcaacgacttatcaaactttaacacgttgaaagtttttggtatgcctcaacctagaaaaaagataaacgaagtagaacatggattactaaatgcgttagagtaataccaattaaaaaaaaaaaaaagatgataaagctcagaaaatgaatgctagcatatatgttttataaaagcttttgttattattggctatggcttacacaatattttagtaactataaatatgactaaatttaatttcaattattcttttaattttttattacttttaattctcataaatttatttttttagaagtcgctaaatgtcagcattgagtaatatatgactattcacgttaagttaaagatgattttgagatgacacatattgtaacgtgttaaatatcaataagtaataataatttttttataaaaataaaatttataacgaataaaattagtattattaaaaaattaaaaaaaaaaaactaaatttaactatgtttcaaagactataaaacatattttatccaaccctttgtgatagctgagaggtttgcaagtagaatattgctcgaatagaaatgctgttgtcctgaccaggtcactaaggaaaaacataaaaggaatcgctatatatgttcctttaattatatagttttttcctttaactatatagtttgattttgctaccacgactataggagttaagcagtcaacaggagtacttgaagctgaaggcacgttatgaggccctacaacggtcccagaggtacggatgccctattgggccttctaatatatggctcatattattggttgataatatatagcatccaagtcaatgttgtgttgtatttaacttttaccctctcaggaaccttatgggagaagatcttggtcctttaagcagcaaagagctcgagtctcttgaaaggcagctagattcgtccttgaagcaaataagatcaacaagggtactcaagtttccaacttttctttgccaattaacatatgaaattgtagatctaggaacatattaagagcccaatcttgaaatatccctatgtctatatggtcaagcccattttgagagcgttatttaagtcatgctctgagtaatgtaagaaatggaaatacaagtattgggggcacattattaccattaaaattgaaagggtaaagtaactaacaaggaaattactgttctttaatttctctattgattagtgaagaggagaaactcgttacataattctaaatatagatatatcaatctcaaaatgtaatttctaagtaaaaatgtagtatgtgtatgtaattttgttaatttgtttccttgatttacagacccagttcatgctggatcagctctctgatcttcaacgtaaggtatgtatgaaaacaattttactttcctttgccaccgtttaccatctcatgccatacctccggttgctcaccaatttatacatgtcacttgtgtaggaacacttgctgagtgaagctaacaggtctctcagacaaagggtaagttagaaacttagaattcatcaacctgtatatgtaaatatgcatcatcccacaaagtatataacatatattaatacattttaaaatagaattaagaatcatgcaagaccaaaacattgctataagatacaactgatattgtgatatcgaaaatgatgggtataaatgactttatctgatttgtagcagttggaagggtatcaaataaatcaactccaactgaatcccggagttgaagagatgggatatggcaggcatccagctcatactcatggtgaagccctctttcaacaaatggagtgtgagccaacgttacaaattgggtatgcactcaatgctaattgactcaatcattgatcactttacagttcacaattgttaattactcttctaaactgtatcaaatggtcaattcactagtaaggtagataagtgcatcaatgacaaatttggttcactagtaagggatatgcttaggagtgcatctttgatgtaaatatgattagaatagatgtggggtcatatgagttggttgatttgattagcataactataatggtatttagaattttcattcttggcctaagttttttagatttcaattattttttaataatgatactatttttcaagtgcaggtatcagcctgatccagtatcagtggtgacagcaggcccaagcatgagcaattacatggcaggatggttaccatagttagcgtttcctgcataagatccactgcaccagcacatttgccgttccaattttatttgaaaacgaaaaaaaaaaagaaggaagaaaatggctttgatgtaaggaagatgtaagtgtctaccatgtttgaagtaggaacaaagttaagcaatgttgtttgtgtgtgctaactctttcataaaactgcacttctttgcttcggttactgtttcttcccttttaataagagtattgatagataaattataaacatctacctattttttcatccattccatttttatctgatttctttcttatcactttctcaaaatagaatgcacgttacttgccacttaggagttaggatgatataaatattaatatacgaatgaattacctgctttaatttttattcagcaaactacatgttaatgatctattaacatttctttttctttctattcttctctttttacattgactacttatcataacttatatctatacttatgtggtttaggatccctgcagtttagaaaaaaaaaaactgcacggttctgcagttgcatccaacggatgcttatagcgttaaatatatattttatattataattttatgaaaggaatatttttgtatggataagaatctcatatcccgtacagttctttatgcaactgtagaagatcgtgatccatccttatgcaccgaaggcattgaatttgaatgtttaaaataatttttattagaataataggaatacgaacaagaatactgccagtactagtaataattgtttgcagcacccactttgttggcctgaatggctgaatcacgtgccaatgacctcagtgcatctaatagttattaattaattaattatagtaattgtttcgagttttgacttttgacacgttagctagtttcagccaacttattttttcaaaatggaccttcacttatgtagttatgttatccatctgggttttcattattaaatataaatgaacgaggaagatcatttttggaaacatcaatcattatttaaaacttttttttttggaaatctttaattaaatctgcttttgacataaaataaactaattaaaatggatatttgaaaattaattattaaattaaatgtatttttgacataaataaattgattaaataagtattgaatgcatattttgaaaaattattattaagaaatttaaattattaaaatgatatttatctaaaataaagatttttaattttaatagattgtgtaagataaatttttataatattaattaacacaattattttaaatacaatatctaaaataatttttaattatatgaataattggatgatgatcaaagtataacgttaagttctaaaataaattgatataaagacacattattacattaattaagttttacaaaattatagtacctagcaacacaatgtgggcagcatgtggctttgacttttttgactagtactgttaaatgaaatgagatgattaaaaaatgaaacgaatatcagttaatttaaatcgcagtctggtcatgggacacgtgtcgattaaggaatcagcacgctaagcctatggctatgaggagagatagtaatagaaggagggagatagtaaagagagaaatccgaatagaaaagaaggtagcgagctagggttttggcgcgaagaagaatggggaagaagaaggtggagataaagcgaatcgagaacaaaagcacgcggcagataacattctccaagaggcgcaatggattgatgaagaaagctcgcgagttatcgattctctgcgatgcgaaggtggcgctggtcatcgtctccagcacgggcaagctctacgagctctgtaacggtgacaggtacgcgcaaaccgcacagtaccttttatgatttccgttccgtacaccgtagcctagtatatgtgtccaacttctttggatcacgtcacgtcgcacatgaaattagtttcgttttatgccttttcttttgtaatttgatttgtttgctttgctatgtaattgcttttcgttggttggaaactaaaaatggaaatgaatgattaactaaactagtgcaaactgcaaaagtagtatccattagctagctgagtcgtgtcaaattgtcacggttttcggagccttagatatggataggaactacttgttaaaaggtgggaggataagtttgtggtgtcagctctctgcactgctgcactactggaagttgatttgatataatatccacgtttatgctactagagtttgctagaacacattttttaaatctattttttacttgaagaaaagacttcaaagtgtagataatttatttatttgtgctggaatatatatacagagagagaacatttatgctgaaagatttattgatttgaaaagagattttcaaatgtacgaatattgtttccatgagaataatgccaagaaaaggtattttgttacaatagtaaaaagttatggaccaaattgtttttcacattcgtctcaatcaagctggagcgatatgctaacaaatgttcaatcgctttatttgtctctcactttttaccttttgacagaaaaactttagaatatcttttaataatatattttgagcaccttttgagagaaaaattttagaatatttttcaataatatattttgaacaaagattttgagtttaagatccattgtttaataaatcttctattaaaggaggagtcaaaatttccattatggagaatgaaatcttgtataagatccttgaaaatctatacattttgaaaataaaatatattcttttttactttctctccctaatagctttaggtaggaatcaacagaaagaagaagaaatcaaacataaaaggaaatgaaaaggggaagaagaaacataatatgtaggctgtggcggcaccgaagtaggggcgatggcccttgtcggtgctgagttgcacacgatggcaccaagggaagcgtgacactgtcgagatgtgtgaagaagagaaaagaaaagagggggctcatggtggttggggacaaaggaaggggcgggagtcgtggtggtcaagagcgaaggaagaggaggggcatagtgattgggggcgaagaagggaaaagaatgtggtggtggttgagggtggagaaaacatgaagggaaaggaagaaaagaggaaacgtaaagggggaggaggagaagaggaaagaggaagggattggtcggagagaaaaggaaaaggaggggaaggggagcggggaggcgtagagaaaaaaagaggaagggactgcacgtggattgggaaaaaatgaggatgaagatgaagagaaaaaagattaaaaaatttacaatttaaatttgaacttaaaaaatagatgttgcattaaatgttgcctttaaaaaaaattagtgttgccttttagttagtgggcaaccaatattggtaatttttttaatctattcacaatagactatgtattttttttaattaaatattttgcaacctataaattgaacaaatactgtttatattttgcacaccaattctcctctccttattatcctttatttctcaatatcttatttgcaatctcaatctcttggtttattttcattcttaatagatccaaatcagtatattggcaagtttattgcattttttttgtagaattatcaactttctcatttgaatggaaattctcaaaatcttccctcattttttccctacttgtaaccaacatcatcaatgaatgttatgtaaaataatcaatcttcttccataaaaaattctcaaaatcctcctccattttttccatatttgccacgaccaatgaattttatgcaaaataatcaaatccctttcactgaaagttctcaaagttctcaaatttttctttcaataccataaaacaattctttcgtgttttgtaagcctcccaatattaagaacaaccgaaatggttagaccaatttattgaaaatggctctaaaaggacgaagatttttgcatctgggacatattcatcgtcatctaattcaaaaacatcagtacaagattctgaagctgacacaccgtctccaattgtccgtccaatgggtcaaaaggcaaccaaaacgaagagcaatgggataggagtagaaacatttaccaattctgtggacttaattggtgtggagaaagcaatgaatgaaataaacgttctcaatgtcagactagcaatcttaaggaagaaagaattggaaagagagtattacgacattttaatgaatgacacatttacaaccgaaagtcaactccaagatcgttaggccttttgtaaaataattaggcgtaaactaggtatgtagcattaatttgttaagtagttttaatttgttgagatcattttttaatttgtatttttaggaatcgggtttgatttgtctttttttattattaatttgtaaccgtctttttttttttgaaaactaattgttataaaactagatgttatgaaactagctgtagtcattataaaactagtcatttatataatttaatagtcattataaaactagttgttgcaaaactagtcatttatataatttgctatttaattgttcatgagctacttacgtgtgatgcaacaacaagaaggcaacaacagtcaatacagaaggactagaagagtgattaatcgcaatcgtgaagatggacatctacgattgatgaatgactactcagaaaattcagtatacacaaagactcaatttcgacgtaggtttcaaatgcggtgacaattgttcattcaaattgacaacactattagtaatcacgatgagtattttcaaaggagacttgacgttgtgggtagaataggtctctcatcattgcaaaagtgcactgtagttattcgtatattggcacacggatcacctgtcaattatgtggatgagtacgttagaattgataaatgcattgcaactcaatgcttacaaaaatttgtaagtggtgtcaatgagatatttggacaagagttcttgagaaggcctaacaacaatgacatcaattgcctattgcaaattggagatgcatgaggtttgtaggcatgttaggttctattggttgtatgcattgagagtgaaaaaattgttcagttgcatggcagagccaatatcatagaagtgataatcgcaaatccacaataaaacttgaagttattgcttcacaagacttgtggatttgacgttaatatttggagttgcaatttcaaataatgacatcaatgtattaaatcaatcgcctgtgtttgattatgttttgcaaggtcgaactcttctagtacaatttacaattaatggaactccatataatatgaggtaccatcttgcagatggtattttatgctgattgagccacatttctgaagaccattccaatgccacaaagccttaaaagaaaattatttgcaaaatgtcgcgaagcagcgagaaaggatgtgaacgagcatttggaatgctcaaatctcgactcacaattatatgtgttccatcgtgtgcctggaacatggatacattgaagtatataatgttgatatgcatgatattgcataacataattgttgaagacaaacgagatacattcggtgataatgtcgatgttgattatgaccatgtatagagatgaaaatgggacagattgcctatcaggggtctttggtcaaacctggttaaggcctggcctggtctgacttgtttatcataaaggtcaagctaaagttttttgaaaagtctgttgaaataaaaagaccagatttaaactttaaaaaaagtctgccaagcctatcaggttggcctatttaatatatatatatatatatatatatatatatattaaaacttaaaaataatatatttatttttctaaaaatatttttcttattatgaaggtggatgatcaatcacttcaaaaaatcacattgaagatctcataaaatgattattacttatttaaaaatataagtaagatgttgagacgttttttgtttaaaattatttcgttaactttcctaaattgatttaaagtattttgtaaaattaaatttctattaaaaataggtttttttaataggcttgtaagcttaatcaggcttttaaataggtcagaccaaacctaaaaaagcctatcacatgtaactaggccaaaccaaactttatgtttttaaatcaggtcaaggtcagacctaatcaggcctaatcttatgcatacaaaaggaattcatcaacaactttaaacagacttggaatagcatatttgaaaacattacaattacaacaataataaaatttaatttttcgttagcattaatgtgttgcgttttttattatcaaatttatgtattttgcatttgtttaacatttagtcataaataaaaattaaatttatgctcattttcaatttcttaatatttacaaatttttttcttccatgttttattaattatttattttatttaataaatatttaaataaaatatttaaaagtgaggtccatgtaatatttaaaagttatctaagatcccaaaatgagatttactactaaaagaaaaaatgagaaagattttgagagatcttcaatcctaaatgacgatgtgaaatccattaaaaaagtgatataaaatcctaatttgaaatctctcattaaagataccttaataaaaaatataattaatgaatataagtctataaatggtgataatcaaatcaatatagttaattacttacatctggttatctattttgtattatatatgtatatttatattgctaatgttctttttcttttatgttttacttgatcaatgacagattttgtctcaaacatataactccttttttatatatacaataatcattgtataataatatgaaactctttattattactacctatactatttattcttaagttaaataaaattcttaaatctattaaaaaataatacatatattttgatcgataatataaaataaaaaactgtcattcaatctcaatgtctccttatagtcttactctccatgtgttttcactgtcaaaccgccctggtgattggtttaatatcctaatttactttttgccctacttgttttgttgaagtcggttgttcccttcccaaggtgtagctttgcttcattttttttccttctgccgatttaagggtttggtattttcattatagctaggctactcttccccgttatttcctttcattattcaaaacgattcagagtattcatgagtgtaggcttttactataacgtcgacggttatagattatttggccaatcttttctaacatggaaggtagctctagaaatttcttaaagtagtgatcatggagctatgaaagaaaacttcaatcttataatcgtatgtgtttgagtgaattgacaaatagggtgtctcattttggtagtgaaatagaaaatttggattataaatgggagtttagtacagggtgttttggaaattatgttcatgtacttagaaaatcacatgtatctaggtaataatagttcatgcactagtgaattaattttctctagaaagttccattgcttactataaatatgtggactcactaggtatattatcaagccaagcaaaagttaaaataaaatcaaaaaattatttagtcccaaataattttcctcttatgtattttattttctttgagttttcacctctagaatactaccaacatagaatttacttcccataagttcttagtctctcaattgtaataaacaattttatttgaacatttatacaagttcacgactatcaaggttgacactaacatcaaacttcatttaaggtgtcaacttgtagataccaattattactattaatctaagttagttatcattatagtataattagggtacaactccaactcaatacaaatacttttgttctaattaacagtcatctgcaaattgaggcttacaactgagttttcagcttgttacaattaacacgttgaataacctaaaaaaataaattatcatataaatgattcaacaatcagaaaaaatgtttctaatattgagtgaccacgagcaaagaaacactgtcaaaaagactcccaatgaaaatatcagttaccaacattatagtaagactcaaacatatccaaggttcattaaaaaagcattatcaacgatagcataaaatttgaattaaagagatctagaaatcttgagaaatatgcttaattggaaaatgaaaaattaaatctgacttaaaaatagcgttcatgtatacagtgtgggattttggacaagtataaaaagccttcagatcaactgcatggtcaggtacaggtgtcactttttcataccctgtaccatatccagggacgtggcagaagcgtcaattgataaataaaaaatgtctgaggagagtggcggagacaggaattttattgagagaagatgaacataaaaaaaattataacataaataaaaatatttcaaaaataatacaaatttaatatacaaaaaatttaaaaaaatctattacaaaaattaagattacttcacttaactcttattctacatgttttcatattgttaaaattatctataattgaatatgtattaaaactcaaaacaattttttttaatgtatgtaatcaaagaatcatcaagaaattggtctttgattctatttcgaagtctagtcttgattatctttatagttgagaaagatctttcagtaattattgtagaaaatagaagagtgaatataagtttaatcactctatcaataagaggtaaatgatgaactttcctcttcttgctagccttgaataaatagtagtttattttattttagaagattaacaacaacaataagaaataggaggagaaagaagaaaagaggaaaaaagaaaggaatgaagggataactggaacctttctctttcactaattctagtaccaaatgacacaactttttttactatttctgttctcttgggatttgtatatttttttctcctctgtgtgtttatgtgtccagacctctctcttttatagtgttttttatccctcttcctctttattctttcccttattatttttttttgttttatcatcttcctttccttttttctttttttgttatctctttttctctttttatttttattacattttcttttctttttttatatatttttttctcttttatattttctttcctttttattgttctaatattttattttattttttttattacatttttcttatatttttttctttcccctttcacattttttaatatttttctttttttttctttcattttcattttattttcattttttattaattttttaaaaaatatatattttttatttttaaattttaggggagtgatgacccatcctagtcccttaattccgcccctttctgagtggtttaaatccaacatattttaacttctatttagataataggtgcaattccgaaactttgacccgaggtcatgtatagaaactcagcgatggcatgtggaagagccaaccattttcaaagcttatcaaatcgttttaagtaaaaatacaaaaatgattttatgtatagtacatctttaatatgagttttgttatgaatcaggcctagctaggacccaacccgaatccaagtcccgttcctctaaaatgttgaccctgcaaactctctcggagattaaagtcactttatgttattctaagaacaacgaataatttctctcttcgaatcatgggcctttagcatagagatccagtccatccttactcctttaaatactattggcatctgtgttataattacgcgcatttattactattggtctttgtgtaaagttcttcactaacttggcatcggagtgtgcctttggcctttgcagatactctcaccaccactcatgcagactaggttcaagaagttcagactactaccctcacacttcaaggcaaaaatcatttatcggtctacacctattagtcctagatagagtttggaccaccactgtcaatacttcgaatagaacaagtctttaatttaataccatttcttgaatcaattactcctaaagcttattagtgtgtttgttttatggttttttcgtagaaatcttactttcacaaaggattactggtcaatgaatccgatgtgagttgattcacaccctaagttgtttaggtaaaaatatgtgtcacatgtctctaataccatcatgaactaattatcccacgaatttaaactattagatgaaagcgtaacatagctttgtcagacatgagactacacttaagcatcttaccttgttctaaaatattgcttagaagaatgggagcaacaaatttaaattacatctctagagagaatagtcatatatgatctaacattatattatgttatataacccaaaacttagcttaagatgacgttttatatctaacaatattcaaggaagccctaaacattgagaaaatctcattcaaagtcgttggcacaaatgtgtgtctaaatgaatttattttaagtaatactttttaattttttatataactttctgatagaacttcaaatatatatatatatatatatatatatatatatatataatttccctaacatgttagacagctgcggtttggttcctaaacatttattgaagctgctatttgggtgtaatttaatgactgtttctaaatcaaattggtgcaacgattactcatgtcttgtaagattaaatcatttaggtattattcaagtccgatctttattagattttacttacctcttagttaaattttggattagtcaaaatccctttctcctgatgaattggagggttaagaaaaaaacatttgcaactctaagtcacattttttaggtagttactgtaatactcctaattgtcgacttcacaacaactcacatatcatgacacttcacacagtaacactttgctcaacattcttgttagtcagaactttctaaccttctgatgctattttttttagacctcgagaatctgtttcggttgatgtcaaaatcaatgactgtcccacaaaccaacataaaactttttaggatactttgtcctcactcacacattttaggtcaaccatctcataactactacaaaccaagatgcttaattgttgagttattaagttataggctagtgaaaaatagatggatcttgttgatatatgtaatatcaattaatttatttaaatcattgttaattatacaatcgcacacatgtacaaaacctccatattcctctcattatggtgtgatttgatcgagatattatagttatgaggtagaaagatatgatccaatagatgatcttctgagtttcaagcctataaatagaccttatacttaacttcaaaaggagaatcaatttaaaaacaagtttatttaatcctgcatttatttattgcttttccttacaatttttcttgattgcttctatttattattttgtttataaaccttcacttatagctttcaacctttacttttcaacccaaacctctcttcagcaattggttttccagttggtaagagagcattgaatttagctttgatagataaccactgtccaataatttcaagaacactcatgtgttgtttacgaagattgagtccacaactcataacaagtatgaaaattggtgtagacgttgtgaaggtaagaatcaatagactgcaatataaagtacacagtaaagcagtatttttctcctaattttctcctcagtatttttcttcaacccttgtccaattcaccacttctcaactaccttggaccatgaaacatagttggaggagcccaataacttcttaattgcaatgacgggtagaagtgaaggtagaaaaaaggcccagacttgacccagaaacttaatcttttaattaagttgacctccaataaatccaacttatacaacactaaggttataagttgctgattaaatttaggtcctctggaattcagatgtaactgcaccgtcctgcagttgtaatccgacggtccaagcttatatgaaattgatatatatatatatatatatatatatataaactattatatcgcatatatgttaaattaataaaattattttaacagcttagagcctcagatcctctacattgttttttaagtgtagaattataggttaacggttaacctatagatacaacttcagaaaaaacaagaattgttccttgtcaaagctagttagaacatagccaacacgaaagagagacaaatgcaaagtaggaaagaagctacaaatctttggtacttaattggccgcagaagttgagatagattagattgtgattggaggatgatatcactacaataagatggtgaaattgaaagaatcaaataagaaagatcattgagtacatacgatatgatagatatgtacattctgtaaaaaaaaaaaaaaaaaaaaacagatgtatatatttgatgcaaacttaacacatatttattctaccatattaattaggttaagcaataataaaactaatacaagtcctgtccattaaaactactaacataacaccaatatgattaaccctaatgttctttttaatacttctactaaacattcattttatgtttatgaggttgttttagttaatatgaactaaaacccatgcctgaaaggaccaggtgtatagtctccctaggtaaacaattgctaaagcttatcatagactgcaatgagatgggatgacctcccctccccttaaatttattattttcattcatcccatttttgtacgcacactaatattaattttttaactactagtgtgtttaaatacctcctagaaccaattttgaccctcaaaatcatggtggaaaattgaaaaagttgaagcaactatttgttgctttggctttaacttgattttagaattgatattgacataattgaaagttaatccaaacgcagaaacatatccctggctagaaaaaagacctgttaagctacttgcacccaagcctatcaaatatcatgcgtttgttgttgtttagttatttcaatattagaatgaaaaatccgtgaatttaatgttctcagtttggccgaggttgtgcagcgatattgggatcatttaggagcaagcggtactgacacaaaggtacggaacttttcatgtatgctagatatattgcacttctcatacaagacatgatagagtaagaaaatctaaccgtagctgccataagaacatcttgaaagttatcactgtaaacatatataagagctgaactgtctcgtaacagttgcaaggtaacaaggatgaagagagcacttaatattgtcaaggtatcatatagatagtgtggctaacatgggaactaaaacaataagtaggagaatttcaatatgaaagctaggggtgtcgatattatatttcttaatgttacaataaaggtaaagttctcaatacagcaaaacttgcatattcaagttttgttgcttttatctcaggttctctctctctctcgctcgctttcacttcaaatgaaaatatgctttattatgcttagcttcgccaagcttgtatttttaatttctttttgtctaaaaaatgacagagcaaaagaaagtgatacataaaatattgttgttttaggggaattatttgaagcaaattatgaaaaatgttgaactgacgcttggaaaaacatatcacaaccgagattattgatattataattattatttggtagcagggactccgctttgaaattgcagatatctggtctggtgcagcgttttctcaagtggtgcaaaggtgattctttgcattcttctttctgcaacgttaaggtatgaacgaatcactgatctaattaaatttcattgcaggcattttggtgtttctgaacttgagcatctgagtgtgactgaccttatggaactagagaaagtggttcgttctgatctttcgcgaatcagatcagcaaaggttaaacactctattcagtgaacgaatttcaatttattaagtgtaaactatacatcactcagctttggcaatgaaaaaaaaaaaaaaagctattgttctaagaatgtcatgcaagcatatcttctttatcctctgggtttcttaaaacgaataaagcactttagatagcaaatatcatttgagttttgaacattgcatcaatgaaaaaaaatcctgtagggatatttaccggagggaggattgattaaaatttctatgaaactttcttggaactctaccagataatttaagcttatacttttagtacaagtttatagcatttatattatatggcctagtaattagacagtgtacacttgtcaagtcccgaaggcagttagtagtgattcattacttttctttgtcaccggtgcacagataatttctattattttcttatacgtttgaatgcaagatacttcaatcacccccgagttctttctaagttttattctaccgtcttaattagatcaggacaagaagtgtatgcattaagagacattattcactttattgttgaggcttctcttaacaataaaacaagctagcccccatttcaccggacaaaaacgctgaatatagatgaaagagaagaaattgtttatttattcaatattatgggttataatatgtgtatttatatatatatatatataaataaatcaaaagataaactaaaatatataaaaataaataaattacaagataaattaaaagataattttttctctcttaaatgtcaattgtattaatactttccctcaaattggtaaatgtataccaatcatatccaacttgccaataagtttctaaaatcttgttaaaggaagccccttggtgaacacgtctatgaattggagtctcatttgttgtgactaaagattgttgtccattttttcttcgatgaagtacttatcaatttctgtgttctttgttctgtaatgctagcttgaattatgggccatactaataactgaattgttaccacaaaacagccttataagtccttcctattgtactttgagaggtcatcaagaataatcttcatccattacctctcacatatatattgtgttggaaatataaggtgaattagatggttaagaaaattaacatttgattttatctactaataaaactaacatttgaaaataataggaatacttacaataaacaagagggggtgaattgattaaaatgttagtattttaaaattaattcaaattagagtttagaatctttatcactttcaaaaataagaaatatttttactcaatcaaataactcagtccctaaaaatcaattgttcaaaacagaacttgttggacaatgaatatgaatcaaagaatcaatgaacaagatgagtaatagagatagagaaacaaaaacacatgcaatttatactggttcacttcacaacagaagctacatccaatttcttttaattcacactgaattagagtttcactattataaatttttgttcttacaaacttttacaaaacctccctttaccaacactagataaagaatagaaatctaaaactctattagacttctaaagaggaagaaccagataacactactttgttctttagctagagaaccattctctagacccaagcaaaaagaacccacttacaatagtcaattacaacagaaattcaaaacgaatttacaaacaaagattaaggagagagacaacctgatgatctaatgaatataatgcacataagttactaagtcaggttgaatagcaaacaaaatcagaacatgtttttccttaaccttgaaaagtttcttgctcaagaatcattcaaagacccatgaatgttttgaatgaagcaaaaagtaatagaacctagaaaatcactttgaaagacttagaaggcttgtgtatactcagaaatacgaaatggtcaagttagaaaacaagtcaagccttcaaatttatttataacagattttgtaactaactctaatcgattaaatgcgccagataatcgattaaaacgcttatgtaatcgattaaattatcacttaattgattaaaatgttcaagaagatttctgggtttcaacaacgagcaaaataatcgattaaatcgagctgtaatcgattaaggcaaaaagttcagtttcacaaaatgaactgtgtaatcgattacaagttttgataatcgattaagtcagaaaattaggattttcaaaatgaactatgtaatcgattacagatgatggtaatcgattattccaggcaaacttaaaatttgttttcaactatgtaatcgattacactatgtcagtaatcgattaaaacatttaacaaagcagttcagtttcactcaaaggccaaataatcgattaatccgataagtaatcgattaagttattcatgaagtttttccagattgaatcaggaacaaaataatcgattatactatcaagtaattgattaaaacagtaaaaaatcatttttccaaaaatcttttaatcagattgaatccttaaccaaaaagataaaaactttgatgttttaatgaaaaccatttaagcttgttaatggatgaatgaatataatgcaagaatcaacatattatctttctcttatacttgattcatttacaaaacttcaagacacttcaagcatgttgaaagcttaaaacacatttttaaatcaaagtctttcactcttcatgatgctttcccctatatccaataacatttacctatataagaaaaaacatatattgtgtgtcataacttgaaattttgtttatgtactaaattgagtaactacattttgtttcttgctcctccctgttactagtttcctcctagaaacatgcagtatccagacgaggaccttttatttacaactaactcgtcatagtctgcatctatataacctctatggataatgtatgaacgtacttttttcttgaacaacaatccttttcttgaatattgaaggattctatcaacttcctgcaggtgcctttcacagggatcatgcataaattggatgaccacattaataacattagcaatgatcctatctggagataaggctaaaagtcttttttacagcttttttacttgataaaaaattctacatttccaatagataagttttcaaaaatatttatagcttgtatccaaacagactcattatctggtctaatgtaggataaataaattagcttccccatcaatctttggtattgggacttttctactactagactttcttcacttccaatcttgtggttttgctcaattgatacatcagtgtatttccacctacatcccgctgccttcttatcttttggtttgtcaactatctcctaggttgagtttctttcgaatgtccttatctctctattcatggcttgaacccactcatatttcagagcttcttggactgaagtaagagttttgattgcatcaattgttgcaataaaactctgatacgatgcagagagatggtcagtacaaacaaactgagaaataggatacctggtaaacgatcttttttccttttctcaaagcaatgcacatgtcatcagtaatactttcaaggatacgcacctcaagctcagacaattgaacttaacattagattgtcatattttgtaccattgtcaaaccgaaactcttaataggctttcaaaattaaattttatcaagacgaaagaaatcgacaaactttagatttacttttcataagaaatgtccatgtcacacaagtacaatcattaatgaatgtaatcataatgaacaaggtgaaaaggtgcaagacttttattgttattaggaagaaatgttgcacgatggtgttttcaaaacacccgactgactcttttataaacaaatgagtaaataaagactcggcattctaaatggtggatgtccaagacacttgtggggaagccagattttggcagatgttcaagtctcgaaatttgcctattggcttgaagactacacctttttgttggtaccaccatcaaccttcatgtgttgcaagaagtataactcaccctactctttagcaagtccaatcatcctccccatgccaagttcttgaaataagtgaaaacgaaaaaaggttactacaaaattcaaatcttgagtacgctgatgtatggagataacattattagccaggatggatgacattgtgcagggatagggatgggtggagttagatgttgccaaatccaacaataggaagttgatctcactttgtaatgcgttatggattgacccccaccccccctccccaatacaatattggggtgatattgcaaatctatatcgtgatttattctatataattgatgtaaccctatttgttctaatcaataatagaaacaactgctctagtcccgaggacatacttggtgatcctggttaaatcttgtgtccatgtttatctatttagaattctggttatttttattaacaggagacctataatttgtatcctagactagagtcaaggaaataatcttcaagccaggttgtggatttatagaatcagtttttgccggggtcttaccaactctagcggcaaactttgctcgggcatgcaatagctttatatgacagtttaagctgtgaggtgagtaggtttcttagcaaggtatcaaaccctatttcaactaactagttgtcaagttttcaactgttgtactgcattcttcatccttgaatgaaagttgagagtatttaacttgtcctataatttcaactctgatggctccaaataccggaggggactacttcatcctaagcttaattcttcccaggccgcttcgcctgcacttttacctaacttcttcccaaacagatattagacctcccccttcttaacaaaaacattcttttttttacagaataaggtgagcttattatttatctttacttcaaggcaaaaaggctttgctctagtgtcgtgcttgagatatatatcaaaataaattctggtatttttaactgcttaattttgttattttctctgttcaaatcactatcatttagaaccaattattctgggcgtgaaatgtttatactatgaagatcccttccattctagtgatggtgttgtatatcatcctgtttgcgtatgagattactagtatcgccattctgttgcaagctcaatttgcggtatttacgtttgcctaagttctttttgttgttaagtgttaactaaaggtctattttagaaaactcattctctcttgaactaccgaagtttatctgatgaagatttccctgtgacttttgactcatggcaattgcggccagagcaacaaattttaaaatttcaattgacgatgcagttgtcctcattagctccacctttttacatttaagactgttctaatgcagaagttttttatgcagatgcgattgatgatggaatctgtagtgaatcttaagaaaaaggtatgcagttggtaagagtttctcgattttgtatgtttgataaccacttatatggatggatcaccactccccaccctcccctgctttaatctgaactataaacttaaggataagttaagttgttaggttgactagttggatagaactaatcatcattcatcatactagcaaattatgtccaggacacgtttaatatcaaggtgctatgcacaacgcctcaaattttagatgtagaataattcaaattcctcatattgagtatggcaattaaaatttattcacattaaagtatgaatatatatatatatatatatatatatattgagtttcagggcgccctatatccatacaaactgatggtactaacacacaccagagtaccagacacgacactaaagttccaagatattcataatcacatatagatatttgcaatttcaggatcaaaaaagatactttgcaatttgtatcattaacatgccactttattagagacaaattataattagaaatattctaaacaatataccggataatgtgaagaaccgtgtttatttatttccacacattcgtctgcattacataattggactgtttcctttttgtctgaatatcaaacaaggtcgattaagaatgataaacagtggatcaaagttcaattatggtttgttaacctttttttctttcttttttaacactttttgctgcttcaaacaggaacatatcttgagaaatgaaaatgagcttttgaagaaacaggtaaaaatgtatacaaagtcatgcacttcaagttatctgtcaatactatcattctatgtggtgaacacactttttttaactcgattcttgaactcggtataaataaatagaaaggcaatattaattaaggctgaatacaacctaaaaatttatgcatttaaatgacactcataagaccactatgattggcctagaggtagaggttgggatagatatgcaaaaacttagatttgatcctcattattgtcattatacaccaaaaaaccctggaggaatcttatacattctgttgtaacaaaaaaagcatacggaattttagactaaaatttatattaaatactttttactcagggactctaatttagtttgttgaacatgatgcataaattgttgtaatttttggtatttatcttcgattatctacgaataaaaaaaatgttaaatcctttctaaaacttatttaagtcgttatcttatgctaatttaaactagttatcggaccagttggtgagcccattcgagctgcaatttatagattataacagcgaacatactctttatcccaataaaactattatagacattctaatttctatcaataatagtttttcacctgttgcagattgaggcactgaaaaaagatgatgacttgaataacgtggtgacacggtatattgaatatgatcaaacagatcgggtgacgcataatctgctccctggtttgtaaatgcagctgaaagccaccactgtggatattttgcaattgtgtgcttaatacatgcatagggaactatgccatggtttagctacttgccttctgttatttctattctggttgaaacatggagcatctagagaagctcttaaacataatgtgttgccatggggaagtttgcttcagctactagtctgtgcctaattaaattataataagtgacattatataccatatgctttaatttccggcataataagttatatatatatatatatatcctaaaaaataaggctctttccgcgataatattgatatggtattataagtctcataaagctaagatatgggaacagttcacggtgaaagtaagggatggtattataatattaattcaatctgttctggaggttattagacgatataacgggacaagaagaatatcatatcaaatgtcaattaagttaagcaatgccaaagtcaacagtttagtcaatttcctgtaatgtacgttaccaacactccaacagcaatgaaagtaacatgatcttgacggtgataatatattcagaaaggaataataacaaatattaaaaattggacagcactttgagctgctaccaccaccattttctatttaggacacaataaattttgtgcgtatcagcgaaccagttccccgcatactccaattatgaattatgtagcaataataattaatcatgtgcaactgaattatgaaactcgcatagtaaaatcaaagtagcatatggatcggggtcacatctgcccggaattagataggcatcatggtatgttaagaataatttgattattaacaatttaatattatctcaaataacatgcatactaaaatttagcaaatgaagtgctatttttagttaaataattttactaattttttgtttaaataatttaatcccactcccataagtatatttccttcaaacttaattataaacaaccaaaaaaggttcaatggactcaaatataataaaatttaattatttttatcatattttaatgttattgttctaaaactacccttcaattaattgagcttttatttttaataatttatttttattcttaatatcaaatttagggtgcttttaaaaaaatgtgatttaactaaattttataatttgtttaaaaattaaatttcttagtaaaaaattagttaattttgtttaatcggctcctgagaaattaatatctcaccgcaagtgttaagaatattttctaatattacttttaaacattctattaattaaaaattataatagtgagagagaaattcattaaatgtgaatttatttttataatttttaataaatttaactaagaaaatgtaaacataaaataaaaatgaaaaccggtgataggatatatgccaataattaatgtattaaataatgcccagcaacaaacaaaaaagttgatattaaaaaatccatgaggtcccacacaatttattatttcccagcttgtgtgccctacctccaaggcgtgataagcatggtggcagttgggttttgatgctaagtatttatgaaaactatcattggtagagcatttattcattaaaaaagttcccgtttaaataaagtaagtatttgtaagagtttattatggtttataaaaacaaattgaaagttctaaaaatattttataattaagtcaataaaattatttgtaatatttttacaattaagattaaattagtaatatgttttatttaagttatgtattttatttgtatttaatgttccttttattagtttttcattattaatattaaaagtataataatattcatattttattactttcaaataaattatagcaaagaatatatttaaattgatcaaaatatatatgtgacatgcaaaggtatgagtgcttgaattttactcacataaatatataaaaatatatatgtgcggacaagcttactgattatgcttatacagagaggatagacttggtgattcttgagcattacccttcattgttgaacgatgctagagaaatttgttttcctcctctagttgctttatagtttttctttgggcatttttttcccgtatatattaaaaaaaaaagaaagatataagtgcttaaattttactcacatgagtatatgggttgcaaaacaaatttgacttatcgttaacctactttcttataaggattgagacagagatatcaattcattagcctgtttttacccaacaaaaaaaaaattggcttttaactaagcaggaactagttcattggcccaataattttttaataagaaaacaaaaagaatagtgtagagttttggatttgtacttaattttattatggaaagaatagtattatatttaggaagcaatactgatttatgaatcatttttatttataattattcttcagttctcctttttatttatttgtcagactaaactggttaacttacccttagtcatgatttgtgtgaactaataataggatgggccaaaacgggtaaaactgacccattcaaccgtcgttagttgaaaataaaatataattacaatagtagccctctattatcttcctaattggtcgtgcgacgtgtaccacttcatttatgtcaacttggatgattcaaccacatcacatcccatccctcaaaaccaaaatcctaacgtcacgcaacactttttctcttcaacgcaacccatcttctctcatttatcactttctcttttcttcaacttttctattctgcttctgcgtctttaatcttacgcaaaacgacaacgtgtcattacttgcaacgcgactccccaaatgcaaacataattcatttccatctttctttctgcaaatacttccatttccttatttccttagaacgacaacacgtttaatttccatctccctccgttttatcctattgctcttcgtttaaattctccctattattattattgctacatcttttccttctttccctgatacaaagacaccatgagaggacaggaagatcaacaatctagggttttctgcgagctctcggctctggtcttcaaccttctccggtcaccgccgatcgttccggagccgccggcgaggcgttctccggcgggggcgcagattactccggcgggtttcgcgtcgctactactagggatttcggtggcgctgatgctgtgtggatcggtgactttcttcatcgggttcatgctgatgccgtgggttctcggattggttatggtgttttatgtcgctggcgtcgtttcctctctctccgttctggggcgttctattctctgttacgctacgccacgtaaggatctccctggtaagaaacccaaaaaattaaaactttgagatgttgcttaattatttgttgcagaaatttaggttttgttttttaatctaccattgttagaatctgaagaaaattgaagatggatattgtccagatttgatggtgtgtgtattggggataagttacgtgtttttggcaatcattgtgtttatctatctgatctcttgtttgtgttgtgggacccaaaaggaagtttctctgttgtttattgtctttttccttttctacccctccaatattcatccacttttaccaaatatttagaggaagggagatctttgagaaatatttggatagataaaaattgttaaaaattgttgctttttgctctattttttaactatagttggtaatgaaatttgaacctaacatctagtatagactactcaggtccatttctagggtagtgtttggaagacttgcgtgttagattaacttgttttgaagaaataattgttatattttaatcttgttgaaagaattttttaaaagaaaaactgttatcttgctgaaaatttgagacaaatgatcctaaacatgacctatatgcacgtaaaaagtgcattaaaaacgattcacgagcttatcaattaataaacctcttttgcccatcacatctcttcacaagcttatcatatgtctgtttggtttcctgtatatgcacctgctacatgcattgagatttgctgaaattttgagataattagtttaaaagctagtaaggaatttttgggataatttttgttgcatagatatatgcacctgcaagccataagatatttaaacttaaacttattaagccacatctatcggggaattggcaaaacccatatcacagatagataggctgcaattcagtatgatgtaggtgctgaatttgctattacccttttttaacaggatgttagcaggctagttgtttgaaaaataatgttctttgtggttgttttgctcagtcattattgatggttgtagttttctttttgaaacagattttcatactattaagaatttcatacttcattataaagtttggtcaaaattctattgggagctactagtatagtgaaaattttgagaataagatagattatgactatcttggtgtatggcctttgatgaatccaaaaaataaaatgtgaaattctttttcaattaagggttggatctgcaagattggttttgttttagaagtataaaatacaaaatttgcacccgcttcccgctggttttgtatattcctgttgagaaatgattgaagccgggtatattaatgttgcttgaggctggctaagttagcaaattctacctttttttaggctaaattggcaaattctaccattgcttggctttgatacataatccatataaactacaggtaatagcctccaattcgaaaagcaaattacattttagtcttttgtagaaatattatatttgtgtggtgtacaatatcttgtaactaaatttcgatattagccagtttggagttcccatttctgctgtttattttgacttaaccgcaaagcttatgtctttgattatctcattctttttggttggatcacgagcctaagaacttcattacaatttcttgctgtttcagagtggaaaattatatgaaaagataaataatcgaattgaccagtactatactggttttgtgcctgcctgctcatgctgcccatagaacaatgaagattactgaacttctctcactagaagcaggagtcatgaatatcaggcttttgtggatatggcttctctttttattacaattagccagcaccaagaattgaggacttgttcccagctactgtcttttgatgtcaattattgtatttatttttatatatcttttgtaaaatttgaattatataggcttctgattttccttttttttttatttgccatttccaaacatggtatatgactatatatactataaaatgaaagggaaaatatgatctgatgactcacgagaccacggttctcttattggtaattatatatataaactgaggacagagttatgcctcgcttgagttgaactaaggctaaactaatttttgcttgttttagaattccattcccatattatttatttggctgcctataaatcaagtggaaccttagttagggtgaatataagttttggaaagaaatgtaaatggggaaaatctgcagtttttattaatagaattgcttcaaataaaatattttcaagttgggaaaaaatttcaaattcagtacttgaatgtacagttatcaatagtggcgttattgcgcgcaatactgaaatagcggtgcggtgcggtgcggcagtcgatcaacatagactgcaccacaatagagcaaatgagaaagtggcgatagctgccactatcgcgggtgggtgtggcagaaaaagcgggtgtggtgcggtgtgttgaggaagcacgggctagacgaaagtcagctgctgccattttgctattggtcaagcctcataaaaggtaaaacaaaagcatcaggtgtcagtgcacttctgtactcgtgtcgtgctgtttgtttgtttttttattggtgccactattaaaatttaaaaataaaaatgtaaatattggcttgtaagtagtgattataaaaattctccaagcttcctttctcctcccgtaattattagtactagtaaataagtctaatataaaaactctcctttttttaagacataaactctcctttataatacttgataaacacatagactagcttaagcaagtacacgcagataggcatggcaacggggcgggttgggggccccgcccccgaaaaccggtggggctaaaaaaaatgatcccgtccttgcccccgaacacttaaaaattactattaaaaaattaattttaaacaacaatcataacataaaatttgatcgcgctaagtctcaaatgcatgtaattacaataaaatttcaacattagatgttcattgctggaaaataaaattagttatactcctaattcttgaataaaactaagtctttatcccaaggtattccacatatataaaagtatttttataaataattaaatatagcatggcgggggcggggcggttatcagcattatcaaaatcgtccctgcccccgaattcaacaggcagggaaaaatcgaacccgaacccgaacccgaaaccggtcaactcgatttttttccgttgacatcggggcgggttcggacggatgcccacgggtgcgggtcaagttgccatgcctacaggcagaaactctcctctcctctttcaaagcattcaactctcctaagctagttagttttacattatattttattttatcaattttatattatatttttattttatcaataaatttttttctatttgttttttattatataaagtatattcatatatttgttttttcttccggtctatttattacttttttcttctagtctaattattttttgtttttttattgttcattaatttattattggactattttatttttttacttataattttctatattatctgcattatgcaaatgtttgatatttatgtcatttttttgggggggattatgttgtttataatttatatatataattcagatttcagaataatgtttacttatatactttgctatagcgatgtagcgctatccgctatagcgctatagcattttttaagggtgattggtacgcgccactatccgatattaataagtatgcttgaatgcaaggtccctgttgccagatactgtgattcttaaatatgaccttctggatgaggaaagaaagtgaaggacagaaggaatcgaaagaagaagaatcaaagatataatggaaagaaatttacattgtttagataaagaaaatgaaaagaaaataagaggggaaatatttctttgtttgatcgaattgaaaagcaaaattggagaaaaatgaataattatatatagttttacacatgatgggacgaaggaaatgaggtgaaagttcactgtgttttacatgttgtatttttggcgttgtcccttgcatagtagcatagaatgttatgttagacccacacggttttaatcagtcactaccttttttgtgtccatcaaacaacagaaaatgatatcgtctcaccaaaatggttcgttcaataccctttcttcccaaaatttgcctaaacaagcatagctagggactagttgattcccccctcctaccacgactccattcttttactcaagggtatcattggagattatctttttcggtgtgtgatataaaagataattaaaataaacttttcctcttaattttttttcatacacgtgattaaaattcaaactctaatcaacatgttaaccgtttcatacttcgtttataggaatctgttagcatcaaaactttagcattccgttacaagtaaacctctaaatgcctaactttcatagaacaattcgagacagccaaaagaaaacacaaacaagacgcaactaaggaattgatcctaactcttatccaatattgtacctagctctttaattttttttaataccgcgacatcttacattacatcctacccctcctatacacacaagcatacgaccatacgcatgcagagacaaagtataaaagtgtgttactaccagtcctccacgatataactataagatgttgtttttacccttgtctctaaaactttgaagattcatatattcttctacataaatgagcaaagagaagcacatcacacagatcaatattccatgagagagaaatgaaagaagaaattaattaagtcatccatccttgatcacatcttaaaagttacattacaacaaaataatttaaaccagaataaaaaagaacaaaaagaaaaacaccaaccgtagagaataaaacaacatatagcggtacatcattgctatgggatgattgattatccagagtaaatatgcacaccaatggcaagtagaaagatggtgatgagtccaaagaagatgatggtgtggactaagatagataagccactagtttgcatgttcccaaatgccaccaccttgcccttagcaggaagctgaaacagcaaccctgggcttaaaagcacaaacaacactactgatatcaccactggaccccaatctgatgccatcacaccctgcagaaattactacttgttttacaacaaatatagtaactagttttagatagtgatcactacttcacagatgtcccagttttcaatgaattaaatgctgtgtgatgatcatctataagctaagcttattaaataggaaattgaaaaatgattctgatctgggtctgaggcaattgcatgactgaggaaagtggagcaaagaagcaaggtataattgacaaccaaaaaattagcatcaactatgccttgtaggttgatgcaatctagagcataacttgtcagcgcatcttgaatctcgcattacttttcgttaaggagaagttttctagagagattctttatacaactacgatattctactatccaatactttcgattttttttccatcacatacgtcattcttttaatctctttttttcaatcgcctgtcgcatttctcgtattattgctaatagagtgtataaccgcaaaaagatatggaacaatttttttccttgttaatatgttgatcaaatttgttgtttgcttttttatcagattttattttagttaaaagttaacaattaaaaagaaagtagtatatattgttacttggaagattatctttttttaaaaaattgttaaaaatgagagagaaaagagataataaatttgatttttttttatgtgtattttttggtttaggattacaaatatattctagtaaaggcaaattctattcaacatccatatcagttatcaaggtaggataggaatagttctcgcgatgaatttttttatatatacataggaaaagaaacgaacaaagcaaaagacctattagttcttgtttcaactgtcattcgttttgtatgagattcttcaatgggaaatattaacaaaatattttttatttgtttcaataccacaaatgtcattgtgaatccaactaatatatataataaaaaatgtctgtaaaattttatccaataacaaaatatattaaaaagcatgtcgaataatgtatttccaatgttttcctcgtagatttataagtaaataattaaatttgttatgaaagtatgatcctgtgataaattagtatttaaaagatgaaatatacaatttaatcattaaatgtgcaaagtacgataaataagttcgattcttaaatttgtaagactattttatgattaagttataatattcaataatcaatttgataataaattgtattttttaagaatctattttgatattaaattgtaaagttctcggataaatttatcattaaattatatggaaactaatttacgtattattaatcaggaaaatatcactccaaattgttttttactgcggaggaagggaggagagtctgataaaagtttttctaagtagtattggtatcctccgctggttggttgggctccagtgccataaattaagcttccaacttcgactgtgttatgaatattgttcatgattaacggagctggtaaattgggctgtgtgtcttgtctgaaccttcttaaccacagtgtcaaatttaatagaccggcccaactcgtatttttccaggggttcttaaattaatgcctgagcctacctttatatcggattagagagctacatttactttaattataaataaataaaatcaaaaaatacatataaattttaagaaggaaatttgctaacctacacatttttatttttttatgattgcgttaacaaactataatattttttggttataatttgttgacacattcatattaagaaataagagtgtctacattcataattttcacaaatatttattaaagtatatatctttattttttagtatttataccattatgtattttaaaatatttttctaattatagtttattaaaaaactgagactaaaaaacgtgtatattaataaaaccttttaagaaatatatataaattcatatacctaatttaactgcactaagatcatacttggacgaagtgaaaaatattatcggtaaatagaattacatcttgtttgtttgttgatatctcaaaaatattctgtcataatcagcacaattaaatcaactctcatataagctccagacgattcattcatttgaaaatttatgcaagaggtttaatattcagggtttacagattcacaattattcaaggggagaataaaataaactgtgtcacgagtggttggttattcacttattctgcaaagtgccgcaccttttattcttttcccgcgttacaccaaatcaaatcaagcctcgagttgaattgaacaaatgccgtaaattaatccgaaattaacatattctacgtcaactgaaacgcatacatacatgaagatgcaaagcttatacaggtttgaattttcagttcagatatctaaaatgcaattgagtataaaatcaagtactggcattcattcagaggaaaactgaatacaggcacaacatctgaccaagctcggtgtcaagaacaagaaaaaaaaaaatacaatcacatgatgaaagccccgttgttatttcaacacgcaataagaacgggaataacaaagcagaacagaacagaaacatgactgaattgaataatcccaacaaaaatgaaaaagaaaaatgatttccccaccattgatgaggttgaaagtgaactatccgaggtacaagtgaatcctaacagccagcaagaagacacatatgagagcaaagtagaggagggagtgaatgagtatggcagcaccacttgtttgaaagttcccaaactccaccacccttgacctccctggtacctgaaacagcaaccctggtgttaagagcacgaacagcaccaacgacacaaacactggaccccaatccgacatgttttccagctagtactactctactgttaaggctgtataccctgtgtttgtgtctgtgttgtgttaattagagtgaagcacactcacagaatgctaactaagcttgtgttgtgggggattcatggatggacgttgcatataaatgcaatcaatgttggaaatgattgtggggggacaaagatggtgtgagaggagtttttggggtttaagttactgtggattcactgctatcgtgcatgtgattgtatatgctttgatattggacttggatttggattaaggataacttgcttcccatgctaattacaattgggtgcttcaccttccgccgattatgtggttctgaagcaaggaattagaggccactattatatatggttttgggattttaatattcagttcggacgtgtcctacaaaatcagggctaattggtttcatagttatactagttaggatccctaatctaagacttgaaaaaccattaaataaatttagtgattggatggtatttgatcatatatgtgaacgttaacttgtgtcttgttaatttaattagttcaactaagtatttttcttttataatttcagccaagtaatgctgcgaattagttaattgaatgcaagaggattctgtagtgtgctttttacatacaattatttacatttattgtgaaaccattttatgttattgtggattttaagttaattataaagtgaggtaaagaaaaagttataaagtaaaacttacaatgaatgataatttatctttaatgttactgtttgaattacgtttgttgctatagttataataatgaaaattttcatattatttaagtaattacaatttgaagaatgttatgcatttaaaaaaaattacaatttggttcaaatttaaggggtgaaaaagtttcaaaaattgtgacaattaaaaggagggtaaatcttcgaaaaaatatttttaaaaaatactataaatggaaaaggaaaaaattaaaaattaactcatcccaaatagaggaaactaaaacttaaaatcctcctcgaaaatactgctacaaatagaagaggattttcaacctccacaaacaaagaaggtttaaaccttcacaacacaatcatcacaaatagaagagttttaaaacaggttacaggaatcctaaaattgtcataaattgacttctggctaatgtaattacagcaattgtcaaaattctcacatacaagggtgagagtaaaacgggttaagagatgtttatttttgttcttatccaacttaaaatttgttcagatcatttacttaaactcaaatctaactcgaccaaaacttgataaattaaagagaagatcagattgacctgacttattattatcgtaatatatatgaatcttaacaatttgtatagttgaatctcaaaataaaaaatatataatatatcaatcttaatatatagctgaatctaagaatgaaaaaaaggaagaaaaaaaacccttaaattaagatatattttacaatatacattttaaaataaataataattttataaatataacatcatgttatacaaaatgttatccatttaataaaaaatattaataatatatatttgtttaaaaaatattaaaaaaaataagacattaagatcaggttaagatggcctgaagcttaatccgaactcatccctaaaatataacagatctaatttttaaaattcaaacctgtacaaatcaactttaggttaagccgagttagaggacaattgggattttgcacgccccgaatcccatatcaatttgaggacgtaaaattgccccaaaataataaatttcttatagtgttatattttgtgcttttaagtaaacaataatattactaatttactatatctatcctacaatttacattatgcttgtgggaagaaaactcgactttgatctcgacccaattacccagttaaagtaagagcaattactcatggaaagcttcttatatcaagagttgcattttagtttattaatagagatggaaaaaaatatgctcgaaggtaaatttaaaattaaaattaatttaagtaaacattttaattacacttaacgaatttaaataaatttatttaaattaattctatttagttttaaaacaatcaggtcttaatcagagatatattaatgctcaagactcaagttgttaatgatacttaaatactattttcataatgaatatttatttatttctattaaatttataatagcaaataaaatactaccatactctgaaaaataacatcccatatgcacaacatatgtaaaacgtttggaataatttattcccacgatggaaagaatttaaaacaaatggacaagtatgtatgactttatcttccccaaagattatccagttttcttatctaagttcaccaattaacatggctttgaatcaaacacgtgtactccatacacacactttctctctcgttcgtgtcatcagggacctgaaattcacctcttgttccccaagtatttcgtgaggaaatgacattaattgattaaatgccacatgcttcttgaaccataccctctcaaattaatttaattcacacacttatgttgcaattttctcgtgaaataatcataacttctcatctgtttcagcttttcaaaataactgaaaagaatttaaaatatgattaaaatgataagttattttaaatattttctcataaatctgctagcatttctcaaacatgtaccatatataacaaataaaatgagattaatgaataacatacgttgaaattgtttgttttgaaatgttgatgaagtcaatgtcttttttatttatttattgaaagtcaatatatcaactcaaacgcctaatacttctaataagttttcacctacctgaaattaatcctgaacttcaaccctcgttcacacagtacaaacttgtcttttgtgtttaataatgatgaccaggtcttcctttatgatgatatcattgctaatcaggttgcccaagagatattcaacccactcacctcattcacaatttcacactacattttatatttcacattttatttttttattaataattaatttcacctaactacatgtagtatatgtataccactaaaaaatatactgtaacaaaaatgtgaatttctagaaggaagtattttccttttgctcacattttatattttacattttgtttttttattgatattataattaattggacctaaatacatgtagtatatgtatactactaaaaaagatactgtaagaaaaattgtgaatttctggaaggaattattttccttttgttcacatttgaatcgcaatagtagtgatgaacaactgtttgggtatgtttcagtactctttttcattatttagaaaatttaagtcacagattcatattcattcaggaataaaatattatcattatcgcttggaaaaaaataatgatatacaaattattttttatttaaatactctattaatatcttttctttttttctttttatcaaatcataaatttatcataatataacttttttcttttttttactctttttaagtattagatagtaatgtgtaccaattatcaaacatttgcctttgggaaataacttttcactaccaaaaaaaaaaaaaaacatttctgttcgttttacagttttgtaccaaaaagaaaaagtcacgtttacagttgaatcattagtttgtggcgaaatttacgcgcgcaataattatatgagcggcattttttttcttttttttcccgatattcatgagcgtcattttctaaatttataatgaaagtttaatttcaatgtattatccacgttaaatatttttatattaattaaatttttaattatggcatgctatattattaaaatatgcatgacgaaacttttgatttattgatcatccactcaattagtgaatgtgttcgccttgcatatctcgcttttttttatgcagtacttgcatatcgcttaaaaacaccttggctcatttatacattaaatattttattaaggtaaaaaatgaaaatatttaaaataaagacaattataatcgaagagtagaactatttataatattttgttaatctctatagtctaatcacacttttaattgcgtaatcaaatatttatttcgtcttttgatatttctttaaatatttaagagggtagttagcaaagttaacaaaaaagtaaattgtgtataatactactacacatttattaaattataaaaggactaccagattgtgattaccgcttagaaaaatcacacttgctccaacttgcaaagtcttttttttaatcactttaatgtaaagtctttaatattctaaaattaaattaaagaggtgagaaaagcaagacatagtagtagcaatctaatagtaatatctcttggtcttggtcttggtcggggtccccaacttgtgttaataaaaaaaaaaaaagttgtttaataaaagcacgtttcgctataaccttaaccttaatcacaacctcaaatcaactctatgctaagcttcaactaacgccaactgcgtctgtttcagctttctgcttttgcaacttcctttctccgatccattattcttcggaaccaactcgcaccgtagcgaatctagcagcctctgcggctccaacaatgctctgtgtccggttctactacttgtagcttttattcctcggattcaacaccatgacacctggtaaacgtgtctttactttttcttaatgattaatgatgttatcattatgtcttgggtgtattattggaaaattgggatgtttaatgttttgttgcgatgtatagtgaagtgaattgagtttgacttggtttcattgagtagttgaagtgaaccacatcacttgcgactttgggtgtgtgcattctgtttagttttctgaggttggtgctttcaatagggaccatgtgagttttggaatttgtttggaatcggtgaaaatcaaacactcgcactgacagtaaagcacttttagtatattctctgtagcatgctttttgcaatttgatttaatttactcaattattttgctgcccctaacacattttgcttccaaatgatatggaatattggaataattcattggtgccgtacagagaagaaaaaaaattaagttgttagttacgttgtgcagttcttgttaaagcataaaaatgtccccagcttatctagttcttctgctataagaaggaagaaaagaaaaaaatgatgatgatgatgggaagggttctaaatcttttgacttatttatgttgtggttttaggttacgaatacgatattaatgatctgcatcaagaggctcaagccagatggttgaagcctgcagaagtgatgtacattttacagaatcatgaaaagttccagttcacccaagagcccccgcaacagccaaccagtaagatctgtgttccctttatccaattgattttagaaataaaaataaatgacagattttgtcattgtttcttcagaattgaccataaaatgctgattgttaacattatcaattgatcttcttaacaggtggatctctgtttctgtttaacaaaagagtcctgcgtttcttccgtaaagatggtcataactggcgtaagaaaagagatggaagaactgtgggagaagcacatgaaaggctgaaggtgtgttagtagtgtctatactgttgtgtttattagttgtccatgaaaaaggaaaatttgttatcaagtgtctaaaggggtatcagttgtagaaatgcagttcataaattaatatttaagagggggaaaattgttgactctcctgaactgttagaaaaaatatattcatatctttgatagatgtctcaaacttggtgaatggtgacagatggtattattaaaaatagttaaaaatccttattggaagtttcattgaagtctttcacgatgcttttgaaataatgaatgatttgcctatcaactgacctttatatacattagatataacttatttctgtttagtgattcttttttagcatgttatcaaaacattattcacttattgttgccatatttatgagtgtaggccaacatttgtctttgtgatggtattctgtatactgatttcttcaatttaaatgattgtactaatctgcatgactaggttggaaatgttgaagccttaaattgttactatgcacacggagagcagaaccctactttccagaggcggagctattggatgttggatccgtgagtaaattttaactattagctaactgtatatccttcatattattaagcttatcactacatgttgtatcctttaaaacaaacatgcaattttcggtaaaaagccatcctagaggctaactaaattttaagtgaattgcaaagattagtttatcctagactttgaaacagaatcagccttcgatgtacataactatttgtgtgatatgcttatatatatgttatcgtaatagtcattcattatcactcatactattgtttcatggcagggcatatgagcatattgttcttgtgcattataggaacacaagtgaggtgagtctccgatacatgatatcagataaacataataatagtacttgtagtttgtgcatagtgtccctccagaaaattttggggaatccttttgtgcaagattgctcactgtctgaacatgttttggattagttgttttacagacatcctgcctgtttactattcacttgtgaaactcaaataatttggttcattttcctgttccatgaaatttcaaacattttctgtattctttcatatttactttttgtagatggcttgtgcaattgtccattagctgttaagatttcttgtttaagtttggtgtactgattcttttattcaccattataattactactgtgttgtaactccctctctccccctcccctctctcattttctattttcaaacttcatttataaatgtacatgtatgcttccaaagtcatttaataatgaattttagtatgcactgatagtgtaaaggatttttacattgcattccaaattgtagattgtcatgtatggtaacattgttgacttgtaataatttctaattgcatgaatattagaccctttaataattattgtgcaacacaattcaactatgaattaaagtcattccccatgcattctcttaacttcttgaaacttttctattccctatgtttatgaacatctctttatgctcttctaccaagcagaaattacctacagagatgcctacacctcacctcccatatagttaattctctatgataaggacaattggtataagaaaaagtcagtgattattccaaagattgtaatgtcctgttgcttttatgcactagttatttcatttgatggctttgtgcctcaaataaagatatacttaaattttcttaaggccttcaataaaaaattgaaatcttcttaagaatcatatttggtatcttgggtggaattattaaattatattgttttattctctgtgtgcatagtaacattgttgtgcagcccatctttgagttttgcattaatgcactcactctcatgttatagggaaagctcagttctggagctggggcacaattatcaccaagttcctcttctgcatatactcagagtcctagcccatattctactcagaatccagtgtcaacatccatacttggcgattcgtatgaacctaatcagagtttctccagtccagggtctacagaagttacgtctgatatattcgtactgaacaataaaatgggtcacatggatgggacagatacagaatcaggaacctcgcctgaactcgaggttactcaagctttgcgccgattggaggtgcagttaagtttgaatgaggacaactttgaagatattgtttcctttggcagtgagcctgaaactgcacatgattcaaaccctcagcacgatcaaagggtgatcagcaatcaagaacaatctgcagctttctctggacctgatgatcaaggactattttatgatggatataatgaaacgcaaggtaaattaaataaacttgatctgttgagaacgcatggcttaagtcagtgaaatatctgagtgcttaatctatcgtgtgtttaacatgttcacttttacagatatctgtcttctacttatctaaatgtgcttgcagcatcttacacctgcacagctagttttctgtaatttgttgatggaaattcatagcatacctgtttagattaagttggtcacaactattatagccatcttcttgtttggtgtatttgtttaatttttctcactgaaacataattccctaattgttatatgctggttgcgttgtgtgaattattagaatttgggtttgagactaattcaaccccaaaagctagctcattaggtggtagttgtccccccacttttattcattattttagtcaatgttggacttgggtttttctcaatatgaatcttaagagaaatatgcgattcttattataagccaagtaaccaggaaaaaaaatggttctaaacaacttactcacggctaggtttctttgtatttgacattaccccagtagactttataaaaacatatcaaaatgtggaacttgctgttaaggtttgagtggaaaattccatatgttacataataaatgaagtgttttgcttcgtttatatggttgataaggaaaataaaacaaatgttctagtcttgataaattgcatgtggctgacaggttagcacttgactaacctttaataataacaagaaaatttgaagtttgagagaaaaggttgtgatattattttaaaagatgccatgaagaatataacacaacatacttacaggatggtgatagccaacctgaataaggatccaaattaaacaaggaaaatactaaatttaaggaaaaattcaaggaaaatactaaaacagtctcgaagtatacttatacaatggatttcgggctcaaaatcacgctcaagaaggtaaatcccggttgcaacaacaagaggctcgaaaggaagtttctgtttatatcatatgggccctgtaactccaactagataaaaaatggtggttttgcctttgcttgaagtttttccttgtaaattagttattatctgttcaaaaccttttttttaactttatatttttaatttcaagtgaaattcagccctttatagtttgttttgtcctcttcattatggaaaatcaaatgggaatagaggaaggtaaaagatgctaaaagtgtttgttgttataggtgatggtggtgaattttatcaggaattaatagaccatggttaccctgatggaaatgaaaaggctttatggacagaggtgctggaatcatgtaagtcctcatctgcagtcaagttaccacagaaaaatgtatacatgccaattgaaaatgtaagtattgcttcgacatatttaataaaatttatatcattttgcaattttatgttttctcagatgttgaaataattttcttcatgtgtttctgcaatacttaaaatgtttgattcttaaagcaggaaatttcagtatcttctgcaagaagtgtaccagtttccaaccaggaaaacagtcagtggctcaacttcaacagtaatcattctgaaaactgtatgatttactttcacctggttaacttacaacatttttggcatattttggtgtttcttcaacttctgattcccctcccatgttagcagctgttttctcacaacctcaaggtgttgatgaagtcaaatttcctgcctattcttctatggtggaaacacaagtaattaattctgactactatgaaacattgtttgaccaaagccaaattggagcacctccagatgcaaattcaagcttgactgttgcacaaaaacagaaatttacaattaagacaatctccccagaatggggttttgccactgagactaccaaggtttgtgcctttaaagcccaacaccttgcataccctatgcaatgatttatttctctttgcataactggtatcttgtggacaatgaaagtgctcattcctttgattcataactattggtgcttataccttacctaggttcctgaagagctttaaaatttattcttaactttgttgaaaatcttgaaatctatatgaaattcttgtggtagtggtggtatgaagcaattatatataaagctcagtctatttataataattaggttagggaaatgttgctcaagcttatgtctttggacatttaagacttaacaagttggggcataaattttgtctcttttttttttttcctttcatctttcttatcttaaaaaatgatgtttagtgttgattttgtccaaatttgattcctaaagctccatatgcataggtcattgttgttgggtcttttctctgtcatccctcggattctgcatgggcttgtatgtttggtgatgttgaagttcctgttgagataattcaagatggtgtaatctcttgtgaagctccatcccaccttcctggaaaggttactctgtgcattacttctggaaaccgggagtcctgcagtgaggtcagagagtttgaatatcgtgataagaccaatagttgcactcgatgtactcaatcagaaacagaagccactagaagtccagaagagctgttattacttgttagattagagcaaatgcttctttctgcatcaacaataaagaatgacaacatagaatctggaattcctctcataaaacagaaagctgatgatgactcttggagccatattatagaggctcttctagttggcagtggaacgtcaactggtactgttgattggcttcttgaagagcttctaaaggataagcttcaacagtggctttcttgcagatctcaggaaaaagatgaagagacaggctgctctttgtccaagaaagagcaagggattattcacatggttgctgggttaggttttgagtgggccttgaaccctattctcacttgtggagtcaatataaatttccgtgacatcaatgggtggactgcccttcattgggctgcacgttttggaaggtaatagagaactctagagagcttgctactatgtttactgatttatttagttttggtgaatgatgttaatattgctatataaggcttataggtaatgaagataaggaaagcatacatacttgacagacaaaatgtgcttggtaaaatatgtatgcaatttttttttttcatttggagaagggaatgcagaagcaaggaaagataaaatggagaaggaaaggagaataaactatctgatctcttattataggtatagagcactaaaatgcaaggaaaaagataagtgtttcagatttttaagtctgaaagttaaatttctggagatgcagactgcaggatagatgtaagaaaaactgaaaaggatgtgttcggttaaaatgatatcaaatacactgtgttttcaaaatctgaaattattaaaatccctgtaggttaagttaattggctttcgggaatgcctagtctgtaagtcaaaagtagaaattgatgacaacactgagggtataataaccacatgtagcatgattgcttaatcattcaaagcaaatgccgagttgctgacttttatttctaaaaaaaaaaactaaaagactacgtaccccatggctcagaaactcctcactatgcgaaggtaaagggaagggatattgtacccagccttacccttgcatatgcaaagagactattttcagattcaaatccatgaccatcaccaaggcacaattttactgttgtgtcagggctcgccccctgctgacttttatttctaattaaaagaaattggttcatccagtcatctgctggaactgatgatcgtatcaagaaagttgtcttgtttcttcagaaaccattttataattatctgttccattttaaagtattttggatgttattttcctgaagctttgttattccatatagggaaaaaatggttgcttcacttatagcttctggagcatctgctggagctgtgacagatccaaatgcacaagatccaacgggtaaaactgctgcatctattgcagccaacagtgggcacaagggactggcagggtatctttcagagatagctgtaacaagccatctgtcatcgcttacactggaagagagtgaattatctaaaagtaatgctgagcttcaggcagatatgactgttaacagtgtctccaaggaaaatcttactgccagtgaggatcaggcatcactcaaagataccttggctgctatcagaaatgcaactcaggcagctgcgcggatacaatctgcttttcgctcacattcttttagaaaacgaagagcaagagaagcagcttctagtgcaggtggcattggtaccatttcagagatttctgctatgtcaaaacttgcctttcggaactcacgtgaatataattcagctgcttcagctgctttatcgattcagaagaaatatcgaggttggaaaggtcgcaaagatttcttagcgttgcgccaaaaagtagtgaagatacaggtaatagatgttaactttatagtttgactagaacaaaatgaattccaagagctacatagatgttattcttaatttatatataactagcacttaaagatactctgaaagtgaataaatttgttttttaaaccaaaaaacagctggttataggcaagctacacatgcacgtgcatactttgatcttcaacggcattattatcaaccttggttatttctaatttatttgggcaggctcatgtgaggggctaccaggttaggaagcattacaaggtaatatgggcagttggaatcttggacaaggttgtcctacgatggaggagaaaaggagctggtttacgaggtttccgacaagagatggacatcaacgaaaatgaagatgaagatgaagatattctcaaggtgttccgaaaacagaaagttgatgtagaaattaaagaggctgtttcaagggtgctgtccatggtcaactcaccagatgctcgtgagcaatatcatcgcatgcttgagaaatatcgtcaagctaaggtaaataaattagtctaaaagccgaagagtaaagtgtttgcattttattaagcagagcaaccaatatctctttagcatgtgttagtttgccactagttgaataatttaaacattgtttagcatgaggcttcgatggggcattccgtgctcaatcaaaaataaagacaaaatagtaaccatacagagctataaaccatttttaccttttagaatgcaattgctttgtgctgttaatgcataacttgtcaattcccttgcaggctgaacttgcgggtacgagtgaggaggcatcattatcaacttctgtaggagatgacttatttattgatgatttttatccatttccctaggagcaacgctagccttggtagtcttcattattttgaatgatcagtttgtggcacaaccatttcgatggtctttgtatctagatgtctagaacaagctgacttattagtttgaaacagtctagattgtatagtgaaaataacgatgaacattgttactttgtaaaatatgaaatggtcttgaatgcaggtggggtggggtttcgaattgaatggattaagtttctttagcatctccttgcgtgcactcttgatatcttcgcaaattttatatagcttatggctgctaccttctttacaactgtacaaggtatctgaaaatgtagcatcattgaatgaaatgttggaatgaggttagcttcagggttgtttgagtttcgaataaaaatttgctattagggttgtttgaggttcgaataacaaattgttattattgttactttagtgagatttaatcacacatttagtttttataattgcacaaattttaccttctaattcttatatttaacaattattcattttagttcctatacatatcattttaatctcttttgtacttaagcatactgactcggttcattttagactgtttgataaaactaatttataagctagctgataacttgtaaattaactaatttaattaaaagtattggataagactagctatataagttaattgataattgtcaaatgacataaaagaatatatatatatatatatatataatatttaaattttatttttaataacttatcctcctaaaaaggaaataactttttaaatgcacgagtttgtatgagtaggagaaaggaatgaatctttatttagagggaattttacttgcatttgtgttttttctcacattgcattcgatattcctatttttttatacattacttttatctcattctattaacgtcattaattaacgttaattgaaatatttgagcagtatttttttttcctcaaattgtacctgatactcatcccttgaatatgactctgacggacgtgtcaaggacctctacgacgctagtatccaggaaaccagacgcaatactgatgatggccgaagctacgacggaggacaaggagatgatagaggtggatatggtgattgcggcgacaactatggtggtagcagtggctacgataatggtgatttctttgacgagagtggatgcgttcgaacgtcatattgatggacgaagacgactatgagaagaaagagatatgctgcagtgaaagaggaaggaggaggaaaagaagttggtggtggtaagtgaagatgtattgttgaagaatatgagagtttgtaaaacccaaaatgtatgattttgaaaaagatgagaatatttttagacataaattttcattaaaagtcacatgactaacatgtatctattttctgttaaattattaaacagtgattaggaaaaagaagattcatttaagagattttttataggatgcaaaaaagaagaggtatcaaataacaatttggaaaaaacacaaaagatagcaagtataatttactcttatttatatcaatcacctgtaacactctacattaatatatttttcaatacataaaccaatagcccccattttaatttttaaccacaatttattataaaacaataacatctacagtaatatcttttccaagcctagtcatactgatcttaggcgaagaaaacaatccttcgttcagcaccaaatagaaaggaaaaaaattaagacaagaagcataaactaatttgtagaggtaaactggatcatgatgcttggattcaatatcgcggatcacaaaaatattgaagtttttaaactccaacactcggtaatctttcaacaatttatccttgaaggtgagtttttaaccagtcacaacagaaaattctaaacacaacaggcacaattaagcgttcaacacaaccaaccaaaaataactcattttcaatttcaaatgtgcaatctgaaacagctagcaataggcaaacttcatctatggcctttcaggtcatatgtcttcatgcatagttcaaacggaatatgtcattcaacacataatagcttccctgaggcgttggtatcaaatggaacatctgaaaaaagagtggacaaaattagtgatggacagaaattagagaaacagtaacatgagaagacaatagagcaagaaaataagatgaagtgcccaccaaaaacaatatttctgcatatacaggaaaaatataatgtacaatttaccagtataagagcacatgtaaacatgtgtagtaagggttaacaaaaatatgccaaggaggtaagactgtaaataaaattccacttccatttaggcaccatcatttgagtgaaatgacaggatttggacaacccatcatttccattcagagtcaggaatttagatcctctatcatgaggcaatcacttctaagttcaaggtaaaatgagtacatcgtaaaaattaaccttactataaagaacaaacaaaaaaatgaaaatttgaattattaatgcaatcacatgaagtactttatcttctctgtaatgaaacccaacttcatctattaccacaaatttaattattttctttaattacaaagaagacctaagatgattaatagaaacccaattcaatcacaattcatttgatagatggatacccaaccatcccatccatacagataagttattcaatccatctatgttttttcaaaaaaattaagctccttaaatttattaagagataaatagaacaaaataatttactggaaactcagtagtcacaataaaaaaaaatggttgaattaaatataaagagagaactagttctcaacgaagaggatcactgcaattttgcatgcctcctactggtagtgatcatagcttaacttccacataaactccttgatgttaacatctgtgactaactgcaaagtcctagctgtttgttcaggtaatgatcattgattttaatttttttagggaaacaattttggtaaagagagacttggcgctgcaccttgacatgatacccatatcataatctcacctgcttacatagaggtcagagttgaatgcactcagcttatagagattgaaaattcattaaaattcctagtgtaattcttgtgaaattccattgggaccttgtgagaagaacaggaagatttgagtcaaatttgaataaaaaactgttttgaaggacccaacaggtcaccaaattgaactcagattcaggtcactaggccaggtcgcaatttggaagaggggaattatgaataacctaccaaagcactgataaagaaaaccgcaataactttgctagcaaattgatatcaatgaaaaagacaagaacagtggttggtaagagcacatgaggaagaaggttgagatcaagaagcatgttgaaagcatccaaaatttgagagcttaaagaaggacttcccctagttaatagtgtggttgagggcacaatgaaacgtaaagaaaccaagttgcctttggatatccaacagatatgctgtagtacaatccatgacaatccaaaaaacaactttgatccaatcaatacagtccattgaaattattatgataaaaggttggataattattttgccactcactctctactctaaacaagccttgactctgcagctaccctagattcccaatcacaaactggccattctctccaatcaattgccaattcatttgaaaaccttcgtaattcctccttctctccgtgatagattccagattccaacgtcaatagcattaataacaatcgaaaaccccataacacttaaaaatttaggttttccagaggaacaaatcgacacgttaatcaatcaaacacacgagcaaaatcagcatccaaattcaaaagcaataagcacagaaatgtcaatcgcgttgaaaccagcatgcgcgtcaacgtcaaagaccgccgtcacagcgaaacacaggattaggcagatcgaaacgtgaatcgagtaattatcacggatcggagtgcgaataaaaccctaacagagagagggagagtacctggctgaacttgagagtgtgctgttcgccggcgagctggaggttgccgctgacaaagacaagcatgccggcgttgacgccggagggctggcagtcgacggtggagatggagtggtggcactgctggaaagggagggaagtgagcttagcgacgatgctggaagcgccctggatcttctgcccttcgaaggtcagcatggaaccctcctgatacagattcgctaaaccgttccggttggtgtcgaaggtgctgtagtagtgctccacgaatgcctttgccaacgcgtctggatccatctctattctctattctctcttctctccctctcccaatctctctctatctccgcgcacacacacacaccctctctatatactacacttctacaccctcgcgtatcttttaggtaccaacagtcaaatttccaaaatataaatactatcgtaattaggtctttgttcccccttaaacaccaagttatattcgcaaattttgattcttttaatctgattatgaaattaatcttaataaatgaccgaattttattctagatttttaataaagtttttctttgttttgagttcgatatattaaaatctttattttgaatttcctttattaattaaatgataatatatcatcttataaattaatattttcaacattattaatattaaatagtgatttattagatctcacacaaattttatttacaaataaaatatttagtcaataatgtaaatcaatcatttttttctgcatcttaagttatatttactaaattttgcctaaattaaatcacaaagtaaaaataatcaaaatataaaaatgttcgtcgacagcagggttcgaacctgcgcgggcgaagcccaacagatttcaagtctgtctccttaaccactcggacatatcgactcagatgtgaattttagtcatacattttttgattacaaaaaatttctttgcaaatcatataaatattaacaaattaattatatttttatccctttattatgatcaatatgtgaattttattgcttaatgattttcatttgaattttttctgttgatatttaaattattatagttaagtacttcaattactttttctatatttaactttaaatatttatttcctattcaattgattagagatttagtgtagctttaagatcgaaaatagtctaaaaggttcaaaatttttaaaaaaatattattagtgaaattaaaaaaaaagtgaggttgagattaaaaaatagatttttctaattcaagatgaaatacaattttttagttgatgaattgtggaaaagaaaagtgaaaaccctatttaaagagactatttgtgtacatatgctaactgcatttcctctaaacaaaagattctattgtaattgtatgaaaacacacaacaaattaataatcatatccgttagatttgcattgaaaatcacatttgtaataaccaaattgaatctaaccttaatacaaatagacagaatatagtgtaataagttcaaattatagagattttagtttcagatgggttgagggttagttacatttatttctacttctcagacaagttaaattcttctgtccttttgctatttacattcgtttgaaacggatacacagtaacacaaatatgcttttaatagtactatatatgtgtgtgttaaaatcccttgtgatggataagaacctaataatgtgtaaaactaagattccctattgaaagataagtgtatgggatgttatttgtctgcctaaataacggccgtgaagcttcaacgacatgattttgtatttctagttttgaatttcagcatattcaagaattaatatatcgttaacgctgatgcatttccttttcatttctgttgtagtgtgttggaacaaagttcccttcatcattgattcattgtgccctgtgtacaatgttgacgtcacatgttgctccaggtaataaacatgcatatccacaccaataagtatttactaaaccggtggaaaaatttattgtgaaattgacggaactagtgagccccacatatgatatctgaaatgtgtaagtcttgtacacccaacaatcaagtgcccttataattattatccaattattgctacacctgctatggcttggcatcaccttttaaacaagcaaattgctcaaattgtgaatgaatgttgtaggtctggtaaccattaccaatgttgataaggccatcagggtaaggaaggtcacgttcactatctaaacgaaccatcaggttagtgtatgtttggtaaaatgatgagttaaactcactataattttttaaagtaataaatagttacttttatattgatctcatcatgatattctactatcaaatcaaacacattttaattcattaggaaatgaataaatacaaagttgaattaaatatgattgatttagtggaatttcttaaacatagaaacctgtttcttagttagaatacacggtatacaatgaccaattaatgatatttatacaaaggatgcaacttttactatgtgttttacgttgtcacagtctcctgctacgaggaggaaaagcatctgacttgatgcatgcatctatgttaattattgtagaatcaagtgtctggaactcacattgatttgggggaaaaagtcaatgtaaatatcagttctgttgcagtgaaacgtactcaagttacttccaggagatgtgacggacttgtattttccaattagtattagtttatcgattttcgaactcatgaaagagccatatctatgcattggcagcatggcattgcatgctgttttaaaagaacctgtattgagaatgttgcatccattgtgtagatgttgcaacttccaacgtacgttgacacttcgttttattttagcctagtgtttttctagtcaattctcatttgtactttaaagagttatacagttcaacgtttttagttttttcaattttattgaatcattttcagacttttaatttttgtttttattattttagcaatgatttattttatgttccctttgatttttttaactttcctatggcctgttaaaaaaaaactccaaatgaagcttaaaaaacaaatataacagttgatactttttgtctcttttgtgtaagtagagggttatattatgtcttactataaaagtgagaaaattcggggtgacaagttaaaactctgcacccacggttcatgtcctataacttgatcaattgatctgactcaagtaaactttattttaatttgatttgattttctttagaatcttttttcttaatttttctatttttattttattttttagtcatatccaaaagttgatatactaggcaaaagcatgtatcaggaataagtttattttaggcaaaagcatgtatcaggaataattttatattagtatatttgagactagaattcagatcctccttcatgaattgaagaacaagacgggtctgttactaatttagacgaagaaccatacaacaattttgtagagcataaagtcctgtctatcaaaatgtgacggacaaataaaatgttaaaaacattacttaacctgttatacccagtgataccttgttagtgcacgttaaaatcaacctaggtaactcctgacatcaaaatttggcaacttcggtttttttgaaaaaatactgttgagataataaaaaataaaaaggaataatttcatgagatgtgcaaggcaagagcaatgagtcaaaggaaatccagaaattggaaatgtacaaatcggccaaaaaaatggtggatcactcaaaccctagagtataatatatcagttacatgtttccaaaccgaattccagcactgttaagaaccaaaggaagcaagcttggtgtgatacatcaatcaccatctttattgtgagtcatatacaaagattgatggtggactagcttccttcctcccctttgatgccaagaagctaattttcttcctttcacctgaattcgcccttgtgatacatgcatcaatacacataaaatgtagcgtccctaggctagatcactataagttgtattattacatacacaaggatgaaactccagaacctgtattataatacaccctagtcttctaatcagcctcaatcatttcggatgagaagagaggctgactttacatggaagaagaattaatatgggttttggtatccttaacaaccaattacaactcaattgcaaccaatcaaacttggctcctatgtacactccctgccacaaaaacaatgttttaaaccggggaccttcaaacacagcataaaagacaacaaaataggtcaaaaaggtagaatgaaccatttctgaacttctacaatattgtccccctttgttccattttctttttcctttcagatgagatagataacattcttcagtctctagtgaacaacccccaaactttgaggtggtgaaatactaaaacatgcattggctgttaaatagggaacttactctcaggagacttctgaacctatttacccacttcagagtgtcctggagtacaaacagctatgcttccatgatcagtttatctggtttagatcagcactgtattttattttcaagatgactggaaaaaccgtgagacttctctatacagctgttcagcttcaaagggttttgaaacatatccatccatgccccactttaggcattcctcgtgtgtagcatgtatcacatctgcagtcatggctaaaatgggtacatgccagtttgtaatattctcaaagtcatccatagatacttctctgttcacactatcttccaactccctaactcgttttgtagcttcaaatctgttggaaaagaattgttatttgcaaaatcgtaacacatgttaattcatgatttagaaataaaaagtagataaacaaattcttcaaataatttttttaattagaattttcaaatgaattgactccacttatgggctcatagctggttccaaaggctggacaaaggaagaggtttgtattagtcccttgcaatcaacataaaacttgttcaaagcccaaacgtggatcattaacgacggattgtgtgccaacgctaggtcattacccgaaaatagccaaagtgtttatcactaaatgcatactttttgcaaatgatataacttaaatcaaggaatcaagggaaaaagttaactataaagtttagttttggagacaaacattagattcagtgggagtaaaacaatatatgcattgccattttagcaagaaataagaaaaaaattgacttggaagtaaaaattggaatgtcatcccacaagtttttaagtttaaatatctagaattaatattataaaattatgggaaattaatgaaaatgccaaacacaagatacaagccaggcaattaaaatggagaaaacattggaggttatttacaactaaaaagtactcaccaagtcatattttatggtagtgaatgttgagtgttgaaagaacatcaagagaaaaaagtgggagtagcaaaaatgagtatgtgaagatggatgtgtgactacacaagaaagtacaagatacagaatgattgtatactaggagatattggtataacacctatcaagaacatgacaaaaaatcgactaagatggcttggacacatgtaaaaaaggtcattaaaggcacaatgacgagagtacattgcatggtttttagccttgtgaaaaggataggagaccaaaaggacattaaaggaaattattgaaagagattttatggtaaataacatcccttagaatttagtttttatcaaagctcaatggcatcatttgatccatgtattcaacctcaatgagacaaagccattgttgttgtagaattgtcaaatgaattatatttatagtattgctgtagcaagttagactccaaacaccttgtgtgcttaatataccctgaggaagccgaaggcatacccagataaggataagtagagttggtattgagttcatggaagactaagaatacaaagtttgtttcacaaatctttgcagtgcaaaaagttttcctttgatgtaaactgttcagtaaaatattttcaattattctgttagatcaataaaagaattaaaaactgttttctatgtttgtagaaattccaaatattactccaaaatgataaattatcagattctgaaagaaagtactccaggtgcatacatacccatccatttctggcatttgaatatccatgaaacaggcatcaaactgatggggtggcttcaaggaagagatggcatcttttccacagctaacacaaaccacatctgctccatactttttcaatgcaccagctgctactgcacggttcacactattgtcgtctacaattagaattttcctgccacgaagaagatggcgaagagacaaactttgaagctctctatgaggagctcccttgttttggacacccatggctcgttgtagtgaggcagcaagcatactcgctctcagaggtttggtgatgacagtaggattatgaacacccaagtttacactagctttaaaagaactactagaattaacaagaatgaacagctttggaggaaccccctggtccattctccttgagttattgacaaagtgagatgacaagactaaatctctatcccaaacctcctgctcaatcaaaaccatattaataactatattcccattgcttatgattgacaaaccttgatttaaatctgaaaccatctcaacatgaatgccaagccgttggatgtgatatctagacacttttgctctaacagatcttgggtcaataattaatgcagtcatcccctcgaattctgaagatgcagactgaggttggttgttgatttgctgaattttgcactcatttgaactgcagtgtccattggtgaatacagcagtaaaagtgaatgtggatccagtcttgggtatgctcacaaatccaatttccccattcatgaggcccaccaaacacttgctaatgcttaggccaatgcctgttcctccatgctttcgggagatggatggacctacctgcatgaatggggtgtagatgagtggctgagattcaagaggaataccttcacctgtatcttcaacagatacaatcaaattgacaagatcattggagggggttgaaaaggaaccaagaggtccctcttgactgaaagccttgaatccttcccagctccggcgactatcagcaacaggggagccactcaaggtattttctgagttggattctttgtcaacctctattgaatggacaacctcctcaacaagatggattgtgacaaaaatatgtcctttgtccgtgaactgccaaacaattacagaatcagttttaataatattttcaagaaatacacatcaattttgctctattagtagtcatgcttggctagaacagtaaaaaactaaaaactacgtaccccattacccagaggctcctcgctatgcgaaggtaaggggaggagggggggatattgtagcagtcttacccttgcatatacaaagagactgtttccggattcgaacccataaccaacaagtcatcaaggcacaactttaccgatgtgccaggatagtaaatagaatatttttttcatgagactatgatgaccgtagcatgcctataaggcaaggatgtaggacaagggaacttctctaagtaacttatatgaaggatatcagactaaataacttgaattatacataatgttcttctctctaccataaacttaccttaatggagttacccatgagattagtaattatttgtcgaaatcttcctggatcacctattagtagttcaggaacctgatctgacacataaactgccaactgcagttcccaaaaaatattatgaaaagccattaactatagttagactatgcacattttgaaaattccatcatgataaaaaggcacagtagacgagagatatattacctctactccttttccttgagacttctcagaaaatagcgacaatacatcatccaaaattgcccgtatgtcaaagagcacagcctcaagctctagcttaccaaattcaatcttagcctgatccaaaacctcatttataagtgacaccagagcttttccactttcctgtgctgtcctgacatattcctgttgggtaacatctagatctgtgtccataagcatatgcaacatccctgaaaatccaatttagagcagggtcatggctgaagaagctcttcttttttgtggaatgtatatagttaaaaattaaaaattggataatcgactaaaccatagacagaagacaactcacctaaaacaccattcattggtgttctgatttcatgggaaacagtagcaagaaactgtggttacaatggataaagcccacatgatcagtatgagttaagcaaaaacaagttcaaaaaataaataaaataaaataaaataaaagttacatacctgggattttgcaacatcagccgcctcagcttgttttttaagttccatctccttacgataatcatcttctacttcggcaattcgattcacagtggcatggaaaatatgtccaacaaggagtgcaataacaaggataccaattgaagtagttattgctacccatggccatggtggcttcttcttgaacctgcattaccatcaagcttaattttcatgaatacttcaagtcttttgacaatttgtacattttaattgtaatatatattaaaataaaaatagttagattcaatggccctaaaaaagtatgacaactccagataaaacaactctagactaggtattgctagcagcaaaaccactaaatcatgaagtattaagtcatatcctccacctatttcaaggtggcacactgttattcttacaaactacactgagcattaaggaggacggagatattagatttcttctgtagcattactcttacctgcagtgcatctcatgcttcctaaaagggtctccaaagttaagagtgctgatgtgaaagaaaacatcccctgattcatttgagccatacatggcaattggatgagtatgatttgtagtatcatacacattaacaattacactttgcttgctagcaagttgctgaagtaatttctccactaatgactcaacatcaaagactccccctagatacctgcccagcaagcagtagtgaagacataaaatttgctactctctttaactgtgttcataatttctttttctttttaccatcagttttattgaatttaaaagtagatttgtaacttccaaaacttctaattatcacagggaagaaccaataattgttcatccttctacattaatagagttcataatattctctccaaaaatttgaatgcatcaattaattatttagtagactagttacttcaaagctttagatgaccaaaagggaataagctaaattatatgaatgataaaaatcataaaaaattaccaaaaaaattaatgaatgacagatgcaaaaaaaatcaaaaatttaggcacacccgtcggttgcttgaatcctttcatttggggttgcatttgatggaagatctctcttgtagacagcaaatgtcaggataacccctagcctatttgttttgagcagcctgaagggtgccgttaaaacccctttgccagattctcttgcacgcagcacattttcacggtcttcctgttgatgaacaagtgaataactgtgacaatcataattccaaataaattgccatagatttcagatatcaaacaagaacaacgtgtctcaattcaggtttgtgatattcacaaaattagagtctattcacgtgtactattctccatcaggagcagtcccatcaggacaagcaagagaaaggaagcacaagggtacaaaaacaacaaaatggtagcatagatagttttttcttcataaatattctcccaaaacaaattaatgaccactaaaagaccagtcaaaaccatactaccaggaataaagagcttagaatggatgaattaaaattatgatcaagacatcaaagtttattgtatagcattttcacaattttcataattaataatatatggctcagactagctccacaaataaaattttgcaagtatcagaaacctacctttccagaaagcacattaacagaaatcacatgtgcaattgtatcttgtgcaaagatgacaggagcatattcttcctgaacgggggatggctccaatgcctctggggcatagtcgtccttatgaactgggttctgctctagagtatccatcctcttgatagtccaaccttgctgcttttcaaattgttccctttcagaatggagcacccttaccgcatacgcaacaccacctgtaagaggcctctcaaaagctgttctttctgtgtactttgcaaaagttttctgcaagttttggaagttagattaatttgtagagatgagactaaagattgaaggatagaagaaagtgggatcttttctatccaacaagaaggtggggaaacaaggaaatcaggtcatgctcaagttcagtaaccttgttagcaaaacatataatactaaaatccgaataaattttccacgagaggggggggaataatgctattagacactaaaattaatgacaatgaaacaactcagaaacctatgtgtacagaaattaaggtaacataaacaaagactaaaagcaaaaggtgaggaattaggtcctgatttgcaataacaaagtaaagactagtacctgatcgatggctgaggggctcttagcatggtgaaaggtggagatcagaatggacatggcttggatatggttcatactgacattaaactgatcctgcagcatcctagccctttcatcacacatgcttgcaagagtttctttcctcttctcagtaccttgcaagctcatgtagcagaagatccacaaagatactatgaaccaacccacgacccatgtcagcaaaatcttcctccataacgctctcttaactttcttagagccaatatactggtagtactgttggtggattttgcaaccctgccctgatatcttctcccaccattttttgtgccacatcttgccagcaccaccaccaccacccatcatcttggtttccataattccactgctaataaaccagttaaggtaaacgacagacacaacccagcaacatagcaccaaaagtagatgccccacttttagaccaaacccaactacatggagcaaactcatccacaacagtaaccaacacaagttaaaaagaaacagttcaaacaggttgtgggtgtcaactctagctgattccaggtaggcttgtgtgtgtgtgagagagagagagagagagacagagacagagacagaggcagagagagagaggagaggagagaaccgctgtcaaatccacagaatccccacaaggctaacacacacctattcactaaaagatttgttttttaggcttgtggttgaagaaaattcaagattttgatgaacaacaccaccaccaacacaaacccaattcctaaaaacaagtaggttgaaggggaaggaaaaataaaaaagacatctttattaaaaataataataagagatgtgaccttgataagatgctgtcttatccaccccaatagcttaaaattcagaaatgcaaaatgaacactgaaactagaggcagataagaaaaattcaaataccctttaaagaataaaagaatcacaagattctgggtttctaattctaaacagaaattgatactccttattatcttgtcagctagcagcagctaccaaccaaggcgcagaacaaaaaggaagggccaaaactaaacctacaaaagattcgattttcactatcactctgcaaagaagctctactagctcgcacttcatggccctagaaccaaacaagaacaacacaagcacgtgagtgtgttcgagagatttttatttttatttcttagaagttagctgcacactgtaaagaaaaggtcacttaaacatggagaatgaagctgacaagagctttaaagcaatgagttgttgttcatcgagctcaggtagtaggagaatttggcaaagcaaagatgataagaataatacggtagcatagcacaaatgtttttaaaatatattattataggccattatctctttccaaactatccactcaaaaaacaatacttgtcaaaagaatatagcaataaacattaatatattttaacaagcttattataaaaaataaatttattattgtatattttgaacacaagtgtaataacaataataacaaaatagagggcagaaaaggcatagtcccactgagcagaaatcacagccttttataacttttgtttgctttgtgttcacatccctatccgtccatgccagtagacaacttcttcacgctaagtcgttaactctgcgtgcgtgtgtttgtttagctgtacttttgtgttggcaaaagtgcccctgcatggaaccaaaatttcaagaagaaggcgtaagcttcttttgctcacaatggcatttgataccccgtagtactttatcaaaattgccatgggagggaggacccagagtcaaaagacgtaggtatatagatagatagaggcaccacgcatgattagaacctctcgaggtgttatttccttcttctttccccctcgaatctgtctactgtttagtttatagttttagtttagttgcacctagccacatatctaactttacgctgaattcagacactatactataagaacatcactgtttaccactctcctctgccaatatttaattgatccaacacaagaatgggaacattgtgagagaatttaggtcatttgtcactttacccattagaacttgttctctctcttttcttttttctcccctttcctaatattgtagtgtcctagttttaactttttgagcattccatatgtaagggtatttattaggcccccaaatatggctttaacgtgtattcagatccaaaaaaaaaaattaaaaaaaggtttgtttattgtaaaaattaaaactaaaaacctgatttatgtaataattgaatgaaataaggcagggaatctccaactacgataatgttattcgatatataaaataaaagtggtcttcatagtaactatttaagaaattgaacaaaaacaaaattttataagtatttggggagcatcaaagaatgcaaagtggtaatttagatggaaagagaaagacaagaatagaagacacttaatcaaagagaaagagagtggccataaaatgattaggtcatcactactcacttctttttttgtgtcctctaaaattaaaagttctttctaagaggatatccagtgtaaactcacaaaatctgtattttgtaccaatcacaactttcttgccctattccaaatgaatgttgtcatataagaaatatttattagaacatttattaagaaattaaaaatattaaaatgtgtaaaattatattgtttattgttttttatttgttcttaatttttaatttttaattttttaactggtttcttgaagccatcgattaaccatactcatcataataatcataaaataaaatttccgcttagtattgtctgtcaggcttgtgttaaagattaaatcattcatataagtactccaatattgttaaaatatcgtgtgaagaaatcattcatataagtactccaatattcatataagtactccaatattgtttaaaatatcgtgtgaagaagggggtggttaataaccagatgattcatggctcgcaagtatctcttggaagttactttttgcaatatccaatcaatgaatttaaaaataaagtaaatagtagtagtattcaaatattaaataatattcgttattatagtttggtcagtttaatcgatgaattaaattattctatttaattaattatagatgcatataaatagttagttcttctatttaatttatatataaacaattttagtacctagcttgtttattgtatcatttagtaaagagcagctcgagttctcatgttttgcgtggtttgatgacttattaaatgcttattgaaataaatattaaaaacaacacatcatcagagctttctcagcatgatgtagacaaaggttcaacttcaaaactaattttatatgttaaatactataccaattccgcgtacaaaaatcaatcaatcgacataaataagctaaacaattaaaaaaaataacttctattatatattttgaatttctcttaaaaagtgagatactgaataaatatactattgtataaaagctacgtaagctttttagtttttaatgaagtttgttctttctcttaaacaaaatttgtgtatgtattttacaagtgaggaaatgtttacacattccgcaatatgttgattatattcaacttgacattattatatagactagtgagtaaaattaggttgtatgatatatttagtaatgaaaataatattcttgtaacttaatctcttttttatatgatttatcattataaacatcaagaactttgaattagatcaatttctcctcaacaaatatatcaatgattcaacctcacctcagcttattttatagcgtctaagaaaatataatagatgtaaaagagatagtagaaactaacaaatatctattaacatgtcatcagtcaaagtgataataaacttgaattctttaaacaattaggtcttcaaattttgtagctgaaaaaaaaaacttgattgagactttaaaggaaatacctcaataaagataattaatcaaattttttgataaatattaatcatcaacaaaattgaaagataatttacactaatatcataatgataaaaaaaactaacaaatatctaatgcactgtcaaagtttataaatgcatttaaaatgttaaaacatgtttatatatagtaaacaataatcacatctttctatttatggatgtcaaaacagatttaactcgatacatcaactacataactcgtctaaaggattggattgaaattttcaatccatcatctttttttatttgttaaagtgaaattacatttaacacttacatttttttatgataatctcttaaatatttatttgatttactaattttataacatttatcttttttaaattacatttgattatgaaatttgtaagttttttaagataaataaaataattaaataatttattttatttgaaaaaataaattggcgagtgaactcaacccacaatccgtcacagatgaattacgttaaaactttcaccctaaaaaaacaacgggttcagcccaatcccaacccttttttagttgagttaacccgttttacacctgtatttccacttctcatagtactcaaaaatgctttttacgttagataaacacataattgaataaaataatgaaaggcggaatttggaccagaattgttattgtttaaatagttcataaatttatataaattattttcttgcctcagatataatattttgtaagaaatagctggtacggaaactataaaacgagtactttgaccaagtgaattgtacatgatcatatacatatagatggattaaaataaaagtacagtccccgataaaattgttatacctcattcgtatgagcagataatgaaggcaaaaaaacttgttataattatgaataatgattgaattataatttttctttatctcaagaaaaaataatgaatgtaaaagtcatttaattacaaattgttatacttcatattcgtaggagtattatgtatatcgaattttttaatttcaatattatttgtcttaaaagttatataatatttttttattaattgattgtataattttttacaattaaaaaaatctgtaaaaaaagaaaaaaaatgaaaataatctctactagttcattcgtggtactgccctcaagtaacatgacataaattgtttaatgtgtgtttggatgagtgttaaaattgattttgaatgaaactaattttaaaattgattttaaaatgacgtgatttatgtttaaatatttttgttattataaaatttagttaggagtaaaatttaatacaaatttttggatctaatcgaaactatttaaattaagttacttcaacttataactttttttggatttttttaacataaaattaaacatgtaaaaagtatatcataaatcaattttgaatttataatcaatttttgtaacatgatattaaacacacattcattgaatgtgcaacgtgacgttgtttttaaacatgggcattcccatttccccaacaggatcttcttttgtgtatattaattaataattaaatatacatacgtgtaccggtgtacatgtcaagtgcaatgggacaggtaaagggattaaaaataccccgtgataaataaacataaattaacaaacatctttaattaaatcttgttattatcaaaataggacctatagatacatctgatggaagtgacttggattcttgaacacgcgatcttgagctcaacttgtgaaaaatatcatcattttaatatctgtttatgtttaagaaattaatctgtcacttatgaaatgagataaatactctaaaaaattcaaagaaaaataatcagaaaattcataagaagacacgcaacctaccatgacgaattatgatccagttggaattatatcgtacaatgacagtaaagaaaatggtaataaaatatcattaatgtaataaaacatgattaaattaattactaacgaagaataataactaaaacatgcataatcaatatcaaataatgtagggtcacctgaaccatgcaggtgttaaattggaggcaatgcccctttaaattctcaagaatagaaatttttttataataataaaataaagtaaaataaaaaaatagtttaaacgtttgtataagagaaaaaaatgaaaaacatagaaaaaataataaaaaaagatgaaaaataagaaaggatgaaaaataagaaaagagtgagtgtgaatatgtatgtttgtaacttttatgaatgcagtgactacatttttacttttgagcaccaattacattctaattttgttaattttttatcttttaaattatacatttttacacttttgttataataatttgtttctttaattttcttcaaaaaaaaaatttcggaagcaccgcctcctaatctccaccactattacccccttatttttttttttctggatccggcctgaacaatatgcgtaatccttgtttgtgcgccacgagaagtggaaggcaatttggcaatgcctcaatgctattaatagcgattggaattaaacaaattctgaagaaactggcgactctaaattatactatacagtattacagtaagttaataatgtttaacatttcatgtatttttgttttttctgtagaatacttgtagtaaataattttttttatcattttaattataagattaacttatcataaatgtaagctaaccatgcatggtttgggcacttttgaggaaaaatagacaccactatttttgcatcaaatagcaaaacttgtccaatcacctctacccacaacaatatcccacttatcaaaagttcaaaacataagcatctccagccaataaccactttctatcgtcaccagttttccttttctattaactttatcaggtgcgtacacaaggcacccatcttggtcaactgaagcaaacaacttcaagcacctatcttgcttgaggccttgagcaaaggaaattaaacacattaaataattgaatagaaaaaaaatattggtctcgaattttttaatcttccaacttacagaacagtctattaacccacgagctaggtaagttagacatgaaccttacaaaaaactatcctattctaatttatttaaatgtacatcaatgtggattgaactaatccatttattcaactaatatataaggatggagtacggcggccactaaaccaaacaaactacatgtcaatcccatgaggacaaagagggttaaaacaattaatattagcatgacaagcaacctaggtataaaattaaagttattttgtttctccctccatctttattttcgtcacatatgtcttgtgcgatgataacttttaatattgtaattaacttattaaccatatcatactaatggtacaaattattgtttggaacagtgtttaaaaaatagtatgacgtgttcacaagtgggactggattagttgaatgttggttttaaacatttttaaaaaggacgtgttgatgtttatgcttccaagacccgcatgatgatgagtagggacatgcagggtgctaatttggaagaggcaaggtgagatcaaattaagtaagaaaccacttcaacgtgctttatctcagaaaggtgccaccaagttttttgaaaaccatatgatatatcacaaaaagtttaaagcatcaacaataaaatattattcacatatctcaaaataaaaatattattcacattctgtataaataaaattatataaacttgtatggtcggttttttttaatttttttttacataaagtcctaaatcttcaaattatcttatttgtaatgtatttttattgaagaaatgtttacgaagccttttcttttaggtaaaatggaaagcaaaatgtttctgcaagccagagaagattcttcgttgcaatcattgttgcctaatgcctctagtaaaagatagtaaataatcaaatattccataaaactaaggggtaaactaagaagaagcatgagtggtatactgtatatgcaatatagttttattattggtacttatttggtttagtttgttttgaaaaagtaattacttattttttacactttttggagagagtttaaagaagaagaaaaataacatgttttaatctaaaccaaatcaaacatgtgcttaatgtgaatgaaagactatagtggtaattgacaagtcagaattaaaacttgttgtgagtgtcaaaagtagaaagcataaacaattaccaagtggtatatagttttattttttggggtccgatgcggggtagttaaataaatcgaacaagttttttgtttttttgcttgtttttagacaatgacctgcttccattaacagaacaacagccgacctgccgggatatttgaagagctccaactttccttcttgaattttttttttctttttaccaccacgtaggtgtgatgaattattttcttaatgattattttttattagagatttttgcctgatatttttggtaaaattattctcataattacatttatttcatttaaaacattcaaacttaaaatcttatttgaaaatcatcaaacacatacatcaactagcttgagattgttccaatttaacctaaagttgaattcaaatcttaaatatgcaattgtcttaaaaactcgaagaacaaattttgtcattcttaatagtcttatccaacttaaacataattatcttccatagaaaatacctataatctaaaaaaataaaatcttatttaaaaaatttgaatcaaattctatttgaaccaacataatattaatacatttcttattaaattactagtataattattttatatcataaattaattagattttttaatataatttttaaaataattattttaaaaacaacaagtttattactagtataatttattattagatgacaaaacaaaatattcttatattataaatgagtgtgtatatttttttccaacatgatgtcgtacttttttaaagttaataacaagcaggcttataaaattgagtacagtctagtaagcccaaaactccaccaaatgtcttaaaaaaatatgggcttgagatatccctctagtaagcactactgtggcctgaattggtttcgtggcatttattctagcctaggaaatccttattcaacgcgactttgcggccttgttcaccaaaatatttcatataagtttttttttttttttttttttggttttagtgtcaccataattaagacattaggttttccaatgatattttaaggtattccaacaagttttaatccgttgaaccaattatgggactcatcaataggacttaatcacacttaaaactcattatccatttccaaaaatgtatgctctcatatcaaattcagatcttttcccatagattgaacatatgttacccactaaattctatggtcattgggtaaggtttctgatttttgataaaggagagatttgatataaaaaaaatataaatgaataaaagagtgagaaaattgtatataccttgatgttcattttgaggccatgtaatatttcatatttgatgcatggatgaattaatgttttaattttactttgttctcatcaagggatcatagtacaaagtattttacaattgatgaagaatagaaagattgataatcatgtgagataggttgccactcaatttggtgactgacatagatcaatttgaacattaggcatttatgatcatagaagattttttactagttaaacaaagaaatcggtgaatggagaggataaaggtcgagttgataaaaggcatctttatgtttgggttgttcgtagaagaatttttttgttttccagtttaaaagatgtaaaacgaaaaaaggcttaatattacttttaaaaaataataaattaatattttagataagtgatgattaaatgggtaacatgtgttttttgttaactgaaatagtaaaacaaataaataatcaagttttcttagttatttgtgtaaaaatattatatagcttacgtaaattaaattgtgtatttacttctatattataaattagtattttactttgtatattatacaggatcattgttcatttttatataattaaaagaaaatatattgaaaatagtacatggttaagaatatcctaattgtctatatcattcaatctttcttatttttaaattaaaatttgatatatattttttaaaatgtaaataatttaaaaattatagtataatttaaattattcattataaatctaaaatataatttatgtatttaaatttcaagctattaatttattataatataataatttatatattaaaaatatttattatacaaaataaacatttatcatttgagtttaatttaaattatcaaatgtactatcaagttaacgtaatcctgaacatacctaaatgatgtgaaaatgttccacaatttttttaaatcaagttatacaacaatggtttgctgatgcttatcatttccctttctgatagtaacaaaacaccgttctaaggtaaattacgtacgtaaacttcttctgttcattttaggtgaatcaattattataatttcgtaaaaaaaatgattaacctaacacgcctaattggagccatctcgaagacttgttcacgcagtgtattaaagctgttcgaataaccttacgccgcgtgtcccagtgacatggcattggccaatcggtaagaagccgtgacgctattatcggggatccactaaattaattgtagttgaacaaaaataggtttgttaaatataaaataaatactaatagtaaaagggagaaacaacgagaaaccgtgtttcactcggatcacgcattcacaaataaggttgaagagggcattgccggaagaagataaataccgtctttcattttccggcgatctctggtttcttccatcaccgttttccggcgatccctattccttaacagaaatggtaattcactcattcattctctaacgccactgcttcgttgactttcacactctcgttttttatctacagtttctctttctccgtcttgtttttgtgttgccgactttggtttttattttttatttttcttatccgtgatatctgatttgtcgtgtttgaaattttcgagaatgacattagaatttgatttggtttagaattggaattcactctattgcttaaatctctttggatttctgcaattagaatcaggatgttgtgaaaattaggtcaaatactcaaattattaattgattcctgataataatgttgttgacgtaggggttttgttgttatagttatttatacgtcgaattaacttctgaattttatggttattagttctgattgtgaaatgtttcgttagcttatggatcggatctggtgccatccaaatccaattgtgccgtccctgtgttatgctatgcaactcttgttgattggttttgtttgtttgatttttgcaatgctaattgaaattgaaatgtggaaattgtggttttgtgtagacgacatcaaggcgccttgcggacaggaaggtggagaagtttgagaagaacatcaccaaaagaggatttgtgccagacacaaccactaaaaagggaaaagactaccctgttggcccagtgctgctcggtttcttcgtctttgttgtcattggatcatgtaagagaaacatttctacatcatcttattcgtttcttttggtggcaaaatgttttctactattttgttttcattttcaattataaaaaacatgtgacttcatgtgattcatgtaacgaatctcatctagtgtagtcagataaggctttgatgttgttgttttaattacaaaaacgccacattgtttttggtttattttctatttttaaaactttgtagaagaaccagtaaaattaacttttttttattgttttttgtgtttaagtgtttgataaacaaacttttgtaaatacaaaacacggtcagatttttttgtaactgaaaaggaaaacataatataaaaacataatcgttttctcaaactaaatgaccgtgatgtttgtctctattcctgtcgtaggtttaaacatttgttgttgactgtatatatttaagcatactcgaaaagtcggatgccaataaatgtttgcaacttatcaactatatcatttcagaagaaaataagcaagcaagcaatcgttacattgcttcttatgtgatatgtcttgtattccataaagtgttggtggttaacaacaacatccatacgcctttatagctaaagcacgtgaatagctaatttatggttgaaacccggaattgaagaggaaatattttctgatggcctctgccaaaaaaaatatgaaaataatttggattgcaatactcgttgaatcaaaatggtggggtcttgcattcataacaaaaatacttttgcttgtttatttatgtgtatgcgggtgtctaaaggattttagtagagctggtagggaagggtatgctttagtggaattcgatccaggttaagcaatccctggaagaaattggtgtcgcttgagctaaaggtgatatatgtgctaaggagtgtgttagattgtatttacctttcttccaccatttgcattttcatagccggtgctttctagttccattgacttatgtgttctcttttcatggacagctctcttccagataatcaggacagcaacgagtggaggcatggcttaaatggagctttattttggattgtgtcatcatctctttcttagcctcctcgtagaaaatgctaatacttctccacatgtactgtacttgtacaagacccggttcctgttcatgttttgatgaacttttaaggatttttaattaaaaatataacttttgtttgtcttgtctttaattctaccaattacttacgttggggtgaatattataatgcatgcaaaaagccaaagctgcccatggtgagaagcgaggactaaagaggttttgaaccacaaagactgttttattaatccccagtgtcatgactcatgacaggagttctccgattgagtgatgaattataatgtggttcaacatttagagtaaaataaataatataaatttaattcaccttagagaagtcaatttgaaagggtttcaactttcaaaagataatgtgaaatgaaaaactccatgattcctttgagagctatccgttgtcctgcagactttgaaacgggagtttccatacagtctgacgcagttatcccaaagcactaaagattatttactttataatacaaacagaatacttgtcatcaactcaatttgaattaaaaaaaaaatgtaaaccacttaaagcattataaactttatgaaatgttgcatcccctaatgctaagttaaagattgagtttttcttttttttttcatcataaaccacttataaactcaaaataaatgtttaactttgctccatataaggtttgtttttttttataagaaatatttttttatttatatgtatcatttttctttattataccctcaaaagatagcttttgtattttcgagccagaacaagttggcaacctgaaacgttgaaagaaatcactcttcttcatcttttatgttttgacaagcgaaacaaagttactgtatcgaaatctctattctgcggtcaaacgcaaaatactgtatagtggttggttcttcactgtctcaaaatagaaacaacaatcataagccgtaaaataataatgaccttcacttgaagggtactacattgagtagttgggaggagccatcaaaattgaaatcccagcttctttcccgtgtgacgctgtaagcaacctgagaaaagccacagtttgcacttagcagacagcagtctcaacagctcaaatgtggaagaacacaccttttgaagtcacaaatatctttagaaacatgatgttatatatatatgtaatgcaggactgcaagagcaacaaggattcagcatgaggcagccaagtgacaccagactgcaaggccaggttgagaacgttttaggttctttatatgcctctcccctgattcacaaggcttcaattctagttggtagagccaaccccagtttggaccttccagcttgaaaacatgaatgatactagctggaattaaaccttcacaactttcatatacagggaaaagtcttgaaagcaagtgatcaaggtgcatgtttcagagcatgaaaaatacatgaagtactacaaacccatatcattttccatctgctttgttaaccagcaatgaacattattattcctacatcagcatcaattaccagcaaattgcaaagaacctcatgttttgagggaaatattctcaggtcattgctgtattatacaagctacatcaggccattgcagtgaggcatggataaaatgcagtaccatgtgctatccattgccgttttcttccatgtggcaccagacaccaaggaaccttcacccattccctacttgctatgttgtaagtaaccaatcgattcatttgtcttgatctcaaggataacatgagcaagcctttgtttcccaagcaagtcattctaacgtgcttcccgtaaaagtccaagcaccagacgtttggcattctgtcaacctccttccacaagaaagtcatcttctgcagctcccatatgcatatacatgtggctgcattctttgtgagcagccccacaagcaatagccggccatcacactcggccagcatgtggtcagtcagatgcaatggcgctgggattatgtactgtgtccaaaccccagtttccatatcatacaaaacaatccctttgggatctgaatgcaagaagtacagggtgctgtcaatagaaacagcgtgtgacctaaaattgagtgacagtggcagcttaatatctgaatccatgttttctggatggctccaagactttgttactgagtcataaatttcataatctccatcacaacccaccaataggatcttgtagccagcaccagttgagttcccatttactgtcattcctatcgcagcacgagacccaaccctaactgattgagctggtaactcctttaaggattgagtcaatgggttacaaacatagaaattttgatgataaatgtcaagaaaacaaactagaccccctgcagaagccactggtaaaactatcaactctgcgggcagtgttgatatagtgggatggtaccacttcttcatagaagggtcatacatggctccagaatttgcatgttcatgagttatagtgtaaaaccatgggtttgcttgtgggacttgagcacaatgcagagaaaaactttgagaagtcagcaaggaattccattgctggcatacagagcggaagcggaaaaatgtggcaatgggaagtcgtgcaatcacaggctcaaatagatcctcaggcaaatttttccaaatttgttgttccatagcttcatccctggaggaccttccagatgattttccacggctcctatctcttcgagacttcttagatggatgctttagaggttccatcatcctggaacttccagactttccagctgccattacaaggccacagaagtcatctacggagtaatcatcaatgtcaaagaaagtcaatctgcgaaaaggatgttcaaatatattcatatacttcatttaatttagtagtactgtagtagaacaaagatgcataaaaagaccagcacaattcattggaaaaaagctcaaaatcagaccataatattaatgcacaaattgatattttattccaaaataagactgaccctactgcatatttcaaggatcaagaggatatacagttatatcatcaaattgaatacatcagtaatccaaggtgctaagttgataagaaagcttttcctttgtataacactaggacaaagacaaaatgcacaaaatccagaccatatgttgtttatccaataatggtagtcacacagttagaacagacacttaaagcataaatgttcaaatatgaatatataagatgagatagtaaaaccaacaatttagggtgtgtttgggagtgaggttttggagggaaaaggaaggatgggcaattttttaaaaaaataaattaagagagttatataaaatgtataaaaataaatcaaagatcaggacgttaaattaatgttaatttgtcattttatttcatttattttcaaaaactatcaaataagtgaatgttttttaagaaatgaaaattttgctttccttacctttccctccaaaacccaactcccaatcatacccttagaagtaagggatttttagtagccagtaaatgaggaaataataaatggccatgtcagactgtaatctttgcaaggattgcttctagccaaatttgacaatttgatgttaagcccattaaagcactgttcctatctcttgtcgtgcaaaagaaaccgtattttatacaaaaggaccaaggtgatccatcccttcttaacaagcattcttcagaaagcttacgatcaagtattatcaacattttacaccgtgattaagatacaggcatgcacaccctgacagctttgagagtggacctagtgatgataacttgcctgtgttgttaaagcaaagaaattgcctctaacctcaatagaaaatggttgtattgttcttacttgcgtgtttctcaacatgtttctaaatcatcatatttttttaatctgtgtctgaatcaaatccacctcttttctttttttatgccaaaatttgatgtaaacctactcaaactaccctgagaacaatgagacttcccaagttcagaacacaagcaacaatgtgcaaaaatcatcaaattgtaccagttaactttctctatgacaaaaagaacaaaatcaagcacatgggaaaccaagggccaagtcatcttcgtaagtttcacaatttatgctctaattacagataatgaatcatgtaacaacacacacacacaaaacaagacaaccaacagaaaatctaacatctaggttatgttttcaggaagcatgttgttaatgattgcacatttcagagcagaaacaaactaactaaccaaccaaccaaccaactggttaacaaaaataggatcaaccttgttatggtttatgaacaaatgaggttcacaaaaacataaaagaaaacaaaaagtaaagtgtagagagaaaaacagcatcctgagtccaaacaaaacaggtggagaataaaaaacatttttttaggaaaaaaaatgcattggaagtaaatctaggagaaaggaggggacctggggatttgatgagagactggagggtgaagggtaaaaggaggagaaagagagtgagagaaatggtgaaggtgagtgatgagcatggcaagcccttcttcttcttccatgcccccaacccaactcaattctcctttgtgtaaaaacctctctctctctctctctccttgtttacccgctcttcattttccacgttgcctaccacacaggacggacttttactcacccacccgtgcgccactttttttctttttagcattgatatgaaatatttatcaagtttataaaaaatctgaataattgttcattttaatgaaatcttctccttctaattactttttttttaatttacagctcaaatctgcttaaaaatattaaatataataacaattggactaacaatttattttccttgcgacactttaactacattttggttacaaattgcatattgttaaaaagttaaaaagatttttttcctttcaccatttattcttttgaaaggactttttttcatttataagtataaagtataagtacaaatctcttatgtattgtttaatttatctatgttatttaatctgagatttttatttatttattttaacacttgacattcttaaaaaatgcacactattttttttatgcacaggcagataaggtcgaggatcaagtacacactattttttagagtttaattgttatcaatataaattttcttcttttatcatgtgacttttaaaataattagaatgaaatttaaactttttttaaaaaaggtgatattttataattagttgatggtgtaaagaatttttactttcttgaaatatcaaataaattattttttaacctcttcattaaaacgtccctagaccataaaaaaatattcgcattaattactgcttaccaacagccattaattttacattgacattgcaaaagccaaaaggggaggagtgagaagtgtgagatatgataatgcaatgtgttatgttatgtgtccttgagagtttttgtggtacaaagcgtggtgcatccccagtggctcctttcttgcacgcacacgggatgattagtctgaatgcgaatgatgattttgttaggtttacggaaaaggccctccaaagctaatcgatgccattttccactcatttctcataagtggcatgcaatgagtgacattgtggcaaggagttgttgtaattatggtttcccagctttcactcgtttctttaataactattcatcccactttaattttggaaaaataattgattttcagatgataccaaaatcctactattagtgtgatctttttgatttcttggttaaaaaacctctatagaaggagaagatggacttacggttagagaattttaaatgggggtaataaacctgtgttttatgttgtgaaaaatatgatgaacacctttgttgtttgcttatatttgacactaattttactgtagaattaaaaaaatgtaacaaaaatgaattgaattttttgctcagcccatcatttttaatgaactgagttacatgtatttacttgaaattcgcctagcatgacatcattgacatgtggattgtgacatgttagggtagaggtaggacgcacaaggtaggttgacacgttaatatcaagtagtttttttaatattttttatttatttacgaagttttccaaaagtttcaatagaaacctaattctctttatttttcattattttttactattcgtaagtattattctaattttaagtccgttgatatcatctgagttatcaaatattatatattttggtgtttgatgatgttgttacaattctgtctttattaaaatgtactatgatggattggatagaaaaaaagtgttataaaatgatctagttcttctctagatcatattgatggattccacaaagcttatgtgtatgtctcttttctaatggactcctccgataactcaaatgatatcaacggacttaaaattggaataataattatgaatagtaaaaaaataaaaagtgttataaaatgatctagttcttctctatatcatattgatggattccacaaagcctgtgtgtatgtcttcctcctaatggactcctccaataaatgaagaggatatttttctcttataaaacatcttctccacttggattcaatcatggatactataaaatataaatcccaattatcggccaaggaaaagggaaagttaatgtcaaaattgtggtaatagatgtaatgagagactgtttatgcggaaaaatataattataggggagctttatatgtaatagttatacaacatttaatctcgacttctaagtaatataaaacttttgaaatattgaaagatgttcccccaattgatactgagggcaaaagtggcttaaactttcggttcaacgctagtgtcgcgacctcaagttcgttgatgttattaggagttaatatatttgagttattatttattttggtgctcaatagttcggtcgtgattttgttcttattagaaggcgtcttaatgggattaagcaaaaatagtgtttataaattatccttaatctcatgagcgaagattaaaaattcaatgaccaatatcaatcatggattattttcatttgtaaatataatatcaacttattaagttatttcctaaaaaatacagttatgacatcaatacattcatctcaagaaaaaatcatatcaaaccaaagtagtcaaatactacaaaaaaactaaagcttctatctggatttttcctaaggagaggaaaaggaaagaagacatttaagtctaagggaggagttttgttctattccaccaatcctttaacacaattatggttccttctcaagcaaatttcatatcaaactaaagtaatcaaatacaaaaaagccaaagctttcattaccttgttaggtttcaacgttgaattttcctaaggatacagaaggagaggaagatatttgagttcaagggaagaatgagaattataaggttgacttggtggttgaagagagaaagaaaatgaaaaggtcatgaatttgaatagttttattaacaaaaattaataattaacatttgttataaaaaaaaatcaagaaaaaagattttcttctgtcccaccaatcctttaacgcatatgcatgaaatctcttcccaaacaaaaccaattagatttttgaacaatgaattttccacaaggatggataatgaaatgataagagtagaaaattaagagaatcttctttaaagaaaacgataaagattgaaaagaaaataaaataatttttttttgtgatgtgatgaaggatattaagaggatttaattttttttaaagatgattacaaaatataatgtccaacataaaataacccataacatacaaacaacaaaaatacacatatgcttacattatatttttcaaaagataagattattttcatgttaattagtttcaatttaaatttaattttcaaagtttattttttcatgttaactatattattttttaaagattttatttttttttaaatattttattttttttatcttaatcacctgtacctttaaattgaattaaaaatttctaatagaattatgaatgaataaataatttatatatttaaaaatatatcttatcataaattttaattatatattaaaatatttatttattattaattttaagttgaaatacatttttaattatttttaaattttatccttgtaaattatttttattttcaattttgtttgttttatattttattcttataaaactttaaataacatttcattatttaaagtattttaagataaaaaatataatttacagaaataaaattattttaaaaaagttaaaaatattaaattataagggcaaaaaaaccaaaaaatacaaaaaaaaaaaattacaaaaatgggacagttttgaaactatttatcaatatggggcaactggtcatgcccagttctgggcgtgacctatttctgccacgtgtcatgcacaggtgaatcgatgcgtatataaacttcggacggtcataacttttgactagaatgtccgattgagacgaaaccggtggccacgcgcttgaaattgagaggagaaggcctgggcaagtcttggccaaaaatttttctcaaaagaggcctctaagtgcctcaaaattacgatttaatatttgaaccttcaaaaaatttcttgttttctaattttttattcatttaattagttaattgcatgctattttttaattgtctaattacgtctcttaatttcgagtattttgacatgaaatatgtatccatcggacattgctacgaaaaattatgattgttcaaagttatatgcatcgtcaattttacagcataattttgttcaattttttaaattagttttgtgatcagtgaggacattagtcttattgcttgtggtcgcaaatttttcccaaaagagacctttaagtgcctcaaagttgcgattaaatcttcgaaatcccaaaaaaattattgttttctaattttttaattattttgtcagttaattggctaatattttttatttttctagttacttctattaatttcgagcattttgacatattgtacacctcgatcggacatttctatcaaaagttgtaacttttttcgatattctaaatttttatatggttttgtttaatatattttggattttttatcccagagtacattcatttctaactttttcgcactcatttcacgttttaccacttgttccactcatcccaaagtgcactcaccacacaataatcggaattgtaacaccccattaattccaatgtgcacagcggtgaaatattgcagaactctaaaaataggagtggaactgcgtgagacaaagttaatcaaattgaaatgtaaagaattgcattgcgcttacccagagagataaagatggtgaccaacttactcgcacaattgatcattcaccatgcaagatggacgatcctttctaattccctttctcggttgaatgtatatgttttgactacactaattttacacaattgagtcaccgattgatagaaagcctgagtttcggtgtagtttcaataacgagttagttgactaggtgcttttgactggaacaaaaagagaattatcaaattatgagaggatgaaagagatgatgagagggatgataataatgtgtttaatgggggtagtctcaatataaaaaatgagaaatatcaacatataatattccatttaaaatgctttctatattaaaaaaatgtttaaaaaaatttataaaaaatgaggaagtatcaaaaaataaaaatttttaatttttgcaaattccgaaagaaaattgaaaaattttattaaataaaaaatattatactaaacattagttatatatatccagaatatattacataaaatcatataaaattataaaaatatattaaataaaaaatattattaaaagtaaaacagatcatatctatcatgaagatcaatctaaaaatactttcatattaaataaaaataaaaataaataatattaaataaaaaataaaaaaccaaatattccatcgttaatttggtcactaacagtttttgcgacaaaattttggtcgcaaacaaaaaaatagaaaaacaaaaaattttgtcactaaatcgatcgctaaccgatttagcgacgaatttagtcacgctgagcgtgaccccccttggtcacgcccaaattaaggcgggaccagtcatgcccaattttagacgcgacccactgtcccagattggtaaatagtttaaaaacggccttaaattaataattttttatttaaaatgtattatttaggttcttttgtcaattataagaactaaaaaatatttacaccttaatcttttaaaaataaacattacaataatagttaaaaaaaaccttatttgaaacactagttaagccgtaccacgacatcgaccaacattaacccctaaaaccccattcggtggtggctccacccagacagcgtgcgtctctgcgactaatagctacagcaggtatgtcttttgcgccaatggttactcggttcaaaaccagtacggttcagaaccggttatgaaagaattccaggttgaaccgttttttaaaatactcctgctcaaaacggtttcagaaccagtttttgaaagcggttagggtttcgcgctgcacgaacccatgctagtgcttagggttcgaggtttgtgttttgaaggaggttagttagttgtggagagtgtgtgcgggaagttggggatattcatagagagagggtgtgggtttcttctgctttggttgcgtgttggagttggactgagaaaagtaaggtcaaattataaaatttgtgttggcatagcatagcactacaccaaccagtggttgtgtgtgaggtgtgataaatacaagtaaagctgctccttatgggctagcttcctagcctgttctttattttgatctgatttatgggctaagcccaaatttttctacattgctctagccgtgtgtcattggcataaacaaactatgggattctatttgtaaccttttctcttttactcttcacatgtttgcccctttttgcactagaaatatatttttttaaatgaatttttgggatgtatcatagaaaatttgtgatacatgtgttaaggaaactaatttttctaatgtagttaattttatataaaaataacttcggatgagtttaaacaaaggatagaagaattagcttccttggttattcaaaaaacccctcaaacttctacatctcaagaagctcattctagataaaaataactatattacaaaaattagtttcataacatatacaaaatgattttattacagaaactagtttttataatatattaacaataattacatcatagagactatattttgtaatatagttcttctttatatattacaaaaaaaattgtaagatttgtgaaggaaaaaaaagacaattgtgctggtgacatagaagggttgtgaaggaaagaaaaggagatgaaagaggaaatattgagagagagagaaaatggaaagggagaggtaaggaggtgtttcctgtgagaagggaaggggtgctagtgagagggaaagggggaagggtattttggaaatattataaaaagatgtgtagaaaagaaagacctacgaattatgagttgatcatggttcggcctaaatcggattgtgttttgaccaaaaacaatagtttatccgtatttgcaaacaaaaaatatattgatctgtttattgaagtaaagaaaacaagaggctatatattttttcggggtgagaaacaaaatgtattccctaaattttgttagttggagatatttctggatagtacagaagctgttagggttgcattgttgctcttgatgatataagggggaaattatcgagggagttgctatttctagtcccccatattactagtatgctctccttagtatcccataaaaaaatagttttaatccttattttttttgtagaccaacattacaccttatgaaatatgatttggactcgtcatgctggtttttaaaaatttgacctaagaagttgttatgcgattcctttataatccattgacttattcggcttccctcagttttcccaactcgaagatgactcgcggcataaaacaccgtcagaaagccaagagcaagaagaaggttcaatctcgtacccttttcaatgttttgtattataataacctcacttcattatggttttttgttggcacctctcatttttttatataaaattttgtttaaatttgtgggcaaaaaaaaattcagggctcgaagaaagagggtgggtcttcttcatctttggcgccagaaatcccagtgaaggtgtggcaaccgggtgtggataagttggaggaaggtgaagagcttcagtgtgatccttctgcttacaattctcttcatgcctttcacattggatggccatgtttgaggtattttcattcatggccttttttgttcttttcatttgttttctgtttttctatttggctccacagaaagaggaaagagagcaaaactttgagcttttttgataaacaaacctgtttgttttagctggtattgttattattaataatgataggatcatatgttgttatgtgaagttcctttggcattggcattgcaattcagtggagaatcttagccacctttattgggaacttgctttatttctgcttagtatcagtaatcttcaagttattataaatacattttggggcttttgacagctttgatattttacgtgactctttgggcttggttcgaaaagaatttccccacacagtatatttcgtggcagggactcaggtcagtgttgtttcatatatatatatatatatatatatatatatatatttgtttgaggatgtttcattaatcaaatcggaggtggttagtggtttcatgagaaaaatggtaacgaatattaggctttgtagacaaatattcactagagaaagttccctttaaagggattttgagtcttgaatataaatttctttcctttttttatttattataactggtaattatctcaagaaaagttaacacccagcagctcatagttatgttgtccacttgctttgcttcctttgtttttctccattctacttcttttgatcaacaaagtcatgttatggcaatgcatgtgcatgtgccacaggcagagaaaccttcttggaattctattggaatttttaaagtatcaaatattactggaaagagacgtgagccggtgcctaaacttggaactgatgacactgaaatggatggtgaggatagtgacagtgacgatgatagtgaggatgaagaagaaggtggtgctcagggtcccagtttgcaggcaacttcctcttcatttaagtttttattgtttcatttcttgactgcttcaaatttgatgttactaacattttgattctttttgcatctacagttgcggaaggttgctcaccaaggatgtgtcaaccgtatacgctctatgccacaaaatccccatatatgtgcagcttgggccgatactggtcatgtacaggtcagacttttcaaccatttgatttagttttctaatttgacaaaaaagacaaaaatctatttatttttactaggattgggagattatgattttatataacaaaaaaagacaaaaatctatttattttttactgtatgtgactggaggttagcggatgacagaatctgtaagatcaaagtgtccataaaatggggtggaaaatatttaaatacatgattgtggtggcaagcttttactgtattggttattattatgctcttacacattactaaaaaaaactatgtacctcattgtctagaggctcctcgctatgcgaaggtaagggggaggaatattgtacgcagccttacccttgcatatacaaagagcctgtttctgaattcgaactcatgaccaacaagtcaccaaggcacaactctacagctgtgccaggactcttacacattgcagactttaaatttgaaacaaatggattcgtaaaactttggcttgacttcataaattattattatttttttttcaaataaggttaagtttgtttagtgtttgttgaataaattaattaggactgcaggcctctttctttggctctgtaacagtttgggcgacaatacttcagataaacttcaaatgagtaactattaggattagatatgataaattgtagctcaggtatagtttactcttagatacagatgtggttacctggttctaagcattgtaacatttaaatttctttaaattcttaaataattagcagcagttaaggttaaacaatgtggagtgtatttttctccatcttctatttcaatcaaagttaaatactgttttaagccatgccttctatttagtatacactatacagtctgatacttgagaatcaatttgtaggtctgggacctcaactctcacctaaatgctctagctgagactgaaacagaaggtgtccaaggagttgctgcaatttttaatcaggacccattgtataaatttaaacacaaagatgaaggttatgctatagactggagtcctcttgttactggaaggcttgcatctggtaatctttagttatatttttttcagtttagctatgtcttccccctgagggcgagccttggcatagcggtaaagttgtgccttggtgacctgttgtaatgagttcgaatccgaaaacagcttctttgtatatgcaagggtaaggctgcgtataatattcctcccccttaccttcgcatagcgaggagcctctaggtattggggtacatagttttttattcttagctatgtcttcccctggcatgtctccatacttagttatcacagatatataaagcttgacaatgatcttcatttttgaaggggattgcaataattgcatttatctgtgggagcctacatctgctggaacgtggaatgttgataatgctccatttgctggacataccgctagtgttgaagatctgcaagtatgtttactcatatgcaaagcagtagttgctcttcttgtagtttcagtatagtatattttgttccttacactctaattttactagtttatccttatttataaatctaattagatttttaatgttcaattaatccctgcagtggagccctatagaacctgacgtttttgcttcttgttctgtggatggaaacattgcaatatgggatacccgtttggggaagtcaccggctgcatcttttaaggcacataatgctgatgtgaatgtaatgtcatggaacaggtattaatacattaattctatggtgttccatcaactgctattatagatctcttcatcactttgttctatattatactgagcaggttggctagttgtatgttggcctcagggagtgatgatgggactatttctattcgtgatctcagactgctcaaggtataagttgacttcgtaaagaataaaacaatagtaaacatgcttcatttataacagggaggttactgtgtgcatgtgatgttctgtcaatggtgtttcaaattatgtcatatccagcttcaatttttttatcattcttttttcctgttgtcccagtaggcatattacattgaatttgtaaagctgtctgatgactttcttttcccttgtttcattatcacatctttcttttaccattcatgtgcaaatcaagtgcctataaatccatgtatgaaggaacttctagatgcattatggtgaagaactattatagtattattgcattattatgatttagaaagtaacttcacattgtctattttttcctgcttattaatttacttgttattaaagctgatatgacaagtgggcaggaaggagattctgtggtagcgcatttcgaatatcacaagcactcaatcacatccattgagtggagtcctcatgaagcctcttcattggcagtttcttcatctgataatcagcttacgtaagtaaagggttttgatagcattatctgctgaattattttttgcttttatactgttaagagagatttagtggtaaaaggtcgatctttacattactacatgacactgaactttatggcatcttctgatccaaatagtgaaaaaggattcacatgagcgtaaaggactgctgttattttataattaactctttgcatcgctagttgtagccttgtcgggatttttttttttttggctaacccttccccagaatctacatgcgcatgagcttcatagcaccactgctccttttttatttgttatttatgtatttgagatttgacaagttttgtacctttctccacagtatatgggacctttctttagaaaaggatgaggaagaggaggctgaatttaaagctaaaaccaaagaacaagttaatgctcctgaagatttgcctccccaactattgtttattcaccaggtatatccaaatgctcctccgctctatttatctgaatgttagaataagactccctgattaattgtgttcattcgtttattttgccttgaattaaaacagggacaaaaagacctgaaggaactacattggcacgcgcagattcctggaatgattgtttctactgctgcagatggattcaacatccttatgccttcaaatattcagagcacactgccatcagatggtgctgtataaaaggcacccccgctaagttttcaagcaaaccatttcgtgaatctacttgaatgttgaagaaagtttcctattgtaacttttttcttttttttctttttggttccttttgttttcttcgtggtccgtgcttcaagttttgtggattttctggttagcttggtattcttcgcttgattttgaatgcaattttcgtgtatgccgtctaaactaagtcatgtagaccaaaagtaatgggaacaagctggctagtttagccaaaaatttatttatgtgctcgtcataatttaattatttgggttaagttgttaactagcgtgtttaccattcattggattttaaattttaatgtcaacttgcctaattcatattgtataaaatcctggtttgttgaatgttaacattgattagggcacattgttaatttcgtcaagttcaaataaagtcactgttcaccaatattgtggggcatattgttattaaggtcaaaagcgataatatattgggtcttgtgtatgggttcacataatgagtttagtctcaatatctcgtacggtaatatttgcagattattacactaaggtctgtttggtggtagaataaattatttactttttttaattagtaaattatagttattagtatttcctattatttaggggtggttcatatcaaatcgattcaaaataaaaataaaaaattgaaccaaattgattctttttgaatttgattgaatagttttttcctcaggctaatcaatttgatttggattgttatttatatttttttaaatcaaatcaaatcgcaacaatttaattattatttatattactatttgttatgtatatcattttcttttttagatgatctttgtttgatttaaaatggatgaaaatttgatagatttttattatagaagattttatatattaataagtttcataaatttttatcagtaattttttaatgtagtttaatttaaaagatgaaaataacgtatataaattttaatgaaataatattttagtaaaaaatcaaattgaaccaaattgtaaaatattggtttggtttaatttgaattttattttaaatgaaaactaaatcaaaattataattttggtttgggtgactttttttatgaacaatccatccatacggaccgaggacacccctattattatctatcctattggtgtgttagtataatgctgaggggagctgaattaggaaataagattggataattttttgggataattatgctatttaatatgaagtatctattaggattagtctatgtaaagagacataattgatcacttttaaaaagtggagtttacgttttttattttatacagaatatttaattttttaataacttaaaaaaatgcgctagagtaaagattctttacattatcatttaattgaatattgtaatgtattgaaagttattgactttcataataattatttttaacaagattatactgaaataatttttcatgacagtataaatttttattatttaaaatatttttgagacttataaatgttataaataaagtttgtttgacattataattaatttgatttgaaatcaatactttaataaacttctttattggtggaataataaaacttgttaatttagttattttataattttgtaactgaaaatttttaattgatagaaataattttttatatctccttaaaatatattattttaatataatacacattttcatagaaaaaatattaattgcatttaaaataattatttttcataaaattacttttataaaaaaaattaaaatataattgtaaatttatgtaaatgtttgtatgagatattaataaataaaatattattctaatatactccatatgttagaagaagaaaacctaacatcaaaagtctattccacgtagcaattaatattttacaaatgctgtagtctattattctaatatacttttaatgttagaaaaaataaaatctatcaccaaaagttcatcccatgatcccacaaaacaatagttactaaatgacaaagcttatccagtacgcgttaaatagtgcaggagttactcctatctgtctttaatagctggatggtgggaataattacatggaggagtagatatagatagataatagtaaatatattcatatagtaaaatagataagtattagatattagatagacaacataatagaaatttactatagatataaaaactaacgagtaagtgaccgacgataagcataacataaggcagttcgaaatgtacaatctaaaacaaattaaaacatacttttgaagtctatttggatataaaattagaaatatttttaatagtttttctattgaaatttttttatatttttaagtagaaaagctctgtacttagtaacttttatccaaacaaaatcttaataatgaaccactacttttttaataatctatcagatatatagtctagcatgtggaaaagaagtccatacaaattaagataattattaattaataaagacaacatgaagagggtcgaaatattctagacaacataacaacatgttgcagacgcaaatcaattaattctatatatgctgcaacctgcaaactaattaaaatccatccatccatcactagcaaaacaactaccacggctactttcatttaaagtggtgcctatctgttactgcatgagtcattaattgaacgcacccatcacgaataaatgttgacagaaccaattggaatcacgacgaggagaatggcccaaacaacagctattaggtctgcaacgagaacaggtctaagcatgtttccattagagcccttgtggatgtcgtctgagactggtggtgttgttcccactgttgaagctgaattggttttcaacgaagcatttctgaagatagcagcgtcaggggagtttggagatagacccagaagctctgccatcaaatcaaatgtgtcccattttcattatttgaagataaaaacttaatcataagttcttttattttaacaataaaaaaattacaacataatgtttggaaaaattaaattttatattttttagaaaagtagacatgtgtattttctttctggtgaatgtacaattgatttctaaatttatttataatatttcttccggttagtcaatcacattaatgtaaaaatagtaattaataatatttttaggattttttaatatttgtttttaagtcaaactcaaacttcatcttttaagtgtcttttttcgtttgaaggtcagagtcggagatcaattactatatatgtaatctgaactaccgtgataatggtttctatcgatttctattgatatgcaattaagtttttcaatttataaaaataacaaaattcaaatacataatatcagctggtgaaataggttaattgatgaaatcatggttacttggatcatacaataaattctccaataaagttggacatgtgctaattattaagtgactcggttctttttatgatcagtaatttagatttggagtgtgagctagtatttggcaagtgaatgaagtactcattaataaggatatggttagttaaaaaaaatttaaaaaatatttattgtaaaaattataagactgtaaaaacaattatgaataaaaataaaaaacattttctttttaagttttttaaccaatattctaaggttagtgattaacatttttggattaataaagatatattattagctggtaattattaaagttaaagaggagtagtgagttatggtgggatgaacatactaggacagttggtggtgctggcattcttcaagttacaagcagaaggcagctgaagcagcctaccctcttgtatgcccatgtttttcacctgcggactacccttgtgagtctgttggatcgcgaagcacaggcactccgggtcgctcttctttatctccgacgtcgcctcgcagcagtccttggtcggaaccgccgcctgccccgtcgcgaagtttaggcacggcagcactttctgaaccagcaggttgcacttcgccgccaaatccgctccctccgactccccgacagccaacagaaagaggcacagccacactgagcctactactactctcattttctgctgcttcaacttcattggttagtttagttttgcttccttgggtttgagtgtttattatgatcgatctcaagtactgtagtactacgtctctctctataatgaatgctggcacagttgtcgttctgtgaagtgggaaaggtgggtggtcttctcctctccatttaatgttcaggatcatttatttgtaaaagctactatacttctacatggtaatggtagtttacctaaatggatatttgagtttatatactagtagcttcttaaatatactacgcataatagaacgttggacactttaaatgtttgaactatatactatcagtgaagatattacttaggttaggcccggccctgctggctgctgccctagtttggagcccactagaaaaagggccgaacatttaaaagtttatactgtatataattatgtaatattcattacttaatatattttatatcatgtattagaaaattgccctattgtttttttttttttttctgatgccttactttataaattcacagtagctatacatgtgaattttcagctaattgtaagttgtaacgtatcaacacgtaatgaacgcagaattatagacttgcatggttactcttttaacaagataagaactacaaactgaaacttaaattataaaggaattaactaaaactaagttggtattgtatttataataaaacacacacatatataaaacgtatcacataagaatagtaaaatgagaatgattaatctcaattattagattaaagtaaaagattaagattaaaatattttaaattctaattaaaatttcatttaatcattaattctttataagatttatcaaatagaaaatcaaatatttaaagatttaatctatgacatcctaaaatatctcaaatcgattatcaccatgacaaccaccaccgtcataacaatttccaccataactgtcatgatcgtcaccacaattaccatcaccgtcatgatcattttcaccataactataatggttgccaccgcaaccaccaccatgatcgttaactatcgtcaccacggtggtgaaagtcatgttgatgatgatgacggtggttatgataacgatcataatggaagccatgatgacaatgatgatagtttatcatatatattaaattattcttttaaaattaatatattaagtttatccaacatctagaaaattcataataatttatcatatataacaaaaattaaaattaaataaccattacaataaatattctgaattgaaagcttgtatagaaatacgagaatttctgactcattttaaacctgggataatttccatttttgaagacattaatgtcatattttaattgtatttattacttgtttaaatatattaattaatgtttgattaagttagttaagttttttttggtgaaggttaattcacgttacatattatgtcaattttgttacaccagaaatagtctgacaaattttaaccattaaaacggctctcttaacttccagcttcttttttcccacaccaatgagtctattttctacatctctttctgggtttctttaagctttttgcttgccaattctaatttcccaattttgtagtctagaagatcctgtaaaatcttggatgatttacgcgtaacatggatatatctttaagagcaatgtgaccatcaacatctcaagttggtgctcattttaacatgttgttgcctttagtctctgaaacttgtgtcacgtattttttagtaaatttaacaaagacatattaggggttcaattaatgtgataaatgacattttttttattgagtattcagtgtaataagtggaatataaattcatagatgattagtatttttattaaattcaggaattaaaatgaaaataaataccaaattcgagggttagacatggattttttttaaaactacaattattcgatttcttttcctcagaaaaatcaaatcacaaccaattggaattggagctgatgcgagacacatctacattatttttggtcaagcaatggcccggccagcacatgcatctaaatatatcatggatagacattaaggatgaataggtaaaataataccaatattctaccggatataataataccaacacaagtaatatctaaatgaatgatgattgatgaacatgcattagagattaattaataggcacaataataatattctacgggatataatagtaccaacataagtaatatctaagagcatgatcacacaatcacaaacataattatttaattggatataagtttatttaatagttaaacatagagatacaaatgattactaacaacaatcaacatataataacagtttatgtcttttaatcaaatggtttaaaattagatatacgataaaaatttggacatccagcaaacaatctcaaattctcaatcacgtggctattaatccaatgattaagatttttataatgtttacctatgacattttattgcaaaagcaaaattagttcgccaaattttatttatatgttgtgtctttgtacctaaagaagtgcaacgcacatgacaaaaaaatttaatgacaaaatttcataataaaaataccttaaactaataaatttttaaaataatatgcaaaattatagtactctaatagtaaaaattagtgtattaatagtatccactatcaaacgagtgatcaaggtgatgtatgcaaagtcattcttgtgggctctttccgcgagttctgtccttgttttgaaaacacgggccgaacaatagatacgatcataacgagaagtcgtaaaaggctgttatctggactctgtaatggcataatggactaatggccttccaggaacttgttattatcctcacacttcgtaatttttatatttatattaattatgaattaattgtttcatgcgctggatgataaataattattttatagatataatatgtattttgctctaaatttaaaataaaaaaccaaattaaatttgtactgaaggactaaggagatgtacactttgcacatcttacgtctgcacctaaaataattaactaaattatttaatacataaggtgaatttggcatacactaccttaaaattatttaatattttattttccacacatatcttattttacaaggtaatcatgctaaaaacataatcaaatattaaatattttttatcttaatcctctaattcaataaagaaaaaatattttgtctaatccgaatttgattaaaaaataaataaaatatagtaaaaatttatttttaacaaaaattaaatacaaatgatttaacctaactttagtatattaatcatttatgtttaattaattgattatcaaacattaatatatatatatatataaacatgaattcaaatcttagttgatgaagtaagaaattagttccttttccaattttcatcggctatcaattaacacgaaattaacttaaattgctacgagaataaagaagaaaagtttgtgttaataacaatttaagaagcactaacttgaaaactttgcactaaaaatgtaacatttattagcattctatcgattaatttctgttagagtataactgttacgacatagtttccaacattggagttaatttttattcattaatggaataaaattttatattatcaactaattaaaaattattttaaaatataatttataaaaaaaatgttacaaaaataaccatcttactagttataacaattttatgcttttacaaagaatctaattattgtgagtttacgttaataagagaatgtattacattaataatataatataaaaattatactgattgaatactaataaaactattaattattctgattatctaaccacaaatttgtaccgtcggaataaaaagccaccgatcgtgaatacgtcctattcgaagtgaagggaatgtcgtaaagatttatcacaaatttaattcattcttatcctcaagtctgaggcaaaatcattatcaccactctgataatccaaagtggacaaaaagctagatccacagccacatattacaccgaaggatcctattcaactagcatctcttctctactgtgccattccacaaatccgaatcaattgatgaaaattgataaccacgtttttgggtgtaaaacgagaaaaaagaaaaaaaggtaaagatgaagtagaatataaatatgattgttgtcaattgttagcatccctctgacttcttcttacgaacttagcaacacaaattattgcttcacttttactcaaacgactaggaaaaaactactgtcttttttctattttatttattcataatttttttctaccaattttaattatatacttaaaatgaatgattaatatttaatagcctatttgaatttattacttagctgagttggtaatgtctttcataagctaacgaagtaatatttattacttttatccctcttcaatattccccacatatcaagggggttatcatgtgtatatgttggtatgaaattttgaacagtacaagtgagttattctccgatggaatttaatgacttttctaagtcaactatctaaaggaaaaagaaattaatctcttatttacatttgggaaatgatggttagtaactagtatttataattaatttccctcaaagcaattttagtacaatcattcttaagattgcttattttttaaaataataatattgaaagcctttttaatatgttttaactaaatattagttagttgttctatttctcgtggtccctattccttcaagtaaattatatataatgcatgaaattctatttcttaacagatttatacgtaaataacgtctttacagctgcttatctgaaatgaaagaagaaaaaaaaaagtaaatttgataacaaatccagcattcgcataaactagatttgaactgtcatccacaaattgcttcaagatgttaagcaccgaccagcggggatctagtttggtggaaacaaatccttttaaggaagcaaatggtggttagcaatgatagacatctattgcaatcagtaagtgtttgaggtctaccatatgctatatcattaatggacaggatttagctagcattccttataaagtgaccatgattttgacttctctctgttgccttgtgatgatactttttcatgcaagcatgtggaagcaattattgttgctattatagtcgaaaagaaattatgttagatttgtggcctcaaaacaacatcctaattatgtctcttttagaagtataatgttgagcagtctcgcagaattatttcgtatatatgcatgtctaagaatatgatgtaaacacactgtctaattactttgcagcacaaaaatgttttttttataacagatttacattgataacaatatttttttaaacattgagataaacattttctattggttgttatataataactgatttcgaaaacacttaaattttagattgattgtattaaaaatttgacatagaaagtacattgatctagaatgtggacactctttacaactttcgaattttttggcaagaatttataatatggtggtatagtaaaccaattttggaaaaaacttttcacatccattcttcgtataaccaatttagattgttgatattttttttcatatttttcattttttacaaaactttttaagtcgattgtgctaagaactaatttagatttttttttctttttaaattgattattagtccagccaatccacaaaatccaatataagttttatgatttcagtaacaaattcctattttcactccaattttttaaccctcttctctagtacgtaagacgaatccaagtttctttggcaaaagtattttcaaacttacattgaagatctacgccccaacaacattgatcatcttcttatatatgattatgattccttcattggctgatacaagtattgtagggtgggatgaaaggatagtaatgtttatagatttgaacaggtgatgttgtgggttctttgatgcaagggttggggtactccttgtaccctctatccatttgtctaataaaattattatttgctgataaaaaaaatataagtatgactccaatacttgttttttttttttatatacatttctccattttcatttttctgaatgtttactgttcttgggtgaatttgtattttaaaacctgacctcattcattaggtgttattatatatgcaactttatgagataatcttctctctctctgattctataattataacttcactttcaaattatagcctttctctttgtttcaaaccctgaccttgttatatgtttctctcttttaaatttaattttaatttaagagagaagtatgattttttatttttatttttttccttctataactaattaagtgctttttgagaaatttaagaaaactaatccatagcgtatttatgataataaattccttgaaatgggggtccaatatatttaaatttttaaacacgttttttttttctcttttaaaaatcccatttaaattgagttcgtacatttatggcttgcatttcaactccattcttgcattgcatggtccttttgtttcttgtcttggttgcggagtcaacaagtaaagacgtgctgggtaatgggcatgattgacttgtgtgggagaaagaaaaatactctctcggtgactagtgtgttcatgttctgaagtactaaattatgcaacatttggttgatatcatgtacaatggttttgccaaacctctaaaaagctaagattattttgtcggcttcctggtaagttggccccctaaagtttatcattctgttttttcagttcatattctaagcctttattacacggtcacatgctgctatgggcaattttgcttccaaagattagtataagatttctagcttttattaaaacatgatcatgaacgcaattcctatgccactaatgaacaagtttaaagtttgtgagtgcaatgcaagaatgtcaaaatttggttagattttcaatttgctcttcaatttgtggccacaaacacacatttgctatgatgatggccccaaatatacctaaactgtcagagaccctattggggattgtctttggatgtgggtgcaattcttgacagcccctgtttagagagcattcttttttattttctaattttcattctgatcaggtgagaatgaattttcttggaccacagcttaaagtgaatatccggccaagttatacataacccttcttttcttgactcatcaattttctttttaaaaagtctcaaactagcattcccaaacaataatttattaatttttcatgcttcaaaataattggtattcttaaaatttagttttttaaaattattttgacaaaaaataataataatatacacttcatgtacattcacacacacaaaaaaaatccttccgattcttttgagttttgatggtacggtcgccaatttgacccggctcggcccattcaagacattcctaatgcgaaacatacttttagttttaggttgggtcaatttaaattaatttaattgtgcgggttagcatttttttatagctaaatctacttttctttttttacagattttgaaccaaaggttctactttatggacttatattttttaaccaaatgttacatggctataatttaatttatatatatataaataaataaataaatagagaatatcaagtgaatttttttttttcattgtcagagagattgaatccaaatgaaattttgtaaatataaatatgaaaaagcaacgtttaattcaacaataactttttaaaaatcaaattacactcatataacttatactcacaatcatatcagtcaattatatggatagtttcatttcaaaacctattgttggattaatttatttattttacatatggatcatatctacaaaaataaccatactaattgtatataaaaaaaacatactaattaaaaaatatgtagttcaattttcattgttctaatacttgagttataatttatattatctttagtgttcttttaagtattgtcaaaattaatatataatcaaatggtttttttcgtatttttcaagtatgtatttaattaattttgatgtttataagttatgtattaaataacttaaattaatatgatttaattataatctatataataagaatttcaacccagtgataaattttggtaaatgcaaattatccaataaaaagttgtttaaaaatgtgagaatttccttaaaaaaaaaacaacaacgtgagaatgtgtgtaacagaccccttttcttttcatgatatttctcttgtgaaagtaatatttaatttttttatttattgttctattaattagaatttcctcactgctatcaattttatttatttctcatgatatattttcatttttaacttaattaatatactatcatttttatgataaaataatcttagctcgtgtattttttgtttcaaatgtgacaaatattaatagttactgtaatgtaatattttacacttttatggcatcttactaatttattagaaggaacaaagcaggtaacttttatgtgtgagagactgaaaggtcatagtttacgaataaatttttaaaggaatgccaagcaaagactggggaaaatatcccatctatgatggtacccaaccccatagaaaagctaaggccaacatgaatttattaaagaaagatgagaacaaaatatcatgggaggactaggtcaagacccatgctagagaaatttcaatctatactgagggagtccttgcagatcgtagacaaaaaaatagaaacaaaagaaagggacaccatcccaccaaaaagattgatggatagaaaccgtgaagttagcagtgtaatcttgtaaacgggacaaatattttcttctctagaaatgtgaaaagctttgaaaggaattaaaaaaaatatatttattgtgaagatcataaaaaaaaaacgtaaaaaatattatgaataatataattttatattttttaatattttttttatttttttaactaatgatctaagaatgttggttagcatttatcataaaagaagattattcaacatttcgttcagatttgttttgatacaaaatttaatatttctttcatttcaaaataaatattatcctaagttgttttatattccttcgtctcattataattggtattctagattatttcgcataaacacaaaaaatcactaaatagatgaaagaaaatgacaatttttaaaaaaatattcataccatcattaactatttttgtttttgtaatccatataattaatatcataacagataagtcaaaaaagtaattaatgttgcatttaaaaattaatataaaattattttgagacaattttgtctttttagataacattttttatgggaccaagagactaatagatagataaaagtgaataataattttacacattaaactaatcttaatattaatattatattaaaaaattaaagtaacatttattaaaagtattagttggaagaaaacaactgacattatattaaaaaattaaataaaacacatattttagggaaaaagtatataactgaacacaagtccaatacaatttcccgtcaattagttactgttgaaaaacagtgacgctacccgaaaatgcagaagtctcgtctctttggtaaagatccatacatatataatcaggataaggtaccgaccaagcatcataattttgtttgtatgaacctaaatgatcgctaacaaaacctaatcttcctaattctatgaaatgggtgtacagccatgttcattagtcttcgatggccatatatgacatatctgtcttcctttctaatcactaaccagcagcaactgcactcaccattaagaatttaatttggttaattacagccacatcctggttcgttgtaattatcaattattactttatctcatacactgccaaatcattttgtggcgtaatcagatagaaagtaagtctcaacggtgacgtatagcttgttatacatttgtcgagatgcatgcatacacagtgtaagttacaacatttgaagccgaaactcaacaatacatgaaacatgttcgtcatttttaaattatgataatgatgcgatgaaaatgaaaaggcctcgataatctgtcttcggtttgtggttggctgttatttattttttctttttcttgtttaggtaggaaagtgtgctacatccttctagtattggttgtcatgctttcttgttattttatgtactgacgtgggttagcatgctgccttgaaaaataatgtataacgaaaacaaaagcaggtacaaatattgtgatcacttctagaaggctataaccggttacatctaaggctaatttgaggttaccatattttaattgagacctaatcacagtgtcaacaaaacattttctttaaatgaagaaaaaacctatatataaactcattattcggtaaaaaaaataagaaaaaagacatcattgtataagttaccaagcattcattttgctacagcggaaattttaaaatttatgtcaacaaattaatttaatttttcaatcacaaatatctaacatatattttaatttttggataagccaattaaaatattttgtagtatcttagttgttatagtataaattaaatttacaaaattaagaatatttatagccaaaaattatatctcaaattgaaatttgtactaatcattttttatatgagtatgtatgtaatttcatagttacatatatgttacataagaaattaagtaaagtaaaaataaaaattaatattttaatttactttgacttgttaacaaattcttttcataacatgaaaaaatggtataatctttttcatttttatttaataaattctattatgatcttttgctcaattttatttatataattagtatttaataatatattgaaagttgaaacaatgatattttattaattttaataaattaattttttttttatatcactaattgttcttatggtatttttagtaaaggctttttctttgaattctataatattttattattttatatgcataatatatatttatatatatattattcgtttcattctctaataatgaaaatattaaaatggttattcagggttattttttgttataccgaattgctcctattttttttttacagattatttgatttctttattattttaaaaatgatactaattaatcacacacatttatctttagagaagtaaagtagtgtgttattatacttaacgtacgtaaacaactaatcgacttaacttagtaagaaatttaaacctaatcgcctcttgacagaagtacttcatcttaattcaattaaagatgaagttaacccttccaaatttattttttaaaaaaagaaaggtaaaccataacttacctgtaaatgtgaagcccaaaaaatcatgttaaaccctttgttcttaaaaaacccagctgttaacacttgcatgataagataattgcggtgaggttaacttcacttaccattcacgtaaagggtgtcccaagaattgccagcactaagcaattcaagttacagcacatcgcattggtttctcaaatttgaactgccaaagctttttgcttatacttgtggaaataattagttgacgcctccgaatcaacatcctagtaagcaaaattcaaattgaaatacttttaactttacccttcattattatccaactttcagattttcttcctttactaagttttgtcgacaccgaaattattctctgttgactatgaatcatgacagttaaaaagagaagcattagtgggtgtaggtatagccataagccaattttgcacatttgacttttgaccatctattgctcatggtaggcctttttttgttatttataattattattattctcattttagtagtattttattagtatcatacaataatagtggtagcaataaaaggaaaatgtttttgagtgaactgacataatataataattaattcttggaagtgaaaataacagagaatgttagatggcttcaaaattactcaaaacactgggccagaagtccagcacgtgtagggctcagtgggatatgtgctcgatatacgaggaatgaaagggacccaaagcagaagctaaaatgcgtttaagcaacataataactctaacattggttccctctccttaatcccatttttggttcgttacgctaaaatctcactaatcccaattacttgttagtatagtttattggtaagtaagagcatattcagaaacgagaatgacgcaaatttacgctacttgttgctgccatcacgttttaattcaaccattattttttctcttaaatactacaatattagttaattatattattcaattaggaactagtagcttattctcacagttttttttattgctttgtctcctttagttgtaatatttgctttgacttgcaaaaataagcattaataagtatagtactggcaaatattaagggatgaaagtgtgacgcagggaactcctcggataacttagttaattaaaactgacgttaaagcttaaaagaaatatgaataatagaaaacgtgaataatcagataaatattagttagaacatgtagaaagaagatagggatggcaacaagaattaggagtaggaagacctcttttttttttttcgaatgaaattggacttctaatagcaggatggcgtgccaccaaccatgcattaaagtataaatttaaagtcataataaataaaaaggaaaactaaccaatatattacaaagtgtatttatagtgccatgccaatagcgggatctttggtaagggttagtcacagactatgcgttatgaaacattttctgcgtattttcgaacttagtttgctcaacgagtacaattaattaataaaaggacccgttattcctgtataatgcttgaaactttagcctttgttttcatcgctaaaactagcatcgcctaatcgaatccgactttgttggtcgtcaattttgttattttctaataactgaaattgtttttaagtacccgtttgccaccttattaaataacttggtaattaaaactcaataataagcctatagtaacatgcattttttttttgtcaaggaacaacttatttagagcctagaaaccctttggaaagcttacacaagcttgatcccacctaaaatagcttatttagcaataatgtatacacaccttacataaatagtgatacaatgtatatacataaatagtgatgcctaatgactatgtgtgtggtcatgtattttttttacttgtttaattttctattcttttcctttacctactttgaaataggtagtgagcttgagatacacatgtgatatatattccccaccattcacaatacactggactgtgtggggatgagatttgaattgcaatgattgtgttccacccactcgccatcttaaccttatctattttctttcgcaaatttttccagatccgttaaaataaatctatggggaatggtgctattagctcgcttcaattgcaaaattgtacaattgaaaccccaggttaatatgcttctacgtggcttaaaagaattggctcaagtagtcaaatagtactatcgtttttgtccctttaaaacaaaagcgtaaaagttgtgggaacataatgactagggtcgcatttggttaagagccagcaggttccaactttccaagttcactaagagacctttttttttgtgttttgtttttttattttctcttttttttagggcgcttccttcgtttgtctgcgtgtgtttgtagttaaatttggccaagttcacttaccatgcacgtaaagttgaaggaaagcatggaatggtagtttgtcctaggactgggaggcataaagcaacttcttgcttacacggccaaagtcgtgagaattgatcaactcaattcaattggcaagaaattgaagaaaaccacatgttctatagtttatttatccaagctatggattcagattcgccaattgataacatgatatctgtctgattcgccccatcaagttactctaagttgggcacaaaattaataatgaatgggtaaaaaaatctcttaccacttcactgccaataactttttttttttttttcagtatagagtaaagtggacgaatcaacaattaatatgatgagattgctagtatttgcttgccgctaaatgccaatatgtagaatctgaggatttaggtaggtggcgtcagtagtatacatcctcgcaacttttcaaaccaagaaaccacggtcacgtgcttgttgtacggtgtagtaataaatttgcccttttgaccgcttctcttacctagagtgaacaagaaaattgtaactaacaaatacttcggaatttttttttatcgtttaatcatccatcccataaattcaaaatatatatatatctaaataagaaaatactagtttttttttaacaaaagtaagaaaatactacttaatattatgttataattaatttaaaaaaatgatagataaggataaatatttttcttttctacaacaagtgagagagtacatattaattgcactacgcctccgctttctttctggagaaaatgttagaaaaggggaaaagggtagggccgaagataatttgagaaaaaaataaaggctaaattataccttcgatttattatgttttagtgttattttatttagtacatataatttaagaaatttattttaatcatttatatttttaaaagtttcatattattcaatgttaaaaatcttaagttttttaacactgtcaagacccgatgtttcaaatttatgtcggtgataaattacagtgtgactataaaatgtcatgataatattatttagtggatggaggttacaaatttaagtgttaacaagacactaatatttgttaaaagaaaaaaatttgaaacttttttgaaaaattaaaagatcaaaatataattttttaaaaatataaataatcaaaataaaccattttaaaacataaaggtttaaaataaaaactttcaaaacatacaaaatcgaaatgaaacttaaaacataaaaaactaaataaaatttttaaaatttaatgtattaaaataaaataacactaaatatgatgaaacaaaaataacatttaaccaaaaataaaaaggtaaaaagtatgacctaaataattaatttgactcatcttagtaataattaggtcattcacaactcgatttcagtttaataaaaattttacacttgggtttaacttataatctcaaattgcatgagttactagtcaaaattacttaaatcttggacagttttaaattaaacatttttcgaaaaatcaaaatatgaactagaaattaaacagaatgcagttcaagtttagttcatatccttattcagtagggaaacagggaaagatgagattcttaattaaacttaatacagttcaagtttagttcatatcatcattcagtagggaaactgggaaagatgggattcttaattattgctctctttttcctaaataataatgtgagaagagaaaggtgtgcaacacgaaagactatctgtaggtaggctgcataatatacatacgtacgtgtacgttatacatatatggttataataaattgtcggttgtacattttttatacatatattgtcggtgtgactcgtttttcagctgagagcaaattaatctacaagggctaaagtgcagtagttcctgattaaaaaagttacattacaatgaagagtctttggctgcatgcagcatgggaaccgacaactctgccgtccttcgcgttgacctcaatctgactattgtagctgtatattactattagtaagtatacgttgttcataataataaaataataaccatgattttaaattgtgatcacaattatagttatagttgtgttattgtgagtcgaaaaaaaattatattataaatatacaattaatatgacgacaattacaattatgatgagtcaaaatatatatatatatatatatatatatatatatattaaaattgtaaccttaacgacaaattgtaattgcgaaacgttatttaaaatcataacaataattatattaatattttgatttcattactttacaacttaatatttgaataaaataaataagttggtttattatttaggtggcttaccacaatctgaaccaaccaggtaggctcaaaggaaaggatatatatagttacaagtttgaattgaagttgaagtggttttatagtaaatgatatgatatgacactcgtacataacacatgtgcatgtaacactagttaaacaagcaatatgtagcttagaccatactcaactcaactcaaccgtcgtttttgctttggtttagtttagatggtgtatcacgtgcacatgctctcacacaccagtcaccaaagggatccttacgaacaagtggtagtatttggcaaatgcgttaagcaacatcctctgcatttgtctccaaattcctctcacttatttcagtgatgagatatagatatatatggaggcatgcaccgtgcagtggtttataaatgaagtgatctttgttgcttcacttgttagtttaatccttttttaaataatttattagtaccgaatcgatcaatctctgcatcgtacggattgagtaatgagattgacatatttgtacgtcaacccatgatccccatcacacagactctaaaaatatctcaacctccttccaactcgcaaatcgcaattctcattacccgcattcgtggacgcgatcatagcacaaattaaccttttctctttggtacgttaactttatgtttaactttggccaaacgttgcatgtgcttggggatttatatactaattaaattatgactaatactatttctacataaatttctcacagttatttttaaaataaaataaaataaaataagtaacatttttttaaaatttgaatcacatgtattctttattaaagataattttatttaagttaaataagattatagtggacgataaaaattttctctgattaatatgaaaacaataaaaaatactattcttaaattggcgcacagtgattcaaaacaccaattgagtttgaagttggtgcatgcatggtgtgcgctacttcttccatgactggcaattataggggcacgtagtcaacctaactgattagaaaagctactgtgggatgaatgggtcattgacatggaaatgcaacacatctttttatattattttttcttttgccccagaaaatatggcccgcttttaggtgtcaaaatccagtgccattgtccgtgatttccctttcgatgcctgatagaggttcattatataaccacatataattcgtgcagatgaacccctatttaatggctattttggtggtggcaatggcaatcgttgtcaaaatttaatcataggtcatattcattcaactaagttaagaaaaaagataagaaagattgagtcaacaaaaattttaaaatctaggagatcgacagttagggataattatgttagtaaatatactagatatatatgatgtatgaattatttatagaagtttttacatatacttgattttttaatcgtttatctctttcaatttaatctttttattttattattattattattattattattattattattacacttgtatgttagtcacgtttttatttgatttgacatatgattagctaacatgggttgatatgagtagttatgatgaatttcgtgtgaactttcacattcccgtctagaggtattaggaaggagtgtctccaatatttttaacttcagttgaaccatagagtagagtctgcttccattataatttaggatttcatcgatatatagcattggtaagcaaagttttttacacagactagtacaagaattgtttttatttatttatttaagatgtaaaatatgtgaagccctgtgtgacaattttaaaaagaaatgtaaggacatacttctagagtatatataatgctgtacgatccactttcttgaaataaactatgacaaattgtgagtatgcatgaaaaaatggacaatatgatttgattacatcaattttttggggagtgaaaattgtgaaaaaaactattcatttttgtgactcttgatatattccctctaaattcgtatataaataaaaataattttatatcaataaaaaaattagttaatattatttaattttttaattttaaataaaaataaattatttctaaaatatttttattaaaatttattatcatgaataaaaatgagtcatttttaaaatataattaaaactaaataaagtgtgttttaagaataataatattaaatatgaaaaattaattaaatttatttataaatccaatatttatgatcacttttttatttttttatatatgagtgcagggagtaatatatatcacattttagacctttgactatgtataagagaagtgatctaaaccaaaacacaatttctattcattaatgattttttttttaaataaaatggtacagttaaaaacttttggatctggtaccaacacgtatacatggtttagacattaatattgcattatgaaatacaatgaacaacgcatatttgatatttgcatcatctttattaaatgaatgctaataccatctacacaagcatctagaaatcataagtataccaactctccctattaattgcgatacatgaagcaagagacagaataattggtctcaagcaagaaggcaaaattatcaaccattgacgaaacaaaactctgctttcccccaagtgtaatttcctagagcaggtagatttcaaaaattgaatttattgggtaaagaagaattgaaaatttcaaaaaattattttattttgaaatagagaaaaaagtattattttttaaataatatgctgatcttcatcattcttttataattcattttatatgtttgagatcttttcacaaaaatcagacattaaactaaaaatcattgctaaagatgtatactaaaaatgttttttaagaaattaaagaaaattaatgtacgacaggtatacacaaaaacacacaagaagcaataaatagtgtgtagtagtattgtttgatacgtttttccttcatttggtttcaagaaaaaatgaagggggaagggtgagggggagcaagcagagggtgggcgttgcgacacttagcatgtactcagtcgtcttcaaaaatcgtcttgcgtggcatgtgagactagtgacagcaccgtaaggatgtgcctgaaaatgcatccgcgtgccatatttcgacaagagccgtgcatcaatgagagggaacaacttacctgtccagaaacctcccaccaaaaaaaggggccccacttaacatctctccctttacaacttcagagattctgtccaaaattaggagaaagtaagaaagttgtgcaattttgcaataacattccccctactcttggacattacttagataagattgcagccttaacctacctttttaatagcttcactcctaataaacaagccaccacttaggcaggcctgtgtttaggaactttaggaccttagccaatttttttaagaaacttaatattacatattatataaattatttttcaaactaatttttttattttttttaccaattaaactcattttaaatgtttttttatgaatagtaagacatttgtcaaaagtattatatgttgagattgaatttattttttaacttattttttattttttgagttttgaaaaccaagttcccgctttttatttgattttttctattactataaagtataagaataaaagaaagaagtatcacataatataaataaaaatatttttttaaatctgatatggtattaaaaaaatatgaaaaagaaatagagaaacaatgaaaatgttgaataaatgttatttttaattaaatgaattgataagtcatgcatcaatatctctggttcttaatgttgtcaaaaaaatttatctctaacattaacaattatgttcctaattaatagtataatttcttataataagctacaaattcaattttcaattatatatatgattttggtatttagttttttcactcctaattgttaattaagacaaataactaactattggataatttttcaatcatagaacatctttgtccgttgcaatttgaacaataggaacagattcatataaaacttacataataacaattaaaataaaattaagaagcctaaggcaatagtcttaattgcctttcactatccacggccttgcgcttagataatttatcagtcaacatattgatttctgttacaaaattctatttgtgacaaaagttattttgttaatacatcaagatcgttatttttgtatttttttttatcttgataaatttgtattgaaatgtgtattatattatttttaactgtaaatcaaacatacacgtaataatgtatttggtcaaacggtaattagttctaaatcacaaaacgattaaaatctatacactttttttttttcttgaatcaatcaatttacatggttttaaaccgagtatggggtatttgtggaatgagttagaagggttttatgacttttatctttttctttacctagtttgaaaatgtgatagggtcaattttttaaacttgaatttcatcgtatgttttaattaaaatttataaacttaattgagtttataaaaatatctcaaatcttctttcttctaattatattaaatttgtaaattaagatttaatcttaaatatattttatagaataatcaaacatctctttaaactaattttactgtcaaaatacttttagaatcctcccactgaaaatccaaaacatcctaagatatatatatatatatatatatatatatatggaataggactaagtaaattcaagttaatgacataatatagtaatgttaatattatatgtagttaaatcctagaattaaagaagtatataattaaaataaaggtatattttataatttattaaaagttgtattattaatgtataactatttttataggaatttttttttgtctcaaatcattaatgtgctgaattatggatgaactaatgaaccgatgaacctatcatgggatgtcgtggagtcttcgattttgcctctagcattttttatattaacttgtgacacaatccaataatggatgacttcatgggctgcagtactgtgatcaattatttcttctagcaaagctttttgccaattcctgaaagtgaaagctggatagatttatcaggaaactgtgtactgttaaatccacatatgatgtagtacaaaccattagtgaagtggtcgacaaatctctgttcaaaagattttgaaaaaaaaaaaatatccgttaaaagtttcagcttgtgctcggagaatatttattgataaaagaaaagaggaatatttgatataaactatgatatgattgcaaatgtgctttctgcaacagtaatgaggagaccagtggccaacttttttttggcttgcagtattttgtatgcagtatggtgcttctgtttctcgtggttgaggagaaattcttagttacatttagagtaagaaattttttttttatttatttattgttcgtcatgtcagtattatgaattattattgttttttacattaatgataatttttaattttttagataaattaataataatttttattttttctaagtagattactgacataataaacaataaatagatcagagtaaaaaatatcttgcttaatgtgcacttaagaatttttcgtgacggattacatagaaattgttcagaggtgatgatgtcctagcctggacgtgtaaaacatttgttgaaacttatcaaaattaggtcttaaactgttgaacacgaatttagagtaagattcacagtttttcttatttatttattttagattgaaagtgaggggacattccatcagtatgaaatcattttaattaggtattaatattatatggttataaggattaatcgatattttttctttaaaaaaaaaaaaacttgtgacaatccatttattcgcaatcttttacttacacggttccctgttaagtagcttttttctttattcctcagttcaattgttgtttccagtagcagtgatgttaacagaagaaagcatggggacaattgacatatgtacacgtcacataaaagaaagaaaataggaaatagaggtaacctttcttcgtggcaggaaaaaacagaagagaataacgaggatgaaaaataataaaaagacaagatgcggataagatgcatatcttgtttatcacaaagagtagcagccagcatgtcagacctgaacacgcctctccactccacctttgctttcaaatgcatatttgtttttctagtactctattatttttttaaaagttttaatgtcagatttttatttatttattaaacgtcagatataatatctacactgcactgcatttttattttccccgttattatttttgttcacgtatgtgttagagattctaaagtcagaagcactaaaatccaaattttagaatacatttgaacttagggtgataaaaggagaccatttattacaatgatttcaataaattgaatatatattttattatgtacttacttttaaaatgtgggtaagcatgaatatcataagcacgaataccatactaatttgtgaaatataattagacttaaggtttaaaatctaatattagagactcaattatcttactatgatcgatacactattcttgatcgtcttaattagttaaacagtctacgattactcaaaacttagtctcaaagacctgaatatgtgttatgctcaatctgcctgcctaacttgttaaagcttaaatttctaactctaactaggcatgacaacgagacccaagttcgtgggtacccgtcaaaacccacgacaaaaattcggggacgggggcgggtttggtattgataatacccaccccgcccccgccataattaaattacaaatttacctttatatatataagaataaaatcctgaaaccctaatcctccccctcatttctcattctcgacgacgatgaaccttggccagcaactttttgaattaattccattttggaagctttgttgctgcaatggacctctactctttgttgtgttttattttaattttggaataatatatatttaaatgatattatattttgggagaaattaaatatgtaggtccataatggttttaattaaattgattgattttgtttaataatttttaaattatgatttcatattttgaatgtgggtttgttattaatttttttgttagctagtcaattttttttccgttttttttcaaaagaaaagtcacattattttttttttaattaatagtaggggtgggacgggggcggggaggggaaaacccgaccccaacgggaacgaggatgagtttggattttaaaacccaacgggaatgggggcgggtgcggtgtctaactctaacgtaggtattaatattatcaaaataaaaaatttaagcaagtattattataagtgcttaaacatgtatgtgtggatcgatatacatgtaggacagcacgccatgtgttccaaattggaaagatctcatctaatgggattcggggggtacgagcaatattgcaaatagtacgatatgggattgggttggcgtagatagatcgtagtaggctgataggttgtgcgataaatatttatagatagatagatagagtagtaggagttgctataatctcatacccacacgtccggtcccattcgctcactagccgatgagattggtgatctctgttatggactcaaagattgtcctcatctcctaatacatcatttctaactttttaagaaaattatatgagatatcaagtattttatttgattgacatgttgttgtgaaaattttaaattagaaaattatgaaaatatcataagcgattctcaattttattctgatgtatgtcatccttggacctaaagtcatgagaattcctacattaggagttgtgtgttttaatgtcatcaaatgttgtccatgataaggtgattatatagttggttattggatataaaacaaatagtgaattgggatgtgagtggtctatatgagatttgtccatccttcatacacgactaatatttgtgcgttctctttatactgtaagagaattatgcatgacatgccaaatgtgtagtcaatgagatattgatctcgtttatttgatgtttgcttttagtattaagaaatagataaactggactatacaatattacatgatctatgcctcgtattgaattatgatatttaaaataaaaaaaaagactaatttgaggtgcttaaatgggtcttgtacacatttgactcatttatactctttccaaatcaagtacttgataaacacctattctctccggtccaatacctttggttgggttcttatcctgacatttaattaataatttatttgtttagttataacaatcttatttataaaataatttaaaaatataattggaaatatgaaaaaaaatatcgcagcatagaatatttttattgataatacaaaatagacattaaattttataaaaatatttttagataatacaaaaatcaaattaattttttttaaattataaaaaaaattgcgtccaaaaaattgaaactaagaaaataataattaactttttgcttgaaatttaaccaataattgagtttgaattgatttggatgtattagatgaaaataaataagggagtaagttgatgatttgagatatgtgagtaggggtgaaaataggttaggccaggtcagactttgataggtctgagtctgactcgcatcattatcattaagcttaagcctgacttgttacatgttaaaaataagttattaaagtctgtatacaaagtctgattaaataaaaataaataattaaaaataaaaaataacataatatatatgtttttcttataagttatcaaatatgatcctataagttatagatatgtttttcttaatcatttatgagattttcaaggtgattttttaaagtgattggtcatctaccttcataataagaaaaaatattttttaaaaaataaatatattatttttaagtttatatatatatatattaaataggccagtctgatagacctaacagactttttttaaagcttgagcttgacctttttatttaaacagacttctccaaaagtcttagtctgacctttataataaacaagttaggtcaagtcaagctttaactagaccagaccaaaagtccctgagagacaacctgatccattttcacccttatacatgagtaaaaaaaatggatgagattgaactttgagtagaagagtaacttttagaagaatgaatgtgtaaaaaaaatatgtcacttatatttattacttatatttatatacatggtattggtgatatttaatatattagcggtaaaaaaataaatgaaaaataacgttcaaattcaaacggtaaaatacgtgctcctaaattgcaaaaatccaatttgccaacggttacacaggcagacaatttacttttcattttttaattaaaaacgtcacacatgccccactatgacataagtaggaatcggttctggtttgaaaaacacatataggatatgattctcatgcaatagaaatccaatttaagtaccgattattttctatcatatattgtgttggatatactttgcattgcagacggtcttacatacttacacaacaacatatgtcattaaaatgttaaatcacaaacgtttcataattgacataagttataataacttgtctatattaatcaaatggtatatgtctatttttattaaatgatatatgattcaaatctcaattttgcatacaaaataaattatattaaaaaattatcttgtgacaatgaatattatatattaatatcatgatgataaaaaaatatcacaaacatgttttttatttggataacagtgatatattacttgatattgctcattatttagtctttttactaaaaatatttttaaaaaatatatctattaacaaattatatagataatttttgtaataatatgtattaatcaaacaaaaaattaactcgaatgatttaattatgttaaaatttcaattactgattaaaataaaacctttcaaaattaatatagttgaatatatttcactatttattttgcacaaattttttgttaataattttaattttcatgaatattgaatgcaaaaagttaaatcaaccaaatcatcaattaaatcaaataattttattgattgactaaaattaattaattaattatcacaaaatatgttaaaattatcacatatgttgaaattttattaaacataagatttatttgtattaacaatttagatttgatataaattttaagcttttatccagtgttaacgtatcattatataatttatgtattatgttaataattcgagttaagattgacgtattatttttgagttgactctagtcttatttggaatattataaggttttaaatcaattaatttttttatacaaatacagacaaatctattccacaaataaactctactctcaattatctcaaatttcactctctttttttttatcaatatatttaatttccttattgaatattatttttaatctaccactctcaaataagacatatttttaatctaccacaaatagtcttatttttaatttcctatcttctatcttttactttcaattaaatcttacgattttaaaaaaatacaataatcaaaattatttttatacttacatttagaatacttattatttattataaatcaaatatataactcatgagtaggaatcaaattatacgatataatttaacaattattataacatttgtataacttaatataaaatataaaatgtgaattgtatataaatcattgaattatatttatatatattattaatttcatttgtgtcaaattttttaaaaattgaacaataaaacaaaaataattaaatgatcaatattttattatattttaaaatattaatattacgttgattttaatttatataaatggagtaataaataattttgtattaatatgaaaatttttatataatttatataaacagaatttttaatccaactatgatttttaagataaagttaattttgttataaattttaattatataagataaggtcaattatttatcttatgccaacgtacatattagtataaaaaagttaaatacgggtattaaaaaaaaacaggtaaaagcaaaactgctttttcggacaatatttcgtaaaatagtagttattgccatttactttgctaccacccatctcttacacgcaagtacaaaatttgagcaataaagattttaaaaaaattgggatgggaatgggaccataaaaacaaaaaataaaggggtaaacaagtagaagagaggagtgagtgtaactgaaccagttgctaaatcgtagttttgacctcgaaatgagtttggtcttaaacgagtgcccaggattcggtacctgaaattgcccactccaatgccactgactgctgaaacacgttccgaagggacacgcaccaaacgacacatgtgtctctcacgcgcacgcgagaatcgcgtatgttgtttcaaacctgtggtgaagttgaattttcaaataactcaagttagtcgtttcactcccaacaaatttaaccgcttttaaaacaaactcgacaatttttactgtctctctcataaaaataagtaaaaacacaaaccgaggaagagtataaaaagagaaagagagaggaaggaggaagaactgttcaaaatcaaaatgcagactaaggagaagcatttggcagtacaaaataagagccaattttcaattttaacattcacagcatcgatcaagtaagacgcgacgaggatgcggatctgggtcaacaacgtttgaccagcataaacgatgacattagggtttaattaagtacttgtgggtcccaccttaatatttctcgtgtcccgttattattattattttttttttacaaattctcaaagaagtatttaaaagccttcggccttgtcgttgatgatgttgtggtccgggtttggagattcattacattacattacccctcttatatataacttgttacctaggttttccttcattctttatctttcaaaagagagacacaacaaaaggaagaaagagtgattaagtagggacatgagaacaaggagaggagcgtgttaccctggagtagtctcaaggatttgttccgatgtgagggtttcgaagaaaataaacaaggatctgcacatccatatgcatatgcatgtccccgccggagactccattatttgtagccggaaaaggcagaagaaaacgccggaaaaaaccgccggcggtgattacgattttttcgagtctttgccggacgacctcgtaatctccatcttctgcaaacttagttccaccgccactaaaccttccgatttcgtcaatgttttaatcacgtgcgtctttactcaaccctcgttctcctccttcccacatttctttgaacgggtttttgattctgttttttttttttttttttttttgaaaaacaacaggtgcaaaagattaaacagattagcacttcattcgcttgtgttatccaaagcctcgcccagaactttcactattaaagcaaacgtttggtgcgaatcggcacacaaattcctcaaacactgtgccgatgccggaaacgttgaagcttgctatactttaggcatggttagtacaaataataatactaattaattaaaaaaaaactgcgaagtgtgaagaaattgttgtttgttattgttattgatgaatgatgaatctaaatttgttgatttggtttctgtttgtgcagattcggttctactgtttgcaaaaccgagggagcggcgcgtcgtttatggcgaaggcggcgattaactctcacgcgcgggctctgtactcgctgggcgtgattcagttcaacggaagcggcggcacgaagagcgacaaggacctacgtgccggcgtggcgctgtgcgccagagcggcgtttctcggccacgtcgacgcgctgcgcgagctcggccactgcctgcaggacggttacggcgtgcggcagaacatcgccgagggacggcggttccttgtgcaggccaacgcgcgcgagctcgccgccgtgctgtccaccggcgccgccgcgcgcacctggctgagttggaatcttcagccgcagcagctccggcaggggtccgggtgtccgcttctcagcgatttcggatgcaacgtgccggcgccggaggtgcatcccgcgagccttttcatggcggagtggttcgccgctcggggcggttcgccggggccggggctgagactctgttctcacgcggggtgcgggaggcccgagacgaggaagcacgagtttcgaaggtgttctgtgtgtggcgacgtgaattattgctcacgcgcgtgccaagcacttgattggaagttccggcacaaggcggagtgcgcccccgtggagcggtggctcgacgaggacggggaagatgtcggtaacgacgagggtgacggagaggtggaggttatggtagatagttagacaatttttaccacggtaacggtaacggaagtcgctttggacggaaaaatgaatctatttttggcgaagtgaaagaaaaagaagaattacctgtgatgatttattcgccgtctcaaaaaggtagaagagagtatatggcttcttttcttttttccttgtatagttcgaaaattctcccgaaaaatacgagaggagattctttttctttttctttttttttgcaatttcggagtttaaagttaatttagaaattcaatgctaagaggttactagttactactataatttttgttattaatttaatcgatttgaatttaattaatagttttaagttttattgctatattaaaacttattttgcacatttatctacagtcacttgtttgtatttgagatattagtggatacgacaaaattaaatgtgatttggttgaagattgagatttggtgagctgtgatttgtctctattgatttaatgcggcgccatcgcataaggttgaaaaaggaatagtgaaaataaatctaatcagttcacagacatcaaatttagcattcatacaattttacttcccctcacatgcatgagatgattgcagagggttgattctaggtgatccaacaacttgttagtagcgtaaagaaaattataaaaaaaaaaggtgttaatgacaaaagattcaaacgaacctatcattgcttgatggcactaattatttgaaagatactgttaaatttgtttctattttattctctgagctagacaaaccaaattgctcagaaaaggtttaagtgaggttaataataataattagttctgtggtctttgagtacaagactaataatcttcactccgacatttgcctgacttgtttacaacatgtttctaataatcgtgatccatttacagtatacttttttaataaggttttttcaaatcccttttacttcaaagttcaattgctttagtggctaaaattcagaaaactctctcgaactgtatagctcatgtataacgaatatagtccatagtttaacttagcaatataactttggaaacacttctaaattatgtttaatgaagtatattcacgtttcaatgtgaaaattctaaagcaactctggtgttgcttttacaaacacggcgggatcgtatcatttgagcctttttttcatgctttttccggacattttcttttccaagtgaaatcccctagtatatgaaagagtgaaaaagtgttttcattattgtggaataagaagccttcgtaccttgagatctcaattccagggtttaatagtacatcctaataggggatgaccatacttgttcaatttctctctcatatttgttcatctcggtgaacatttcataatattgcccaagctgccttcgatatgagtatgaggaattcctaaaaaacaattgtttgaagcctattgatattttggcctcttctaagttgtgtttgatttaggaaaggaggagataaataagagaaattttatactttttatgtgaaattcattcttttatatttattttaattcatttttttttctattttcattatctataccaaatacatccttaacgctagcttaatttatgtctagtcttacaataattttaagatatgttttttttacattaattgaaatgatttattagaaatattataattttcttagatgtttataaaattagttacttttttttactgaagtgtaaaattagttacttgactattataaatttaatctatttgttatttcattttaattagtaataaaagttagtctatttaatacttatttaggcattattcatctggactagtattttaaagagaagtggtaacaacactttttttttaaactctttttgttattgacttttttttgtataatcactgtgaatcccacatttaaaatacgaaaaagaaaattaataaatgacaactgaatctattaaaattagtgacttttaacaaatttcaatcaattatgataaggattagaaagaatgccgttactatttctctttattaaataaattcagttttaagaaaacatatcatcagtgctaaactaaaccaaaggaattattgataatatttcataagcaacttatgtgtaataggtaattaacattgatggcaattaatgttttgctacttttagttctaacgtttaccatattaactaatagaagatatgtatttttattgtgataaattaaataataaaagttaactattaaaataaataaagtagttactttttaaaaaatatataataaatatcataataagatattgaacttactttaggcggaatttttttttctaactatagaaacatctaattcataaacgatactatgaagttgtaggagagagttattgaatatcgcctaaggagggagatcaatttttccaaaaatcaatttggatttatgccagaaagatgtaccataaaaactattttcttgatacgacaattaaaggaaagatataaggaagaaaaaaaagacttacatatagtattaatagattttgaaaaaacatatgatacggtcccaagagaagtcttatggtggattcttgagaagaaaaatgtagcattaaagtattttaatacaatcaagaatatatatgatgagactaccatatgtgtaaaaatttgtaatggaatatcaatgtattttcatatgacagtaggtgtttaccaatgttcagctcttagtccttatctctttgccttagtgattgatgaactaacgaaatatattcaagatgaagtgttgtggtgtatgctttttgcagatgatatcatgcttattgataaaaccaaagatgatgttaatagaaaattaaaattgtggagaaacactttggagcctaaatgattcatgataagcaagagtaagagagaatatatgaagtgtgagttttcgcaggtaagagatagtgatcaagacacaatgcatttacttggtcaagaggtacccaagaaatatgtttttagatacttgggatcaattttacaaaaaggtgatgagattgatgacgatgtaaatcatataattagagtagggtggataaaatggtgaagtgcatcgggatatttgcgtgaccgcgacatttcccttaagctaaaaggaaaattctatagaacagctataataccgatagttatatggagtggaatgttgaccaacacataagcaacatgaacataaaataggggtagtagaaatgaagatgttaaggtggatgtgtggttatatgaagataaataagataaaaaattgagatatttgacgaaaggtatcaatgatactgatatgtgaaaagatgagagagcatagattgaggtagtttgagaatgttatgagacgaccactagatgctcccgtaagaataaaagtgtgttaccaagagctcgatacaaagagagatacaggtcgatcgaaatttacctaggaaaaggtagttaaataagacataatggagtgagatatagattgacgaacgatatgtcttaggatggagtggagaaaagttataagcttgatggatgattaactcattagtagttttatgttctagttgttcccttgtttttgttttcttcttcttcatttctttcttattttattttaacttatttttcatttcttttgtcttatttttactttttctttccctctccttttctctttctttgtcttattttcgatatatcattagattcatttaccacccgtctcaattaacttgggttaaaggtgcagttgatattgatattaattagttatattttttaatttttctaaataaaagtattagtaattaataataattttggagagtttttttcttctataaattgagtctcaagtaaaggttttactttccttatgtttaggcacaccatggctccacatatgtcgataaaatctgtagagaatcattggtacgatttgatgaatttatgaagttgtataagtaggtttatacgcattaagttttatgtacacaattggaaaggtcctttatttctatttctttctatttgacccaatttattatttattacaactcacaaagcaggatattcaattttaaaagattcaatacctaacaaagttattcattaaaaatacgtaaatgacatggtacgaatatcaacaaccaaatgctgctccagaacctgctttcatcttcttttttttttttttcatctgcaattataaatgtattaattaacataagaagtgcttaaaaataattacatctccaagattctcacaacactacataatctgacagtgcaaaatcaaaatcagtcaaacaacagaaattattacatcaaagaggagttgaatcttaatatatactcaccaaaacttatataaagaaagatacatcacttcaactctagaatcaaaccagaattcatactcaatcaccctacaaacttaaaatttgatagagaagcaattggatcagcttgccaaagttaacaagtgatacaaaaatctctttgaaaagctttcaaccatgaccatacaaaaaacatgattttgtgtcaaactttctcattgtcaaattcttttccttcaaacaccatttcatttgattgactccatagaattcagaggataacacaccatcccatcacccaccactcatttgcttttctcccaaccaaacaatgcgcatgttgcaaaaaaatgatccaataggcagtgcaaaatttaaacccataatactagactaacgtttccaaatattgtgtgaaataggacatgtaaaaaacaaatagaataaatcctttacctcctctttatagaatgcgtacaataattttcatctaactttaattatcgctgtcttttttttttttggttttttggtcaagaggggatcagaaaagatgaaaagaaaagtaggagacacatttgagaattccaagttgcagtgaattggtgtgggatatgcgcatatttgcatatcatagagtagaatgattttgaaataagtaagctggctggaatttgagtcctatataagaacctcaaaatatatttaaaaagggggaaaaatattcgattttgcacagattattaattttaaatggggaaacaaattaatttattgggtttgggaagatggtgagggattgataagagtgcacttattctttctgcaatgttcgttatttattaatttttggtccaggttctttatttatttcagttgcactgaaccccatacaagtgaacgggtggtccaggcccaatacagtaactagtcccatttccaaatatctattcaaattacggagaagaatatcacaaaagggatcatagagaagacgaaaaaagggtaatagtttggcatctttttcaaacaagaaatcttgagttttttcattaattttttcaataaataatctatcactatacttagagaatatggaaataaaaatacaaagaactttgagagacatgcttcttttatttccaggaaacatatttggcatttccttatggggcaacattagtactaaaataagaattagggtcacattctaaagagatgggaggcttggcaaaacaaaaggaaaaaaataataatagttagaatggatgatcatatatgttgggtacaatagaattcgtgcattagaaaacaaatttgcttaatgggccagctacggagacaagcttacttgttacatgctaactaccactattttgtcgaaaatattaagaaccttccacgacaggtgggattcttatgcctttgaattgagaatgaattcccctgtttgagcatctaactgttaattttttttcctttcttgctttaataatctctgtttgcttcttgctttggtatctttgcatagcatatgcagttattgccaggtcggttgtcaccatcttatgctttctgtctaatcatttttcatgtcagaattagagggagacaattttaaatcatcttaattaaaggcaatttaactatatagcatcgatttattttttaaactcctgaatgcatattttagattaatgtttagtaaggtattatggactaactaatgttttattgatttaagtagtaagaaatttatttatttataggtaaggagaataatctaatttatttaatcagggaaatattgtagttttttatttaacacctaattagtttccctctattcgagttaaatggagttagttcattttaaaaaaatgatacttttaattatgattttatgccaaagttgatcaaatcttaaattttgattaaaaaaattaattgtcgaataacttgtttcaataacctttgatattttttttttgttgaaattaatacaaaaactgaataattgaagacttataatatttatcaataatttgacaacttaacttccaagcttaagttatcaagtaataaaattcattaattacttttaatgaaaaattacatatgttaggacgatttctttaatttactttcattttattggtagggtatactttgcaaaatgggaataaatgaaaggagaaaaaacataaactaaaaggtctcctctttgtgattggggtcaaagaaaatgagataagaaagaggggaaatgaatgatgggatcatgcctcaccagacacgaaaaaaaataagaagacaaaaccacgtaaagagagaattatttattttatcctgagaagtaatgaattataaatatttgtatatctaatgcatggataaaaatgtctcggtgataaaatatttttttcgttcacacttttacctaattatatagagacaattcaactttttccctctttattttcttttgatttaaataattttaaattttacttttatttatttatttatttatattctcttttattgaatttcttttatgtttcttctcacgtccaaaatccaaataaagcattcaagaagaaatagctctcctcaccacattacccttatgtagtactacctacattaaaaaaattacaataacattatttatgcctgtattaaccttaaggtagtagtatttctttacctgtaaagaccttataaaacaaacgcaactatttaataagtatttattactattattaaagtgagttgatccatcctaaactattccaattccaattcccacctagcctagccactacacctaccaaaaaagaagacttgttggctattttaaaaatgaattaataaaataaaattttctgtttttataatgagttggtaggccaatcaatttaatattataaataaaaaagaaattaaatgattttaaaaataaataaaataaaataaaaatgaaaagataaataaataagaattgagaaatatgatgaaaattgtgttagaatacgagcttctagttaacgaatgaaaattaaagaaacagaaaaaattgacaggacaactgttccacctttgttctcaacttatcattactcatgaattatatgagtctataaattaatacgaggaacccaacaaataaataaaaatgagtaaatgggttagtatggcacatcaaacccactttattaagattagttttattaacattctttttgtacgagtgtgatgtaaaagataataaaaaataaaaatatatagataatataaaattgaataaatatagatagatgccaagtgttaaaaagtttgtgttagaatacttgcattcctcttatacttgaattttacccattgtttatagttgtatgaatttattgcacttttatgtgttatatatatatatatatatatatatatatatagatattaaattgcaaagttatattgaaaaaattctgttggagtgagtaatatttatcagggggtgaaaaataaggtgagatttaacttaaggataatagagaccgaatcttattcaccaaaaaaataatagaaaccgaatcctattattttgagtaaatgtccgttaactataatggcttgattattaaattaagcccagaccaatataagtattaaatggctgagctgcatgatgggaactaatgggcttaagaaaattgagcccagactttattgtaatattggcaaaaaaaaataaaaacttgatccagaagtaggagtgggtttagccacgttgaaaacgcaggcatggaaagcacagtctattttcattgggtgctgatcggaacaaacaggtaatgcagcaaagcactttctcacactgaattttcgcgtttcaacaatttcaattgcactttcatcatagacttcttcgtaatattttctcggaatgttccagattcgtggcttttaccgttgttttgttgtcatgattatgtttttctttctcaatttcgtagtttaggatttcgacatgattaagtgctttattttttttttttttaatgattggaagggaatagaagagcggagaagatgggtttcataatggaattcgctgagaacttggtattgaagttgatggaagatccgaaggaaagggatcggaggttcagggagcacgtttatagagtgaaggacaggtgcgagaagacgaaggagatgtggagctaccctatgcgaccctatgggttttggacattcgaacgccacaattctcagcttgcttgggatgcacagattagccaagtggccgggaggagggacccttatgatgatctcctccaacatttctttaccccacctaagtgaggtattgttgttgaaaactgtaatttccaagtatgcagctctcaaatgtcaatgcaaaactggattgtttttggttgattatatttggttttgtctctttgatgaatgacggtcaattactgtgtagaggttattttagtactttgaggctgatgttttgatttgtctgcatgctcttatgattatattgtgtttatggagtgcaactagagatactgtgttttttaaatcctttgggttgggattctggagttgtttaggatgagagttgatggtgaaactctgcagagtctgcacctgtcaggctgtcactgctatggtgtaagctgttatttactatattagaagcgtggtttttagtagctaaaacaaaataagtctgagctttattggggtgagaagggaaaaatggtgaaagttgggaaggcagggaatgaagtgagaaatagtggagtggatgggttttaccaattcttaggctgtgaacatggaaaaagaagtatctacaggcttgctaaaggtagagaaagaaagagtgaaacgcatcaagagttagaagggtaaactaaagtcttgctaactaaacaagttatcaaggaaagatggaagagtcactttcgagtttcaacaagacatcttcaagtgttcctattacatatgctttctcaggtacccttacaatcacctcagtcaagaataatttggcttggtcagccttagttgaactctggtttataggtctggatctctttgacctcatttaaaagtcagcatctgatatttgctcaaaaagtcaaagtcagtgggacatttttgatcaccagctttgtgctctgttatggtgatctatggagcctactattttgggcaatttcagaatcttaaacatgtttttaaccttcagaaacaagtcaaagagctggtgccatgatgcatgcttttgctgatgatatagtactagttggagagttgagagaagaaacaaacgggaaagttgagatgtggagcatttttgagaacacagactttgtataagtagaagttaacatagtatctgaaatgtatgatcagcaaaaagtgcaccagtttgagcttagagctaaaatgggaggccataccacacaagtcgcatgattttaagtgtctaggatccatggtacaacgtgacgggaaaatagagggagatataaaccatagaattcaaaccatttgaatttaaaggagtgcttcaagcaaaacacagtaatgtaaatagaacagtaaatgagagatgagtattatttgtagataacagaaaatacagtagatgataatcctactgcccagagccaagctctttcagagaggttacaattctctctccataacagaattctaaaattcccgatacccctctctctctgacaccttccctaaataccctcagattccatgtcacacttttggcaattctgttactctcttgccagatctttccttttctcacctttgtttttcctagcatataccctggatatcttgggcctctcccttacttctaagcccacactcccattcctatcattattagtgatagaaaagtactactgaagcttcaagggaaaattttactccacaacattaattatagtagttgttatgttgtttaggattgaatgttggagagcagacacacaagatatgcaaggaaataaacttgatgttgcagagcagacatgcaagattataattaggaatgtttgcatttgagtgggggttgaagtagcatgagcatcgattgtggaaaagatggtaattcctgccttaggtagttggggcatgtgtagagaagacttgtaaatacccaatacggagagttgattagatgaagggtagtgcaataattgaggcagagggagataaaaaaccagaaaataaattagatataaatggtttgtcattaggtatgatttacaatagagcattattgttgttcctttaattgctttctttatatgtatatttttctattatagtcttttggaagtttgacgaggtaggtttctagttataattgcagtacctgccgctgtcttctgtactcatatgtggtattctcttttctatgcagtgttgctgaacttgccacaagcattataggtgaaaaggatgaatttgtcgtaatttccccttctaatatcctgtcttgtcgcatgttgcagagattacaactggattgtactgttatttcaaaaataaaggttccatataactatgctgttacagaagaatttttcctctccagaatttacattcttgcacaactgcacttcttggcaattatctgctttatcaatgtttcatgtcattatttagtatttacattgtttgtggatgattcatttctgtcgtcttgtagcctgtagaatgccatatttagaaccttttatgtgttgaatagttcattgttagtttttcatagaatgaggataggttggcagccttaaggtttgctacggaagtaaatagtctatcattgtggtggcaatgttacactgtgtatgtttaaggggaatcccactttccaaagcaggttgaacagggaatccttctcactgtggattcacgttcaatgtgctccaacgtgaaaacaaacgcagctttagtgttggatctttccattaatgtagtgcattgaattttgacacccatcctgtaaatttttattttaaccacaagtctatatgttgaacttctatttcctccaacttccgatcctttcgttgtttcaccaagttgaccttgaaagagatccctgtccaccaaaagaggccggttcactgtggcataattgttatacatgcagaaaacaataaagaaacaacttcaaaacctgcaccattcgaaagccttgtgtctttagatttttaacaaaacaagtgcgaaaatccaataagtacgacaagagttatccataaaataatacgttctgcaaaaaaggaaattatgcagttaatattgtattttcaaacgtataattgttttaattgaaaaataaatctacctcaactatatatcatttcaataaaattagtgatgctcaaatccatcgcataaaacaatggttgttaccaggacaaaatcaacaattaaatttagtttaacagtaggaaaattcaacaaatttcaaaatcacgccaaaagctggacgatatgagcatggcaaaagtcatcatgcagatttagaatgagattttagagaattccttctcaatcattcaaaactattctttgaccaaaaatcaaatcaatacttatttgtttcgatgaccttccctcttccttttcttttttgtagaaagagccaagtctaaagtcaaggaactcttcggtttagctagcagtgctcattacgtcttgaagggcaatcatcgattccaacgagagcataggatgctcctcatgcatttgtgaatgcaaccctgtttcaactctttgaactttgtaatcaacttgtgatgaggaattggcagcctgacctaccctttagtagtaaattagttctgaagcttcaatgtttattccttatattagttataatccctatatttattctgtttaagattttatctctccaccgtacgggacatcaatccataacatgtaagaataatttgaaattttaaagattacgaacgaatttttgatataactacaatcaaaattaaattaaactataagaataaaagtatattctaaccaaataacaataattcttttatgagcctagtattatatttttagtaatactgttcttagttataaaataaatcatttaaaaaccaaaaatatattaaaaatcataataattcgtttttaaaattactattatgctagatataatttttaaaataattattataaatcaacaaaacctgaaaggattagtcaagtgaaataatacaaaatctcgtatttagcacgtagaggcttgtgtccttgggttggagaggcatccctcctaaatttttcaagtgctataaaaaaaaattttttttttggtagatggagaaaaaacaaacaacaaaaacaaaagattacactccagaaacaggctgattcacataatcagctaataacagtccctgagttacacacacaaaaaaaatcttctgctttatcaattagtatttaaatcatattcttattttcttatttattattaagtgtaagtgatttgattgtggcgtccaaggaagaaatgctcttgaaatgtcgtggaatgttaggtgggcaatcccagttccaatagtgagttagtgaccaccctcaatccgcccaagacgacaataaagataatttttatgcaagaaaaggacgaaacaacttcaacttggtgacgtccatttaacgcaaccattgacacaatcccataatgttctacgaacttggttaacttataccatccacacactccgaacccatttcttacacttccatgaacacccacattgcccacaaacttaaacaaatactagccagaagcagattttatgaagaaaatagctaccctattagtagtgctctaagaactctctgccacggaacctgcttcatcttcattcacattgccttctccctgtttaaacgcctttgctatctcatcaattggaatcagaggcaaatagccaaacacggcaaaacccttttcactcgttcccttgaccacattgttgtatttttctgaccagtgtgcagctgtgggaactgccatctctgctactgcatggaatggtggatattggttgagaccagtccacaatttcaccgaaccaaagagcacaatttgcttggactcagtggctacataatttgctgctgctcgtgcccctccagattgagcctcactcactactttctcagctttgtgtgtcacttcctgaaccaaacaagtgacttgggttgcaacctgcttaaccaaagaaggtgcatgctcatcgaatttgtgagcagcttcatccacctgccacaatcatatacccaaaaattaattgcttagcaaatagtagcaatttcccaatccgttcaaacatcaacaagggaatttcatttcaggcatgtcgatgcaagggcatacaaaatttacataaattcattctttttaattttattttgttttaagtactcatggaagacgataggaatcaaacaagacaatttaagggagagaactatacataaaaaaaagtcaaactgtgtgatagtatcaagttctggggtaaacaaaaaaaatcaactgtggatgcatgtacagataacaggttcctcagaaagggtgttattgttatttgccacggttttcaccaattcaactacgtgggggaacgaaacaaatagatcttgatctgaataaaaagataaaaaatcgtcagaaagaaaattcatccttaataattagaaacagaggacaaacaaattgcaagctttaactgatttggttgaaggggtacagcaacaaaagaagaaaaaacaacaaatcacacaaacaaaactaataaatatagattttcatgaaagaaagagagagaaaccttgttgtcgacaaaaaggaggaggtggttggggacagccttgaatttgtggtagacgggacccagaacggtggttacagtgtcttccacggttccaacagcagatctcaaaggtcccgagttttgctttgcgaagtcgtagatattcgacacacacacaaaggctttaattgccgcaatctttacaaacccaagatgcttcagttcttcttgatcactcttgttctccatatccctctgcacacacaacattattcaaagattaattctatgagatctctgcaaacaaaacatagaaatcgagaaagaaaagagaagaattgcaaacctccaaggtggtggccattattgttttctccgccttggaacttgcacgttagctgttgttgctgcaaatataagctcagtctctcatttggagtgttcatttatagatacaaatgggaatcacatgcaactatattaacataagtaaatgccaacgagtacggactccattcttttttaatccatgtttaaggttgtttttgtaaaaaccaataaatataataattttttattttaataaaatagtcgtagagttttttatttcatttctttctctttcaactccacaataaataatgtatgtgtgaattaattaaagataaaaaaagtaagattataattgataaaggaataattcaggtgatcttgaactttacaaatgacaaataaatagaaacaactttttttttaaaaatccgacaattaaaaatgatcagaaggagtaacttaaaaaatattgattaaagaatttaaaatatacttttttttactgaaagatagaaaattgtaatttttatgattttttacgcttttataaaatttatataataaatatttttttaatttcttaaccaattaatctacaataattttttattacctagaccattaacctaatcaagttacttagtactatatagcaattgtagtgtagtattaacctcgaaatattaaaagtgaatatatatttactatcatgtctaaacaattccaaaaaaatatgatacgatagccaggtggaatcaggtctggttacttttgttctttaaatacaatcacaaaacaatgccaaaaaaaatatttaatttaggatttattatcttttaaaaatacaacaaaaaacaaaaataaagaattgttttaatttacacttaatttcggtagaataagttcaaattttttttattatcataatattagtgtaaagtatcactaattttattaataattaatatatgctagagaatttaactaattcttctcaatcatattctttttatctataaaatttaaatttaatatctttcttaagaaatttaatttcagtgtaactaataccgacgatatacgttcaaatttaattacttaagcattattgccttattgcggggatacaatatcccttttttttaagtaaaggaagatgagattgtgcctaagtctaaaacaagaatttaaagttttcactccttttttttctgtctgaggttgtattacttaacctatctcagctttgatatatcctaagtgtattatgattggacttgaggtgcaccaaaacaaataatgagatgccttaaataattatccaagttaaatatcccttcaccgttggattatgtagtctttaatattttttgtatgctagcccacatgagatattgtcgaataaggccgatcagaaatgccatgaaaaaaattattagcccataccttaacccaggcgcgttatggttttgtatgattctgatttctgaatatcgccatcgtgattttggataaaattaaatgcgacacttttatttattgatatagttttagtttaataaaaactaaagttttaacgtaaatattataaatttattttaataatacgaaacattaataatatatattattatgttaaccattaattggtagatgacgtttttctatagcgattccattcgttattttagaaatattccctccttgttctcttgtactgtattctatcaacgacgacttccaaacaaaagctctacataatatttgaattctatgatttattcccttctttttttattctttttatttttcttgtcctatgaatggccttatccttccggtgccgatcatattttgtctgtaccaatatctttcccatataatgaatgctacaaattaataaaatcttgatcctaaattgtcacatgaaaatgtaaatacgtcactggaggcttatttttatcctttttttaaataaaaaaggtatctctttttcttttcgatctatttggaaaaaacaacgtgaatgggccatgtaatttctgttctttcttatactttgaaaatatctttaacatggatctcatactgcatacattactgcacgatcaacttaacattcatttacttgtaattatctagttcttgtaactgtattatatcattctcttagcttccatgcatatgcttgtcctctctacttaggcctttacttaaattgagattttctctttaagcctgagttatagagttaggggagttatataatcttgtttttaattgagtctattactatgtatactcttgtggagagtatggagccaaggacttttctggtttattctattgtaaatccctcttatagtttttcactcactccactacaaatggacactgctcacactcttaacttttgtaataattaagcaagacaggcttagaaattatttacaataatttctgtattgtgaggctcaggtcatcattctatagagtaaccttcttgggatattttatgattggagaaacatttttctggtttggtataaaggtaattttggcaaatacaacaaaatttgaatgctagttgaaatacatacacttttggttactttggttaaacctttctcaatacacattaggtatactgaaaggtctcccacctaatgggaagctaaggctgctccaaaacttgaaatggcagaattaaaactaatataattggagagccatgttacaatagagaaccatatccaaccacttaatgcatgaatttgaaaaacttatatcttcagaaaagcaataggaaactggatttcatcttttctatctttgtccagtgtctttgcctaattcagaaagtgtatttcagcattgtctccaaattgtccattggctgggggttggagggtgaggagagtatggattttgatttggaatagagtggtttagtcaatttgggattgcgggaattcaattattttttccaatgggattggtgatccttttcatattgtggaattaaatttaatccttggcattggtttttggctaaatccaataataggagcatttctcatattgagggtattttgaatagtttctagttctattgcggtagtaatggggtactataggatccttggtgttgagaattgattttcaaccccctttttttttgataatttggaatatccttgatactccttttataaagttactagtactcctctgcttaaaacacccactgatggtttgttgaaccagtagaatagacttatacaatgtttgaaaaagaataatatttgtaatggcaggaagacttagactactaaaggtattttagtaaccttgttagctcaagaacatcaaagaatgcaatagcaatgcagactaattatttaagatagtaaacgaattaatgaattatatagtactgataaataagcggtgtactccttgcaagtaatcaaaattaaagaataaataaacatccatttcacagtttccctgacaggtcaaattaatagcaaatatgcaatttcaggtatagaaatccgaaactacctttaaaagatgaatccgtcaatcaatgtaaacaaaaaatattcatcaaattaaaagtaaatcataactaacatcttatgaaaaaagaaagacagagtttaaccttgattggacagacgacattatgttccttcaaagtatcataaacactttccaagctcaaatgctccatgaaaatgtgtacttcaagatttccaacttaatataataatatagtcaagcaagttgataccttaaataccacaagatattgaaattgcactgaccaatgtcttaatacaaatcaggaaattgcagaacaactcatcctgaggataattgaaatgaaaccccaaactctggaagtaactctgtgattggctctgcagcttggaccaaagttggttggtataattgaaggcaaactgtttctaataccatgttcatgaaaaacaactctttggcaagttggaggcgccatctaaacctcatagattctactaccattggatcaaaaacttggttggtgtgttagtataattagcagttgttaaactaataagtttgttgaattttgatgtttgtcttaattatttgactttatgaacgttagatattaatagcattattgagcaagtaaagcaattgacaattgataaagaacagaagttattgagaaattaggtaatatcttgataattgtataggtgaagtcagacagccaaaattcatctcattgaattcttgcttattgcagtatattgaattttttagctttctagctagttgcattcttcatctttttagattctcttgtttaaatcacatcccctttttcgtttatcatctaaaaactaagaattaggttaaactgatacttaaacaataatccttgtaagatcatatcttagaatcctttataattctaaattacttgttgatgtgtttagttgcccaacaagaaaacttaatagcaagtaaaattagatccgatcaaatccttagtttgttctctacaagatgccaaagtaaattttccaatcatgatgaacaagctcgatatgaccacccgtttgaataggtaaaaagcaaaaaacatacatttaaacataggtttaaatgttgagtaaagctcaacaacaacaattactcacaaatcgacttaatcttattttcaataaattataacattcaattgttttaagttttaacaaatactagtatgtgagaatgtatgatgcaacatgcaataatcaaacaggtactacttgcacaaggacttgaaaattgaaatcactgtacatacgttgatcgtggacatttcaaaggcaacaaaacaaacttaatcacaaattgcattaatgacttcccttgtgaaaagataacgtagaatctttggcaatttcgcatataaaatgatcaattaatggttcatgggcacgcctaagagaatatgttaactttaaggttatgctacgtggggacccaattcaataagacaatagatttgtggagcattaacatgattattggaagtgtgagtatgtaattacttcaacaggaataaaagggctttgccttttatactgttggagactacgcgaaacgaatattgatttggattagaaaagcctaaaactttggggacgtgacttaaatatctttaatcactttaatagtttaaagaacctggcttttatccaagacatcatattctaataatcattttgtcaatagaaaatgaattgcacaccacttaaagaacctcagacttagaaaatgcataccatatgagattcccaatattccactaacttgatattggggagacgacgaatagagaagtagaatagtacgtacttcgaaatctgttaccgtcctttcttcctaattaagttagctttgcacgtaaaaatgatcttattggattttatcatttagaacagtgttacagaaaaatatttaacacatttctttttaaagaaattttactaaaatatttgaatctttcttttataatgaactcatataaaattcacctacccataaagagtatattaaaataatattatgtgaaaatgtatgctgctagtatatatatatatatatataggtaaatctcacttgaaaaaaattattctgccaccataaatgagacctagctaccaatttacataaggatgtatcagcaacatgtacttaactaaagtaaattaatattcattcaattcaatttattttttaaaatggttaattttcaaaattgtaaatatagcataatctgaaaagattaaatgatttattttttaaaaaacgaaagtgttttccatatctttagggattaatttaagtcatccttttttatgctttaaaaagaagtattatgcttaatatacaatgtgtttaaaaagttccgcgtgaaagataaaatcaaaacttaaagacaatacggatagatagataggagaggttaagaatgagcatgggaaaaaaataaaactttgtttttattatcaatccaattactgataaaattcaacacaagttaataaatagataactttataaatatattgacttttgaccatgccaatatataaaaaaaattattgagagaaaaaaaaatctattttgataatctctacaaagaaattttgattatctattgggagacatctttagtgcacacgtaacaaattgacccaatttaattactgagaaatgatagggagactttctctatactctcttttcaatattcttcatgtgattgagtgaaatttgttaaaaatcattaatattgatgagtctcacttatcatttaatgattctctctttatggattgtttaaaattatactattataataaacatatataagttatttgactgtaatgtgacattttggaattaattaatcggagataagaaattcaaaatgagttatttaaattgaacttgtcttaacctttaggctatatcatcctaaagtactattacatgaaagaatcttatcaacatataaatccgtagttcataatacgtaataaaaaaaaattaagtgatagaggcctcgaaccatctattctaccatagagaaacggtagacaataactcccccgaacacaaatgatcacaaccggaaatgctctgatatgtgcatcgttttggcctggatttacgcctagagcggtttaatgaccattaattacatcagcctcaatcactgagagaatcaaataactttctgactaattaatccacaacagctcaaaaacaaaataagccaaagtggccagtgcacacttgctcctgtgacgcacaatagacaaattgcctaaaaaacaagcaaccacccgttggaattgcacgaacaaaatgaccatttattaccacaaaaatatgacaccacgcaccatgcaacggagaaatgcaatacataagtaattagaaggtgcacaccattgaggaaaacactcttttctaggatttttttttgtcatttcttgattcttaccgatttagtgttagattctttgtgggtaagtcattagtcatcaccgatattcgctagaaaatgcaggaagaactacatatatagtagacttgctacaaagatttcaacttactgggacaaggaagaacatatatagtagacttgctacaaaaattttaaaatacaattaaagaatttaatacaatgacaataaaaataatattattgttgtctttaattaaatagaacaactttttttaacttaaagtttttttagttaaataatctaaactcacttttttaattaacaatttttttaaaagggaaatttaacgtgggtaaggaaacagaggacaatttattttttaaaataattatataaaaaataaaataaaatattaagacactaaatttatgttaactttttattttaaaaattagcaaattaaatattatatattaaaaatgataatttgccctcccttattctacaaattaacctcagttcataaacatcttaacagacggtgtgatttatccgttccatacatccagtttggaagttacaatcatacagaatataaaataaataaaaggaaaggaaggggagggtaaaaatttaaaagaaaaaatgtagcagaaaaaagaaagaaaagtgcattatgttcgtcaaagtttggttattactataggcatccaaagttcaaaaacatatatatacagggtttcagaaaaatgtataacatatggggttactcaaactccaaaaaaaaatagataaaagaaaactataaaataggttgttgtaactgatcagtagtagacagaaaaagtaacactatttacatgctaaaggtcgaaatagaaaaaggtggattaatttttcttatttttttcgaagatacgggaggtttaaagtgtaatgcttttagaagttacgtataaatgtatcataaaaaaaatagacagctaaagatagtgataaccagtaggagttgctttaagttgagaaatgattatgataaaggcttaagctttggttagtgacttagtggtgggacatctccagcaaaaacttgaaactagatctttacggtaaaatgatttcgatggcatcccctatatatgatttgttttatatcaattcatatcatataggtgacaatagctagtgagccataatttttaacattatttaaaattaattagatttgttttataaaattgtgcatgcaggtgggttaacccattggatttgctattcagccagctgcgcgcgtctcatggtatttaacccaaagcgatattgaaatgagacgcaaacatacaagaagaaaaatgcatacattacattacaatagtttacattttacaatttaaagatacataaagccttcttaagccactctcttcttagacccacctcctgtcaactggcactggatatttattttaataatttgataccctttaaaaataaagtgaaataaaacttagagataagctccctaattgtacgataaactcatctctaaatatttcactagatatttgagtaacaaatttaacatcaagcatcagatactcgatcatcctaattgcacactaaacatggttcggttcaagggcttacgattatttttatttatttatctacgaaccactagggatcgcagaggtgtcttcatttccatggaaagcctaaggcattcggaaagatccacggtttgcgcgggaagccatatgaagtggcgaagaaggtgcgcgagccagagatgggccgtggccaagcccaaggcccggccaggacacaccctacgtccagccccgaagggtgcaagcctcaagtccgatcccatgatggagacatcttctttgaggaacctctcgggcttgaaagcccacgggtcttcccagatggacgagtcatgcgaaatggcccacatgttaaccattgctgttgtgccagctggcacgaggactttgtccacatggacatcatggaccgcaaggcgagcccatgatagtagcgggcctggtgggtgcagccggagaacttctttcactatggcctggaggtaagggagattcgcaatatccgagtctagcacgtgactgttttggccgacgcacgtgtcgatttcttcgcgggctttcttttgtaagtcttggtgtaaaaccatccttgccataacccattcaaggagtattgcaactgtgtctgttcctcgaaataccatttcctgctcaaaacaacaagatcatatatatccacatatataagcacatccacccattaggcctacatgaacaataagctaatgaatttatgtcactcccaatctgaatcttataaagaaagaatgagatatgcaaccactgggttacttgttaaaatatgttgacatcataccctacatcaaaggttttatttctctaaaatacgtccaatattaaaataagggcttgtagatgtcaaaactaattaaagtctcactgagaaaatatttatagtggcatggcgcgcactagattattattctttatcatgatgattgatgaggtactgatagtgaataatatatataagttaatgttttagaaatttcttgaatatatggtcatttcatcaacaatttaacctaggggactttctctactgtgtagctatgtgtcgtacaattaatgaatttatgcatgttaattaacaagtttaagatgataagtaaaataatatactaatccttatttgcgttttttgagggaaatataacgtatggaaaaagatgcatggttatattttatttatattattatccatgggatgagagagaggtccacactgagtgtggggttttgagagaagaaaaatgattctaggtagatagagtacttacccacagaatagccaccagatctgaatcagccaatctttcttctttgggcaaggatagcaaagtgctaagaaaatcattcttcccaacaaaccaccctctctttttcgctcttccacaatttgccccaccacactaccaaccttagccgccaacttgtggcaccttctcttcaccccatgaaaatccaaaaacttgaaaggaaaataatcctccaagttaaacatcgcaatcaactcgtacccttccctaaccatatcccccaactcctcactcttatcgttactgccaaaaacactctccaaaatattacaaagtgacccttcctgaaataccctccgaacctccacacccccttctcctccatctccctccacgcgctcttcaccatgtcgtcacccacgcgctgtcggagaccctccaagccatgaatcctcctcggagagaacatgtgaaacgccgcgatcctacgtaggtgtcgccagtaggttccggaggagcgaaaccaatggcacgctcgaacatgagagcgcgtgccgattcttttatcggacgatccgaaaacgatgaacccaacaagatttctctagcggtctcggggtggctgcttataacaacgggagtaggccccagactcagcgccattaacctctttgcgttcagcgaagtggctaaagccgcaagtttttggtgagctaaagagcccatgagggcagagtcccaagtatgggccagcccataggcccagtaagttttttttggtttgataatagtgatagtttctccatgcaaagcctccgggacaagccagtagttaagggaaattgcgaagagggttataaagagggtggttgttccaattccaaggcaaagacaaacagcgagtgttgttgaaggtaggagaaagaagaatgttgccgtgggtttcatgtttggtcaaaagaggaggaagaaaaaagaacggtgttattgttatccagagatggacgtgtgtcatgggatatagagcatgtggggatcaattggaatatataggggtggaaagtggataagttaaaagagcccatggttaaggtgaccatggttaagaaccccaggtgctatcttgttatgacgtgaagtgcactataacatttaactttatgagaatcagacccacatcttccgttccttttttctctttttaaacaccttgattttaggaaagcaaaataataatttaataggaaaaattttcaccaataaatcataaataatcatataaatgaatatgacatcacaccttaatctaaaatcttaaggtttaggtttatgatttttcttcacttatatgatgttcaatattttattcctatacgatgtgagacttacctcatatttgtattccaacaatctctccttcaagtgtaagtttcatctacataatagtctttccctcaattgaagtcattttcatccacgagtatttctaggatggccattagagctttcatgctatagatacttgcattgtcgctccactcacgagatacaccgcatggaccaccgtcaggaagacttttgatgcaaggaatccccagccaatgatccatcaccgcatcttactcgttcgagctggtcatcaagtcgaacacttgatacagttgttagcaatatcaccttgaattctaaaggaaatgagagaaatcacacacatacacaaatacaaacacaagagatttaacaagatttggcaagtgcgcctacgtcctcggagcaaagcgatttttttaaaccattaaattcagaatatgataaagtactccagggtgggagaactactcctttgatgggtgttgcaatgattctatttgcgatatttctatctattattttggagatttataattcgtccattttactctacggaatttctatgaattagattcacaagaatcgagtaattaatttttctatccattattgtttggtagtttattccattttgatcatggaatttgtggtttttgtattttggaatgagtgtgtgatttgttttaattgatcctattgaaagtacaaaacataaaatggatttgtcatcttgatagagatgacactcgaggtgaaatcctacatgtgtaggaatgagaaggttaacactatataagtgaaggaaaacataagcgttaagattttggggtaaagtgtagtctcaagttcacttatgtggttgctcatagcttattggtgtaaatctccctagtgtttaccccctctatttcccaacaattggtatgagagtcgatgattcgacttggtgaccggtttgaacgagtaagatgacggcggtgaatccttggcatgaggatcccttgtatcaaaagtcttcctagaggtgagtccaagaagcgtgtctcgtgggtggagcgacggtgcaaatatttagagcatgcctcgaggggaaggctaccttgtggatggaactcacacttgagggaagattattagagtataagtgtgaggtgaagttcacatcgtgtgggaatgagaaggttaaataccatataagttaaggaaagatccataaatatgaaccttaagattttaattaagacgtgatgtcatattcaatagataattttactaaacacttatgattcaataagataactttcaacatctaactaactttttaactatttttatcaaacataaccataatttcatttaattaagttatattattattattatgcacacttacgtaaagatattttactttatcatttaataacatattatcatatatattaagttaattattttttaattagttaacattgtgaaaattattatactgatgatgtacaaaaatcaaaatcttattattatgtgtacgaaggtctcagtaccctagtggttcttactatatgtgtgtgatttagtaagtttgaccagtaactcactaattaaatcaacgtcttagtaacctctaataatatattgacactaaatcagcaagtcgagtttaataatattaatttaataatttataccactaaaaaaatattaatttatattggattaatataacaaaaggattttctttccaaactcacgtattgttgaatcattataataatggtttaacaatcacaccacttatagaataaaataaagaatgagaatattcagatgcattatccttatatattaggtacattgctttaatttacacttatttcaaatgctttatagatcatctttatattgaatttttgtacctaaattattttattttcatgtacgttaataaagcattgcggcctgactcaaaccaattcgtgtttatccatctagggccttttaatggctataatgtcacacccagccccaaaatatttggccaatttcttggaggcttttatgagtggagaaattatacttcctagttaagtagtgatgacccattctcatgggatgtacttggtaagttggtgttcgatcagttcatcattgacttttgccatattgtccattggcatgtatctagttggcaattaccatatttgagcctgatttttgtttattttctatttttaaaactaattgttttgaaaaaataaatttcggtaagagtaattttcaaaaactgtttttaaattaatatttctatcttaatttaaaataaaggaaaataagtttttttttttaatattgcctcattttcttcttctttttctaatctttaaaactagttttgaaaattattttataaatgatttttggagacaaaaatcaaacacatctcatatcactttggatttcttaaacaaatatttattgaaaaattaagaaagcaattcttttatgaaaaaaaacctttaaaaattgagatgaataattattattttttggagggcgtcaccttgatgaaataaattaattttaattttaacaataaattaattaattattcatttttaaagcgaattactttcattttataaatacttatagcaaaatttatttaaagtggtatttgataaagagttttgagtttttaatattttattttccttgcatttcttctacatcttctcctattttatattttttgtgatactatttatcattcattacttattttatttattataatgaagattaagatgaattgatcaagcatgtacataatcagataaggtcgttatagtaaagaaaaaatactgacattttttaacactttttattattattacagttataataaaaggataatttaactagatcgcttcagtgatatgaatactaaattctttcatgcgcagactcttgtgaggagaaagaggaataagattcatgatttattctttgatgatggaacttggcatattgatccgaatgatcttcgtcaggaaactaccaggtattttcattctattttctcagaagatagttctccttctcattcttcctttgaggttcagaatatcccccaattgaatgaggatgggaatcttgatctttctgctcctgttacggttgatgaagtcagaatagctgtgatgggcataaaatcattcaaggctcctggccctgatggtttcaaccattcttttacaagcaatattggcctatcgtaattgatctctggaaacttgttagagatgccttcctttatggcactgctgatccgggcctccttgaaaccttgcttgttcttattcctaaagtggaaaatccaaaccatttgaaagaatttcgcccattagcctttgtaatgtggcctataaggtgattgtagttagactccgtcctttcttaactgagcttattgacccctttcaaggaagttttatccttcgatgaggtactatggataaccttgttctagcctaagaagtggtccatcacattcatcaatgcaagtctagttctggagtgcttgctttgaaaattgaccatgaaaaagcttatgaccgcttaagatgggatttccctccgagtatcattcgcctaatcatgtggggtgtaagtggttcaaatttagctgtattgtggaatggttcgaagcttgataacttttctccagctcgaggtctcaggcaaggggatcatctttccccttaattatttgtttgttctctgtatggagaggctagcattgaggattgatgagcttagggagaataatacctggctccctatctccctttccagagggggtcctcctttgcaattataaatattacaacaacatacattctaatacaaatccaacatataaaaataaaacaaacgtaaaaagaaaggttttgatccgttaataaaattattttttcctcaaacataattttataacggattctcaaacaatgctcatgctcttctgctctccatcatttacagccaatagaaaatcaaccagaagcagcacaaagtgaatggagagaaaaggaaaaatgaaaaaaaaaattagaaagatgtaaagaagttggaaagagctggagacagtcttggctgcacatgaaccaagtcatgtttcatgagcatgttcgtcctggaacatgtgagtggaaagtgaaaacaaagacctgctatttatttattattattgtttaaaattcgaaccgaccaactcaaagtcacagtaaccccttcataagcaacgaatgttgataacatgaattaatcatttgatattttacaaattactataatgcaaaagttgtgtagtatgtacattagcataggttatagcctctgctatgtttgtcgctttagaggcagaatgtgcatatacaatctattgactctgagactaagatttgctgagccccccccccgacaagcttgtataaagtttccacttctccgtgttaccgggcaaagatatttaatttagtcaccggtcaacaacattatgcaattctaagttatttttggaaagaaaaataataataatttgtttttaaaaaaaattaatattcttccaaaaataaattcaattaaacacaaattaaatataaattctcatacacgagtgagaaataacattcatgttcttgttccccattttatttatattgcgtaactgtgacttagccgcacatgccactgataaggaagagcaacgtcatggcttcgcttttcacaatgcttggattcagaagaaaaaaaaaaaaaaaaaggtgggaaatattcctgttttggaggggtggaggtttcacctgattagcagtttagcagtctgtttggcgaaacagcgagaaaaggaacacagtgaaaggaaataggaaagtgaaaaaataaataagaaatatgatgatttttttttattaaagagaaatattaaaaaaataatgtaaaattataaggtttgtataaaaagataaaataatttttttattaaatatataaaaaataatattttactttcacgtaatgtgtagcacacaggtcattatgcgtatatgatagattatacagcacacataataaattatcaacacaaacataacaatttttcatggcattggcttaatttggttgattttagtgtgcatatatataatcgattatatgcacctacaaggacgatagtcaattaaaatatgcatataatcgactcatcaaatccatcaagagctgcacaagggtttagcaagatgagcaagtgtgagaacaaacaaggattagtttaggaaagtaaacactgtgcgtccatttccaacctgtttctcttctcttaagcgagggaataagaccatagtaaaaaccataactttaaacttatcacctttctatttcatttatattaaacaacaccatttttttttatcatcattacgatttctactccctccactcattttttatgtatttctatgctaatacagtgtaaataaagttatgtttgaatatataatgatgaaggacaaaaaataaaatagaagtaaatgaaaataaaacattgctattattttactgcttagatgttttaaaatgaaagaaacgagtatatcccatattctaaattttacaaataatgatattggaattttatcagtttcatttcattattttatcatgttttaagcaatacaaacaataaaacttgaaatcattatatttcatttttgtttttccatccaatatatatagcctaataatgaactcacttctagacttagataacctggtgcggcccattggtctgattcaaattcggtgacttgccttttgggttagtttggtgaactatagaactgctttttgtgtaatatggttgacttgtttctaattttaatttttggcctttagtcaaaataatttttttgaagttaatttattttgcttgggaaagttttgactccaatgttaaattacatgttttaaatattataattaaattatattctatttaaaatatataacgttttaatactatattctgtttttttattacttttttaaggtttttttaaattccttgacttattaaattaattgataatatcctttttgtgaatcgacctccgatccgaatcacacacctatgctcaactatgtccacatatataatattcatgaaaatgcaatgacaagtttatctttaacaattatagattcttcttttattgtaagctttttggatgactttgctttccattttcttctctttttagtatgtgaaaggacaatcccttacaataatatgccttaagccacatttctcattgccatgtgttactgcaaatcttacggaatgatttttcccagcattcaataatgcaatgtgcaaacacatccactcatttcacagttggaataagcaaaaactggacatgtgtttcaccgtggcatgtgctgtttacctcgcagctgaaccggtcacaatcatgtctgtggttttggccaactgtgtttgtttcaatttcttataaatttaattttgcatcattaacataaaaaatgaattataaaaatattttatatttaaaataatgttttaaaatatatttaaagaattatttttactttaatataaatactttttaaattatgaatcttatatgcatgagtggttgcacttttgatcctcaagtattataaggatgtcaatcgaatttttaataattgtaattttctaattaaaactattttttataataaaaaccgcacaattctcgcataattgtgatgtatacatgggaatcaattaataaaattaaaatataaggaattaaaatttcatatttacaatacagaagagcctaattgatataattcaaatttaggtattaaaacaaaaatactttcatttatattatatcacattttttattttaaatacttatatcatttaatatacattttttttcattcgtacttttattttcactcatcaaacaatttaaaaaatcaattcactttctattttttcttcttctttccttttactttcttctccaaaccaaacatactattagttggtgttatttagtaatgaaagacaaaattcttttacacatcaagattagaaattaaagtatgtttttatcacatttaattaataatttttcatatataaaaggattaaatatgtttttggtatcgaataatatttaaattttgtatttaatctctaatattttttttcttgactcttgatccctgaaaaaattatattttatctctttcatcagattgactttgttaacttaatacatcatcatttgattaaaaaaacaccattggttgtgataaaaaaattaaaagatcaaagaaaaatccaaaaatatttcagaaatcatgtacattctctctagtacgaatgaaaactttttagatggttcaagtattctctttacctcgtgtgtcgcagatataataataaaaaaaaagaattctttagtctttgtattctaattttgagatggtattatttaaagctccttttaaggagtactattgtgcaactcaatgaatcgccttgaattagtggctaaattaaacctgaatccaattacagatcatttaagcaaaccattgatatgtgctataataagaaacatggttatcccacaacccatcaggaaaagttgttcaatggataattgtacaacccttagagaatacatctcagatggtgactagactcaaagagggtatggagagcacaagtttcttcttgattccggagtggcataaggctttgttggtattgctactagactctcgtcaaaggcacagtacaaatccaataacttactcagacgtcaagtattgtgtgtaacttgtttgggtcttctgagccaatttaatgggtactcaacactggaattatttagtatttaccatcatatatatgtgcatgtcattccctacataagtttcaatgtcagaaaaataaagcctgtctaaattaagttgtaagatggtgtgaaaccaacaaatcttaattcttactaacatgtcaatagcatgttaaattttttaataaattcttttcaattaattttagaattttgtgattagatcgccagagactaacaccgtaatcttcttccattaaataatattgacgtgggaacctctatccatgaattctctttcactcccatgccacactctctctttgaattttgtttttcccaaatcattatctctaaaatgactaaatcccctatgtaatggtttgcatccatatggttaattttcctagtcttgtcttccatcaaaatggtagatgaaaagaattaaaataagatcattggcgataatgcaaacattagtttttaattatatatatatatatatatatatatatataaatatataaattctgacccatttgcccgtatggcagtatacttgctttgtcctcagacagtggaaatgaagcacttgaataaatccagtaatcgtacgtttttattccaattccttctcatttctttgcttgatcactttttcatgtgcatcctttatttgtatgtctaccgcattggtgaaatgggagtgggggtactactgcttaactatttataagttataaccatgggcatggcatagagtactttgggtctttcctttttttgcttcttacctgtgtttaggagcatgccatgattgtctttcaattattatgtgttaaataatattgctcttatcctttttgaacaattatattttttatgtaacgagtattttagaaggaatttcatcttcgttcttgaaatcatatgtatgtcagtggaatgcaatttaaactctgcattgtgcttcttcttttttttcatttaatagagatcttgtgcgcatgtttagaagaccttttctttttggtagttctaggagacctttatttcagagtgaataatcacttattttgaaaaagttatctcacaaagtggaaagaaaacaagagattatttttctcaaaataagttgaactaaaagatacataagtattcacctaattgaattataaattaataatgggatagagatatcaagtttatgcttgtccatgtgataccacaagtttgtgacagatgttaacgaagtgagttccattgcattgattaagatagatatgctaataaaggtttttataatgcagcagatatatcaatgtgctgttgtgagagaaaagaagaaagcgagcgcagtactagtgtgaatgtgcgactgtgcgagatgtggaatgcaatctaatagtctattagaatcaaaaaagcaattaaagaaacagaaaccagttgaagtggttgggtagttattgcttcttttttttaacaaagatttaacagtattagttttaaggatttaataacaaaattttagaattataaattatagagatttaaataaaattataatttaacccaagaaaattttcttaacaattaagaaaaaaatacatatgaagataacaaaaaattgattttatttaaaataatcaagaaatatttttttttagttacgtcatcttcatgttgatgcttacaagtgctgcttgattaagttaagcaacgttagtacgttacttgcttgacaaaatttattattgtaatatttcttatagaagtgctgttccttatataagtaagtttttttctcaccaaaaaaatataagcaagttttttttctttcaaggaaagatacattccttaaaatttgttaatgtttttttatgttttgaaagagagaaattaatacatgttaagatcaataaaattaagttaagtatttactttaaaaaatttagtattagagtaaatttttgtgtaaagtacttaaaatttatatgatgttaaaggattcataaaagataagtaaactcatttaagtaattatgtattgtggatgttattagtagttaaatcaattttaattttaaattaaaataaattatatacatgaaagagataaaaaaaaattaaaaatgtttcctctagtctcgattataagaaaaaagaagacatgttttatatttattaagaaaattagttaatttcattaaattgtatcattttcattaaaaataaacacttttcctaaatcatcattcattagaacttgatatcaaatatataaaaaaatcattgatcttattaaatgaaagatattttagagaaaatctcattgtaagtaattgatatttaattacatttaagacaaaaaaattattacttatatttaagattgaaggaagcatatacatttaggataagtcatgtgtcttaatgaaataataatatcttttaaaatgtgtttttatttaagaaaaacttttaaaaatattggtttaaataataactcttaaaaagtattactgtttaagaatcattcttaaaaaaccactcttattcaaaataactatttttaattcataaagagagagggaattaagttaaccctgaatatttaataatccttcctctataaacaatcgtgacttagaactggacaataaagaatcaaagagcgcaatcaccaaatagccatgtgatcatcttatgaacccttcatccctccaactttttggtgtttgtagtttcatttggtttattaaaaaattattcaaattaaacataaaaataatatgtaatttaattcaatttaaacacaatattaaatttgaactatacatcaaactaactttttggaaattagtttaaattggtttgatagttttttaaaatatatatatatatgacttttaaaattacttttaatttagcaactaaccaaataaatttacctatgtaactaataaaaattattagcaatacttgaaaataacatttgcataactataggcaacagagtatcaaaaatcgtagatgacatattacaaaattttataaaaaaaaaaaaaacattacaaactatttatagtcaattaattatgcattatcaatgtcataaattcataatttaattaactaaaaaaatgtttggtatatatgatattgcatattatcattatttaaaagatataaaagattggatttcatataaggatataaaacaaaaataaatataaatacaatatacaatattttacaattggatttgatttaatttccacaatagaaactggaaaacaaactataccaaacaaatgttttgtcatttaaaattttgagaataaacttttaacatctttaattctaataataataaatatatttttaattctatatgttgttaaatttgcttttagttttccaaaaaaaaaaagttattggttttagtctataaatttaaaattttgaaaaaatattatttattgtcatatattaataatataatactaccactatgtcacttcaaaattatcactaatatatgacacattaccactatgtgaatatgtgataacaatcaccatttaaaaaatatatatatgaaggcagaaataaggaaaataggattgagtaaaggatatgtctgaaaactgaagagtggagaaataaaaaagaaaatgaaagtgatatttactaaaactacacaacatgtctcatagtacaagacttggctctgcctttttgtgtgttaggccctcataaacgtacttgtaatatgcttgctagcgagttggtttctttttcaagtttagtggctaacccaatatggttggcatctattggataaggttccgttttaatgctggcccaaatccctaggagtcaaagggaaaaagttattgggcccaaatttcgaggtgttgacctcggcccattaccatttagggtaaatctctaaatgtggtacctctctataaataccctcattatagatggaagctggtgacgaagggattccagagagactgacgcaaagctgcggcagtgagagaggctaagcaaagacagagagtgggtggtttttcttcggtattggatcgttgagagtgtctccgagagctgtgagagcatcttgttgagagtgtttccacttctgttgtatgtgaggctgagtggctccggcaggtggccgttgagcgttttgtaaccattatttctcaatagtggattgtttctggacttggtcccgtgggttttcctcttggaggtttttttttttttctcccacgttaagctatttgtgtgttgattctctccttatctcttctctcgtgttctctgttttgtttccgctgcattttactctgatttggttgttgtggattgagttgtgcaactccccagtgctaaggttggtagagagaagctcccagcagacaagaaggttgtggtgccgagccggatacgcggtgtcaggtagcaaattccacaacagcatcaacccttctttaggtcatgcatgctttcttaattatatatttttttttttgccgacagtttgaatttcttttgtcatcctcgacaaaataatagcattctgttaagtcttcaacaaatgagtattgttactactttattctattcatcttatccttacatatccatctaatttttagctatatattctctataagcattacctatatactttgattaacacacacacacacacatatatatatatatacatacagcattatagctgggggtggggggtttcctagacggttttcttggtcatatattcgttgcgagtacgtggttacaaatttgaagcaccgttatgcattatccatataatacaaatttctattgtgtcactacaagttaattattggggttctattgtatagtttccagcaaatcatacaatttaaaatcatactaggaccactaaggaattttagttacatttaactattcaaaatactatggggatcacagataaatcaaatctgtaaagtgttgaatactataaatagtaaattataaccgggattcttcctagatccaacttccagaatgcagtgtgatcttttgaaaaagcaaggaagattttggctgacgaaagcgtccaaaatatattcagcatatatccaatattttctatgcaatttttgttaatgttgtgattgttgtcctttgtcatagtaaaatatcttcagcaatgtttatatcaattatttgtatcctaaagttgaagaagacgcgtggctatcttcgcacccattcaatctaattgctcttgtcgttttagcataggggagggctccattcttctgaaagcatgaaatccaggatctaaaatactagaattatagtatttagaatccccgttaaccaatatgcatatcattgcttagtgaagtgatgattggattaaattaaagcaccaaatgaatggccaaataagagttatagcaaattctcatattatttgaatatttaaatcaaatactaatgaattatgttgttaaaagaataattaatatttcttatttttatgaaaaaataaatattaaaaaaaaaaacatgtaaaatgagaccaaccaatgctattacacaatgtctcaaaagaaagatcatcaacacatgcaacaccaaaaggattctacagaagacggtttattaaatataaatatgtaaaaggtgggttgtctttgaaggagagaaaatgagagctataccctgtagcagattcttccggagacccttggaagaaaacttaagtggaagaaaacttttagatactttaacatatataatactaggtgcatatcataaattaattatagactcatacgcccatgatcgacccaatatatatttgtgaacgttaatgggaattaataattaattaaattgtattgtttgaaatcaccttcccctctaaatggaaagtgacccataggccgcctcaagcacctattgatcataccattaaaagaaagtggtgggccttgttgaccatcaccagcaatgcaaccctgagaatagttattatcatcgttcaatttcctatacatacgtgtattctagcaaatcaaagataaattaaaggtgcattctactcatgattacactttccttgatatttttgtggtgtttgttttcatgttgtttgattgagaattatgtcaagaatgcgtgtaattaaaatgacatcttttttagtaatatttcaggaaacacttgtcctctctacagatgcaaattctattttctttatgttgctaaaatcctgtttagtgagtcccttttttagggatgtaccttaagtttcaaggattagttgagggctaagattggataaaattacttatcatttaagcgagtacaataatttttttaagtaagtctctattgatactcctaatatgttattaacaatattttcggtaatattagaggtatcttctcaatttacaatttttaggtaatatttttaagttaacttttttaggtcgatcccgagtcgaatttaattctagctttttaagcgtataatattatatatatatatatatatatataataaagaacagtgttatatgacacaataaaattatttacaaattttatgggtggaataaaatacatattttagtacttttcaatccatgaaagattcacttagaaaatagtctctagaatgtacttaatagattttggaaataaatttttgaaccatttacccatttccaaaatcaatttgagaacgtagtttttaaaaaaataattttagaaaaatattacaaaaattacaaaaaaggaggtgtctaagtaaaaagatgaaacaaatagcaattgctctattttttgtgttaatttgttgtttctcctaaatggtttgaactcgatccatctcattcattttttatattcaatttttggcatttgtatccaatatgaatcctacacctcccaaaaagtgactcattataaattgacttattatactcactatgaaactaaagatactgatatcttggaagcattccaataaactactcaatatgataagtaaatcccatttaatggtaaaaaaataatgaaacaacggtatcttaaaataacttattaaataactagtgccggaaatacttttaatttcatgcatacgtgaagcaataggcttaatttaattaccttaaggagtgctgggcttctgaggatgcccttttgcttatgagttctccatgtttgaaaataagtctccatgattaaggggttaaagtacagagaaaattagagtgtggatagatgaaaaaagaaaaaaaaagtattttatttgatatctactcatatagagagtagaaaagttaaaatataaatgactcttgattaatgttattgcgtttgttcgaattttctttgctttgtcatagtctagaaggattgttatacaaatgaaaaacgagaagccaaaaccggttcaaacttcaaacgttcgcgtcacggcctcttctgtattcttaatcttaactcatagtcaatgatcaatttctcttaaattaaaaaaaaaaaaaaatcaacaggtgaaaatcttgtttattaaagttcctaacaattgaaagtcatgtgaccattgttgttaaaacgtaatttcaactcggtagaaacggacgttttaacatttttgcttcaaaaatgactcggttgaaacggcgagttgactcagtttttttttttaaaaaaaaaagggttaaaagcttactcccctaggtgcgctgccactgctggtcttcggtcttagtgctttgtctgcgtcctttttcttctgcgaccttcttcgtcttccactctcccttctccgtcgtgtgctgcgtcgtctgctgcttctagtggtggcgctgcatccgtcatctttctttcttggtggcgctacatcttcatcaatcatcatcagctaatatcttagtggtggcgctgcatccgtcgtcttcctttctgtgtgcttatgtgtttgggccagataaattgctttttgcactcctgttatttctttctgcagtgttcgtatttttttgggacttattttagtatgtagtaaattcttccgtttcgtttacatttcacgtttttactcaccctcaccgtttctgcgttgacactacattttaacaacattgcatgtgacttgtttcgctgaagaacctcaagagcttctgtaactttaagttcccattattgaaaatattagtagtgacggcatgttattggtttgagtacaccaattttacaaagcatatacatcatactcctaacatgttgttagtttgagtaatacaagatttgattttgttaaataaaatcttgagtttaaaatttatgaaagaaaaaataattaaaaagaaaaaatttcattataagtgatcaattaaattttttagcaaaaattaattattaataaaattaataaatatttcacaccaacactaatatatatatatatatatatatatatatatatatatatatatacacacacgttgtacgtgacgaaaagagaaaagaggatgatgctggaaaggttatttaaatgctaaaaggctgcaatacaaaaatattcaaggaagagttatataatatgtatgattgttttgactgaatttttattttccttgttatttttctcctcttttaaaagttaatttaaaataatgaaattaattttcttaaataaaaaatgattgaaatgttgatgaataaaaaaaagagcaataaaattgaaaaaaaaaataataaggcatgccattttgttgccgtaacataaagaaacgtgcctgtgattttacacgggtttagtcaccaacttgtactactaccattcccaagctaagcttgagaattttttccattaaacttgagagtttctctgaaaggaagaggtgctgatagaaactaaaccataaaaagtttgctcatactacttatatatagggatcgaaatgttaaaatggtgtaattataagaactaaaacatcgagcttgagatatgttattgccacatcaccgctacgtcaatgtcatactaccacaatgttaaaagctttagaggagatttgacgacaaaaattaaaatgtaattaaaaaatgtatatgcaaagacttaaacgtgtaatttctaaatatataaatcaaaacttaaaaataatacaaatgcaggaatcaaatgaattttcgaaattcagtccatttctcctttggaaatttaccaaggtctgaaccggaccgaccgggtgggaccttggatttgaaacggatgacatcttgtgtctggatattaatgggaaaaaaaaaaaaaaaacgacaatgcatggttgctgcattattttctttaatcccttgattcatttcctgcataaggttggtcctttgaacattgctctagttattgtttttttgggttttattgcagcaattgctacttactggttcactttttggccttgctaccttctcccacttgactgttgaagctcttggagacacagcagtggtaacaaaataacataaaaaaaggtggataatttggagattttgaaaattataggtttaaatatcattttaatccttgtaatttagtgattttttttttattttagttgttacaaaaatatttttttacttttagtccttacaaattatatttattttattttcatcattatgacactttagataactttttttcattgttcaaagcatagttatcaatcctggatagcggagccgagcggccgccctcaaaactggaatagcagatagcgggatgatcgctattctaatgtttttatatatgtattaaaaaatttataatattaatatataagctgaagaaaggaaaaaagatgaaaggaggaaattgagaatttatagaaaatgggaggtgaagaaatcaagtcccattgtggagatatgctagagcccaatgtttcaatatagcccaaaatttttcacagaccacacttgctccatgttataaaaaattgccacttttgctcccaaaatttctcacagaccaaccacttgcttcaaccttttcaccccttttcacacttctctctcacttgcgtcagtgcatcagcatcacacacaaacaaacactcccagtctctctctctccgactctaatctcgcgatgttccgttgcgcaaccaccgcctctccaccgacgtgtcggcgactcccacggcggattcagccttcgcgaaggtgtggaagaaagtgagccccaacatcgacccgtcgaagacgccactagcgtacattaagcccagaccactcactccctcggctctcccatccaagctcacagtcaacttcgtcttacttgtgactggtgagcgcgaacgacgggccggtgacggtgagaacgaatgtcagagcgaatagtgaatcgtggacgcgtcaccgcaattgcacgcgcgacgccaccatcctgtcacgggcacaacagccgcaaccgttaaacgcaccgctactctaccccttatagcggcacatgtccgctccgccgcaatcgtggctgcgacgcccgctattaataactatggtttaaagctctaaagtattttaaggactaaaaacaaaataagcataatttgtaaaaaataaaaaaaattacaatgaagaaaaataaaaataaaaacattaaattgcaaggacaaaaatgtatttaaaccaaaattataaaattaaaaggaggtacaggaagaaatatgtgggctgcaagaagtaatggcacggcaaagtttatcacaatgattgtgtttggacttagacctattggacctcccattattgggtcattaagtagagggatagctaatttataagtaatcttggggttaaatccaattctaagagaagcgaacaagccaataacaaaagctattatcaaaatctcttataagctattatcgaaatctcttataagtagaggtataaaacctgcaaagcattacaaactaatttatttgcctttgttctccacaatcctgccttctttctatagtttcttggctataaagtctaaacatatactgaacacaagttgtgtccacccaaaaacaccagtaacaaatttgtcaccacccaaagatttgtgcacacacacacacacaacttgtccccccaaaaacaccagtaacaagttggtcaccacccacacacacacactgaaccatcttcattattgttgttatgtatcccttccctttaattaaagagattaaagacatcggcaaagagttacaccatccccgatcgaaagaattgttgattcaatgcgagtatcattcgctatataggtgttgaattcgagtgtaggcttcctattttgccaaaatctatcttccattttatcgttgttctcagacatagccaccgtaccaagccataaggtgttgtcgtatgcaattattccacctttcttcaccaattttaacagcagctcgtgatactttataaaatttttcttgtcagcgtccacaaacacgtaatcaaatgtatcttcatgtttgccctgcaatttatcgcagtttatttttatttttcattcttcaaatatcaattcaaagacaatagataaaggatgttgaataaaatacaaaactcactttgtttagaactactttatatagagagagagagacacacgcgcatacacacactcatttttataaatgtaggggacaaattcaagataataaataaaacttaagcttaataaaaatgtaaagaataaatgatgtaattgatatatataaattgacaaagaaaaataaataaaatatgtatcataagttatttttaatttttatttaaatattttttacaaatttcctattaattactagtttacataaattaatatcatatcaaactttcattatctttctattaatcattaaatgaaatttaaaatgagacacttaattttaacaattaaacaaatgtaaagattgaatataattttttaaaataaaagagactaaattacaaataagccaaaatatgaaatctaaaaatgttatcaagccaaaaaaataaaaacacttacatttataagatcatggagagcagatagtgcatccccttggataaagtcaattttgtgctccactcctgccttctgaatgaagggcaatccaatcccgtaagcttctctatcgacatcaatcgctattatctgcaacattcgcaaaattcttttcacactttgttcattattttatatttcatatgtacatatttgtgtaagtttagaaaacatccatcagaataaatgaaagcatgataacaaatacagtatatgaaaaaattgttgattcgtgtgctagccgtggctgagattacataggaaaaaaaaaggaaaatgtttgatcgacactcaaatgttgaaaaagttaagagaaagaaatgaagatgtaatagataagatgatgtgataagagagaaagagaaaataaaggttgtcaatgaagtagttacactgttgtgatatccaaaaacaaaaattactataaaaaaatgttaatgtgataccttgccatcagaaggaagagcgagagctgtagaaagaagagaataacccgtgaaaactccaatttctaatgttttctttgcgttcatgatttttagaagaatagataggaattgggcctcatccacgggtacattcatcatgctcctgccagtgccaccatacatacatacatacatatcactatttttttggtattaagggggccaatggcccaaaaccaagaaagacttagggtctgtttagataagattctttagaagcacttttaaaagaagaaaataagaaggaaaaaatgagatgggtttttccaaaagcaaaaataaacttttcattagctaatttttagaagcttatcaatataacttctctaaaggatgagatgacatctataaaatgagctaatggaaaactcattttagcttatagagaagctcatttcattattttcttcttattttcttcctctaaaagtgcttctagaaaaacttacatccaaacaaacccttaataagacattgcacaaggtgctgaactagctgttttacacatgttaggtgtgtgtctaatagaagacttgctcccatctgtgttgcatttcactcacccaattggagggggtacccatctaaattcaatgaggctgggtggtatatgcagcatgtgatttagagatcctttcagcattcaattgcatgtgaatttgattatacacaatagaattccttatgtgccaaatctcatatatatacagcagctacaaacagacttggccaagaaaaaatggtgtcatgcaagggaggatttaaagggcctctactgttttaaatcaggaggagggacattgagggatttccaaagttgaacaagagcaacacaatttcaaaagatgtgggagagagattcacaaagtctattacatataataggacagatagtgattgttataatgccccttttaacaagggccaatttagcaacacaatctgtataactggtttggggcaagagaaagcgatcaaatgataggctgtgttgttgcatcaggggtaaggttccagatgaatttgtcatccccaagattaggtcttggaggtacagaagctataatatccaaacaatctaaaatgggaagcaagtgagaaaatttagataaattccataggccactctcatcaacatactattcaataatcttggatgacacctatccacctaaattgacactcatttaatttgcaattgcccatctaccagctttcataatccactcccaagtactttgaatcgccctccaaacctttgagcaattttgtttctttttcattagtggtctgaaacctgatgtttggcaaagttccaattccaaggccttagcatgactgacattcttagaaacaaataatctggtttttgttatagaggccttctggccagaggcttaagacatcaaggcacttcatgatagtatccatatgatatattaatatcccccaaaagaaggaggccatccgcaaagctaaatcactatgtatgatgtacgttccttgaccaaatgtgttacttacatgcttaattagaaaaatcaaaaagaagaaaaggaaaaaaactgtaagatcgatccagttaactaattagtaattataagttcataacagctttgaattaattttacacatgcaactagataaattgtacgtgactgtaacttacttaaccccgtatttctgcagtgttgtctctcggagttgcttcaattgctcgtgctctttgggatagccactcgtttcaaagatgtactaggtaaaaaacatgcagaaaaatacagttaatgtgtactttgtatattgtaaggaagcacaaagtatgttgattgaattaggaagatcacacgagccgtatacatcagaataaatggtttgcgagaagttagattttctgaatggagatgaagatatgcaaattcttttcatattaattttgggcaaacgatgaagctagactgataattgattaataaaaaactattttacacaaaattgataaatggggcttgtgggggttgctgatagtgccgatcgcagaacaaacatgatggtcgaggtgtttcattttgcttgcagagaaagaattgatgattatagcaaattaagggttataatattatattacatgtatgagattgatttcaagtgtatatgcatacatgaagcaataggcttaatttaattaccttaaggagtgctggacttttgaggatgcccttctgtgctgatgagccctccatggttgaaatacagagcaaattgcggggtgtctttagatgaataatgaacttctcaattttatggctgtagagtgtagagaagaatataaggaacttttttttataaataagaatataaggaacttgagcgttgacgtttgagatcagaagcaccattccctacgtggcagtcggccacacttcccgtcattctaaaatgaaaacaacaattacttgacacacttaggtttagagatttttagtaatagattataaattgatatcttacattatttttttatagattttttaatataaattaggattgaagatttcttttttttagtgtgataaacttcattttaagatgttaaagagagggaaaaaaattattttttttgaataatatgtatatcttcaaaaaaacttataaaatttattctttttccttttttattataagatttagtgaagatcggatcttaaactcaagatctagcattaaagatatttttaaatctaaagaggaagaaaaaacagaaataataaaattataaataagacagataatttgataatttaagaaaaaagatatcaaacaagtatttgtatttgtaatatagaaatgtctttttctaaaattagctgtatgaaatatgggcaccgcatataccgctgaaacttattcgactgtgtaatggctgatgtttataatatgaaatagaaaaatgctaagtgaagacatttgggacggaatacactgatgtaatttggagctaaatttgctacagcaacatctattttattctcgttaaagatgtgattgtttgtgtgtgtgatcatctcataaatttttttgatggaatgacaagtcaatggattatcataaatatttgttacttgattgaagaatctaaaatcatttatttattttacatagactaaaaaatctttaaaagactaaaacaaaaaataagatattttataagaaccaaattgttatttaagttaaaatcaaattacgaacaaccaacatcaaatggaaaatgtacagaaaaatgtaagcaaaaagtaaatgaattttaagattaaacttagttctttagcatgaatggagatgtacaaattataaagtgagtgaactgtagaacgacaaagtggaaattgaaatccctttctcacgtatctcgccccttcctctgagagcaaatcttcggttgcacaactagaaaaaatcatgtaaccccattgcccgaaggctccacgctatgcgcaggtaagggggaggctgtttccgaattcgaacccatgaccaacaggttggtcaccaagacacaactttaccgctgtgccaaggctcgccccttcctcctgagagcaaatcttcggttgcacaactagacagtccatatttaattgaaatgacccagtagaggagatacaacaattgtctaggaagtggcaatgttcatgaacatcaaggccccaagtgagatgtcactaaatgcccaccaaattagaagccaatgccaaaacaaatcacagattaaaacttattcaaaaatctgaatttcaaaatgttgagataagaagatgtattaatgatattcctccctttcaaggattgtcactgtaactgaagaatgtacaagatcaacacgaaagctccaaaaatcatctcctctgccaccaatctgggatttttaacctccggtttctatgaacagaaagtttgacccctggaagcttgtgcttgacctgtctccacagcatatcaacagcatcttctcttttggaggatattggaattcataatgatgggagatgttttttagttgcctccacatttcagtccatttctcctttggaaatttacgaagttgatcgatcatgtagccaggctgtaatgcctctttgaaagagaagaaaaccgagaactgggagtagtcaatctcatcctcaaatgggagttcaatttgatcactcacaatgacaggaatgcaatgactcacaatggcatcaaaaagccgacaagatgatggtgtgtctcctgctggatgcaaacagaactttgatgaacgcatccctttagatgactgttgtatcaagagcagtggataaaggaacactatagttaatgattttagcatgatactaaaagattaaaaaaaattgactataattcctctcccctagcaaagatagtaactcatcttggttatattgcaaaaatagtttcaaagtctttgcaccctcaaaatgaagcatgtttttgattcaggatatcatatgaatgtttttgagagagagaaagtgagaaatctaaaactagtactatttcaccaatgcaagatttatcaggtttggtggggggagctcgcaaacaattcattttgtctacagaaagcaaattgtatctcaacattcaagttctcagagtcagaatgcatggggaatacaaaatgtagagaagtgcagcacatgggtagttcttattgtgtaagttatctgaaatatctttcgcttttttaaaggaatcctggcctttgatttacaatgaagaagaaaatagttgtaaaatcaatcttttaaatggttaaccacaaatattccagctacaggtaaagtaagcaaagatcaattacataactatactgcataccgcttttatgttctcttctgtagcaacacttcgctcatagtgaacatcatcataaccagccaatatctttgctagtttaacacggacaatccctttctgcaaacatcacagacgccacagaatcaattatcatggaatttaaagaaggaaaagctcctctaaacttagattggctttaaagtgagcaagtatgggtatatccacctttggattttaccgagttaagatcacaatgcactttacttgctcactttaaagacaaaattactttagaagaaccttgtccaattaagaaacacattattcatataactaactctcagttagacatacatctttcctgtaagtcctccctcggaagaaaagcaatgtggagcgagactcgtatggatcttgaggctcatcatctgtaaaagagtccacaacatgcacatacggggacaccacatctttgttcaaattagacatgccctaggatagcgaccaaaatccacaacaacctgaatcgattcattcaactgatctcgtaggaacctaaaggcattggggtgcgtcatgggaaatacatggtctctacctccagacctctgccagtatttggatttctttaataattccattaaatcaacctgacaccagaaacaagccctgtttaacattgacaacagagatttgtaaaacaatagctatgatgcacagatacaggtacaagtacaaactatacaacaccctgcatttctcaaaaaaaaaaaaaaaaatacaatgtaagcatggcaagaaactgtataacatacataaaatccattacatatcaactcaagaaacaattcaaaacaaaaagctaacaattgtcataacacataataaataagtggagaaaacagcttttttgttccgcggcacaaatttcaaacacgacggaacactagctgttcgagatccctctcgggaggattcagacctacaattaagaataaagccaatgtgctagcccaacagaatcaagcacaatagctgacatataaggcctaacatcaagaatcttctggcactacaccaatcccagtatagtcgcaatgtaccaaatctgatgccaaagttcgtttcgcagactcaatggatttcacagggttgacccttggaggtatttctcacgcctcatcaagtaagaagcaccaccatagcctataggagaataatataaataaatcatataaataggcccattttccaactttacaatctctcattctcctcctgcagctacaattctcaaacactgatttagcgatggaatccatgcaggtacataagcagagttcaactcgtgcgatcctgagaagacttcattatgatattccaaccttctagactggtgtgaagtgaacattagcattcatcaaattcttatgatttttcagcatctaatgccgtttaacaaacatcctgtatcgtaaatcttcacgtgatcttactaatcgcaatctaaggctaaacatgcaaagcctggctgtgaaaaataactctcatagcatagcatctgaatgattcacaaatcaattcggaaaaattgagaaacctagcttggagaaacgtagcgaagcacctgcaattggcgatctatctgcgtggcgggatccttcatggtgtgaccatgcgtgttgaagctgagcgacgagaagaacggcacgaagaacgcttgggcaagttccggatccgaaatcctaaccgcttctctgcccccgccgacgttgaggagcgaccccatcatccagtactccacgctgtgctgcttcttcagcccccagttcaccggccacgccggccattcctcgatggtgacgggcgtctccgccgagctccggcggtcaatcatgccgacgttgaatcggcgagggagatcgtacatgaaaacccgaagaggcgggtcgggtgcacagggagcaggtgcacccgcgggtaactttaggcgagggaagaaataagatcgaatgtcgagggtacctatgaaaattgagtaagaaaggacgagcaagagcacgaaaatgaacgagagaaccacttttccatacattgcaggttcttcttcttcttcttctaaatattttggggaataatagtgagcctgattgatgcttgtaggttatcttcttcttcttctgctgctgctgctgcagcttctgttacgagttgctttcttagctctgcgatcagttgcggtgtccatgtatcatgtatgtcagccaaatgtgaaggccaagaagatgcatttcttccagagtgagcttatgtcgttttcttttctaatttctaattttaatcatctaatgggaagggaaaaaaaatactattattttttataaaaaaataaataatttatatattaatggtgagaatagtttttatactattatataattacaaattttataattaaaatataataatattgaaagtataaaatattttatgctagcaacacataattctttttttaactcagaaaaaaaaacaattttttatataatcactaattaataaataaatgtaagtctattttattcattaaaatataacccctttattttggaggtaataaatctgcaaacattgacaaaaatttacgatagaaaaaagaactttgattttcttctcattcacttgtagttgatttttgtccgcgtcccttataacaattaaaaaaaaaaattgcatgtgcactttggtcgttttgatttttgaatgcagtattctttaaaataatatatttttgaatgtagtattcacggatcgggatctggcagatttgaccttctaaaagaaatttgcatgtgcactttcgtggttttgaatgcattgttcacgatctgatagatagacttgagttgacctttaaaaattagatctagtatgttttgatatactaacattttgagttaatgctgtaaaaaaaaaaaaatcttaatttgaatgaatgttctattcgggtattcggtcatccgaataaccaaatacaccccctcaattacctgaaaaagacatgcttaagtaagtcgtatatccctacacaaacaaggaattcgattattcggatacttgtatatctgcaacacaaaactaatgagaaacaagctcgtatgatactctgatgcctgtaagcaggtggcgatggttggaagaacataccggttgacgggagcatattgtcttaaacacataatcgaacaccctattcgaccggtcgaatagccaacatcccgcacaaagataactaatagtaattgattaaggtcataatagccattaacactaaaagatgtaattaacaaatgattacctcaaatggtcatcctggctaaaagtccacatgtccaatatccattaaagtatatataaataagtgaaattttttagataaaacataattgatttttatttattatgtttgtttattagcatggatcgtgtcttaatttaagtatcggagttctttttacaaatatcacaccttccaaaaaattagacaatcaaatatcaaagaagagctgttggattaagaaaagcattctgaagtaaagttacttagtcattccttggcagaaatatgttctgtatttatttagaaatacttgctaactcctataaaaataagccaatgtacattagtaaatatttgtaaaatttgttaatgtgcattcacttactttttagaaggagtatattaataatatgtaattatgattgatctggttaacatgttttttttctaaaaaaaacaaataggtgtacatttacaaatttttaattcaaaatatagatttgtcttataatgatatatcaataataaaaagtatattaacaataaaaaatgggtgaacttgacccatgtgtaattggatcttaagtcatatgtgaacgaatcaaattcgaattcaaataaataaatcaagatagtagtaagcattaaaataaacatgtttcaaactttcttatgaacaccttaatatcaaataaggaagattttatctacaacagtaactaaaacacccttaaactttaattgttgaatggttggacttaagagtgacagtttctccctaaactaacgggttcttccaagaattatcttgttcaaaacattgaggtttgtaatattttctccatagttttagagttcaataaaaaaaataactctccaattcttaccaacatcaatgtatcaaggattgagttaagtttgaggataattagatccaacactaataaaaaaataatttgtttaagttagtttaaaagtaagaaattataatgggcaacataaagttaagtaagcgaaattaaatatgagttagtttgggtgggtatatatataattataattttccatttcttaccaatattatttttttgagataattttgttccaaatattattggacattaaatatatgcacatattttagtgtatatgtattctgaaaatatactacacatagttttggaaatatacttctataatatgtatactttattttaaaaagtcattttcaacaatattttttttgttttatctcattacaactttgtttattttctaatattttttttgcatatgtgaacatgaaatatcatgttagtaagatgtctaaagagatgaacataaaagaagaagggaccataatacaagtcgggcctcatcgactcaccttatattataggattgactgttacaagactagtgtttaaacctattatataaccccttgtattttgcttgtaatctcttcatttgcttatttgaattcaattggcattatatctctgatctattttcataacattatcaaattgaaaagtcaaattttgacatgtgacaaccgccagttgctacatcatcgtcaaaagtatcatgtaggcataaccattttacttaatggagaaaactaacaatgagattaatttattgcattttttgcaatttcaataacaattttttgttcatctttcaaggacctaattgtcagtacttaacaaagtaaatgatgaatatgaatatataccttcagataatgaaattattgaatgtcgaaagaagacctatggcattgaattggaactgaccgtggttaagataacaaaattgtgagacgtggttggaattggaataatgatagtgaattagggagttttggaaagaggataaaagatgtttcagtttcaatatttaaatggtgacggaaaaaaaaatctaataaaacttggaaatctgcatatgataagtagagagaaagagatgtgatcatgcgaaaaagagaataggagattttgattatctatagtttttttttttaattacatagttatcctttactctgcatgaagtttaatataaagaaaattgattattttgtcaaacataaaaggtgcatggtgctaacatacacttactaatttttacgtgagtctatgtttttttgcttttgtgaacgagaggggaaaaacgccttccaaacgatcaattaaaacccacatgggaaaacaatcgacattacattggccaaaacatctgtaaacataaagggtaaaacaaaatcataaactctcatatgagtgggtctatattagcaaatcccatatataatattatatatatagacatattaagatttatatatatatatatatatatatatatatatatatatatatatatatttgatttgatttagtctttgtttgagcccaaaatgatatggaagcaactattaacactaccatattttctattgatagtttaacactaccaacttttgtgaatctcttttacccattcaccaaattcctacactcttctcatcccctcataatttttatcgagccaccccactgtcctctagcactgccacccacctacatctccgttcagatctagcattgttgtgcacccctaccttgcccaaacccgcgctcgccaccttcaccgtgccactagtccaccaccaaacctatagctactacaccatctttgccccagctttgaacctactgaccacaacaccaccacaatccaacaacgtcacgccactgccttacctaggacctatgacccctacacatgcaacctcaacatctgaggcttcacgtgtgcgacttccctgcaccactattgcaccaccgctcacatccatcgttgccactaatagccttattgttcttgcctaagaggtagtaatacttgaccatgaaggcggcgcaaaggaggctcaagggcttgttaaggaaggtggcaagggccaacgaagggggattgtgtttccgttggtagagaaaaaaaatacaacaaaaacatgatttcgttgtacactatacaacgaaaacatgattacctcgtatatattttttttttcaccatcacttaattcaagggaaacaagattctgttgtacaagtgaacaatgaaatcatgtttccatgaaaatgacattttttcaatttttttttaatgcacaccaaggtagtgccaatagcaaatctagtagtgttaacagttgctctcagatgacattttaaaggggtattttcaggtttgaatgaaattgaccgtgggctggagtagatgttgggccttattctccaccatagttccatatcgctgaattacgaactagggttttaaactcattatattatataaactccgtcaatctttctgtggagttgctgacaagccaattctttgtgttggtgctaaatccctagtaagccgccatggtatgcacttcacctctagtcctttcactttcttactccaatccgtgttttcatatcatgcttaatattattgtttgcacatctgtttctgcaggtcaagtactcaagggagcctgacaatccaaccaagtgtaggcttcattaataatcacttttttgcgtttgtagaatcgacacttattattctctaaacgacggcgtttatagtctctcccaatctcagcattttttttttttttttatcgtttttcatatgcagcttgcaaggctagaggcgccgaccttagggttcattttaaggtactgagtcccgttactttggttttctgtttaacaattttttgaaagtcgaaaagtaaatttcatttgaatagcaacgccatcaatgtataatcaattgtcgacaactcacatcaatgatatatatacttaacagatcctgatgataaaagcggcgcctttttatcctgtttgagcatggccctagataacttgttttgagaaatcacaaaacctggtttatagagcttttcaaataatctaaccagagtggtggcttgggaaaaaagatctagaaactgaaggtttttttttttcctgaagctaatccaaatgaaccttgtcatccccttcccttaactgcattaactttacttgaggctgtcccttctgctctagtttaacttgatttggattgtgtgggaaaaccttttctaaataaaaaatgaagtggaaaaaacctgatggaaaaagcaggggcatgttgcctgtgtgagcaggcctctcataaccttcagggatataataaccattgttattgagtgaacctctgttctctgtttgtgactgaaaggttcagtaaatgatggaacccatggtttaaaaaactgatgaaaacttattttaacaaatgaatgaagttgaataaacctgatgaaaaaagcaggggcatgttgcctttgtgagcttgcctctcgtaaccttcagggatataataaccattgttattgggtgaaccactgttcactatttatgactgaaaggttcagtaaatgatggaacacatagtgaaatctgatgaaaacccttttaataaaagaatgaagttgaataatcctgatgaaaaaagcaggggcatgttgcctgtgtgagcaggcctctcgtaaccttcagggatataataaccattgttattgggtgaacctctgttccctatttatgactgaaaggttcagtaaatgatggaacacatagtgaaatctgatgaaacttttttaataaaagaatgaagttgaataatcctgatgaaaaaagcaggggcatgttgcctgtgtgagcatgcctctcgtaaccttcagggatataataatcattgttattgggtgaacctctgttctctgtttgtgacagaaaggttcagtaaatgatggaaaacaatgcttttgttgcatcatgaatttgattcattctgagcttgattttttatttctttttatgttttgtttttaaaaacagcagaaaattgatgttttacccaatggagggaggcagtagttaatatatgtttcttctttgtgaatgatgtttcattgatgctagaacaatactattgagtttattttattctgagttatatcattttcctagacatgagacattaccttttacattgtacttacagaacactagggaaactgcctttgcaatcaggaagttgcccttggttaaagctaaaaggtacttggaagatgttcttgcgcacaagcaggccattccattcagacgtttctgtcgtggtgttggaaggacagcccaagcaaagaatagacactcaaatggccaaggacggtggcctgtcaagtcagcaaaattcatccttgatttgctaaaaaatgctgagagcaatgctgaagtatgtctatatatactcgttttttttccttttccgtatggctattttatgatttccaaactaactgaaaattgtttcttttcaggtgaaaggtttggatgttgatgcgctttacatttctcatatccaagtcaatcaagcacagaagcaaagacgtcgaacataccgagcccatggaagaatcaatcgtatgtctaaaatgtccagatttttgttttaatggcttgttatcatttacacggttttatttatggagactgtttttgcagcttatatgtcatctccgtgccacatagagttgatattatctgaaaaagaagaacctgtgaagaaggaggtatttgattcatctagttttgttgattctcccccatttttttttcaatgattcattatctaattcctattctttttttggtttgtagcccgagactaagttagcaacaagcaagaaatcccaagctcttcgaagtggcgcttcgtcttagattactaataaattgtttgaggcccaatttcctagattatgtcaagtggagagttttgtttgttttatttttgttatggtttgatatgattttcatactatcttcaaattaatttgagttaattgaaaaacttagtcctttgtatgttttccttcggatggattacttaacattagttttaaaagaaatactaaatattagacataaatcgatggttaagtggtactgaattattttttgttttctttccataatcctcttaggcctgggtttggcccaggcttttgagaatttctgtaagggtttcttttggggttaaagccctacaattcttagcttaagcttttttttgaacgtcaagtaattagcttgggttgttgaagcatttctaaaaaattctaagggtattccagtaaaagtgtaaagctaataaatgatataatgtttttgtaaacgtgatattgtttagtgtttttggtgggtgctgaggaggtggcatcgtaaacagccagcacttattagctagttatcatgtttggcgtttttggtcagttttaatgtttttctttggttgatgaacaagtgcagttgttgaaaataaagatttttctttggagtaattattaaattttagatgttatttacataaaagagagaagtaagaagtatgaaatgagataataatagtcagagatacaacatgtaataacacgaattgtttttttttttttctttctattattcaattgtaattgattctaattgaaatgaattatgtgcaagttttatcgaaaacaagaaattatataaatgtaatataacattaataggattttattcatcgtaattaatttttggatgatgcaagaaaatataccatgacataagtttgttaatatgaatttttttaaagtcagcgttaatataaaatcacccacattgggattccttcatctgatcattgtggcttgtgggggaaaaaaaattaaaatataacaattttaataaaaaaattatgaaaatattgtagttttaaaattatttacaaatgtatagcaatcaaacacgtttcaggtaggcgtgatgcgtagaaactttggaaggtcataacttttgtccgattgaggtgaaatcggtggtcacgcgctcgaaattgagaggaaaagcccttggcaagtttccaaaggggacttggccaaaatttttcccaaaaggggtctctaagtgcctcaaaattgttatttaatcttcggatatccaaaaaatttcgtgttttctaattttttacttatttaattagtgaattgcaagctcttctttatttatctaattacttctcttaatttcaagcattttgatataaaatacgccttcatcggacatggtctaaattgcgattttgacataaattttggtccctaaaggagctgatccttcatatatatatatatatatatatatatatatcaatttagacccattgctctttgcaatgggatatataaaattgccaaccgtgttaacattattctcccatacgtggtagggccccttcaaaccagcttcattaagggtagaaattcggttgataacttcattattctccaagagcttgttcattcttctcaagctgaatttgcagactgttcacttcgaaatggattccttgactgcggttaaaaagatggctagagagcttggcctaaccatttaggaaatctcatctaggatatcaagcaatccctgcattaggactcgactcttggaccactcttcttacctatgtctatcgtaaaccaaatacaagtgctagcttcttggctggtttggcccatcaagggaactactatcctacacttctggattccattcctattatgttgagggttatcatcgaggagaacactgggggcctgaccctccctagaatggttgcggtatagtctttccctttctttcccttttatccaaaaaattaaaaaaacaaattcatattatgataatttcattgtttttcatcaatcgagtacatctattttctaatcacatttgaagttatttatactgcaaacttgaatctagattattgggtttgattgtggagtgttaagtggaaagaatgatttaatattttagtaaaaacaataactgaattaaatatttataattatttttaatctttatctgattaataaattgtttacagtttttttgttccttttcatgttatcattaatatttttaagtattgataagaaaggtatacttaagatttaagagtttactcacgcatcttattcatttaagtcaactaaatcatcttctgataagacttaaaatctaaacctttagtcaaaataaagaaaaagtaaaagaatactgaactttttttttttaacctttagtcaaaataaagaaaaagtaaaagaatagttttgtggtataaactcgaggaggttgaattgagtacctcactttgctacactctccggcgttcaatagacttcaccatcttcctcttctgtctaccccaaaggtatcgtttcaccacacttactttctctttcttttgattttcctcccttagcatgccaaacccattcgctcgacgacactttctgggggttttatttcactgaacatcccgatgcttatacgactcgtcgtgtttctacaattgaactttatattcactttttatcgcaattttcccttttccccaaattttaaagcataacctagaccggggctttcacacaacacaggttacggctgccccagatctgatctagaaatttatattattacagagataatttcttaaattcttgatgttgtgggaaattgtagacaaatgcggctaatgtggccgaaattgtggtcacgtcgattcctaaaaccttgatgtcgcggttcttgatttttatttttggcattgtattatatgatctcaattaacgtgtagggttgctgatgctgtgtattttccccttaattgttgttgattagattaggatggattggctagggcaaaagctggcggagcaactgatgcagataatgctgcttgcatttgctgtgattgcatttgtaggtggatatgccatggcttctttccaaatgatgattctcatatatgctgggggtgtggttttcaccaccttgctcactgtccccaattggccccttttcaatcgccaccctcttacgtggttggatccaagtgaggtggaaaagcatcccaagccactaccttcttctgccaatgtaactcaaaagaagaaacctgttaagaagtaggttttttttatttttacttttttacatttttggggataatatatctttgaagtacatgatgctttgacagtaatttgaagttcttaacctctttccccttcagtcgatattacagtgtacaaccatatatttactctcttttagacattgcttatagctgtgttgttgtgttggttatccattttccttttttttttttttttttttacctattttcttgattttaggcttttgattatatgataggggaagagagttctgacccttgatggtttgtggttttagttttagtgtacaattttgatgattctcacaaggtgattacccaaaggacaaaacttaaatgcagttctggtgttgttttctaattagaatcagagttttaccttgataatctgtttaatgaaggtttccatcaaaggtcaacatagttctgaagctccaattatgattggagaacaacaccaaaagcacttatgaaattgcatttaagttttgtcctaagccaaaccaagtgatatcataagccattcaagatataacctatctagattcatgaatcaattttttggtcgttaggctcttgatggttgatagaccttgttgatttgtggattcaactgatgctcttcaattttaaaggaatttacacagtttgttttatgctaacttgcacttttggtcttcctactttctcaatttcatgaatttcaatcttcatttttttttcccatgaatttgatccctagctattgtgcaattatgatccttatgcaaacttaacatccaatatttaaaggaaataaattgttgaaattgagataattggtgcccaaaatgcaattaagtctgttttatattgttttctaaatccattacgaggattcttctctctaactgtgtctgacttttcttttctttgattgagctacaatattggtctgtcattgtttatggatttcaaagaaattggtttcatatctcaggccaaagggtttttgtagcttaggtaatatgtaagttgcaaatttggaagcttttatttttgttgtagtcttggatgttaatgtgctcttctcttgttttgctgtcacttctgagtttttttctttctttcctctaaagtcagggacaatgttgttaaaatcgtgagaaaaatcgtataatcgcgcaccatcttgcgattttgcaggtgattctcgtgctgaatcgtgttaaagatcggagggtgttccagatcgcgatctttcgcgtgagaaaacacccattttgatctgtctcaatctttaggggttggcttgtgggccgtatttattatgggttgggtttcagttcgaaacccatattttctgactcggcccagttcacaaagcagagaaaaaaaaaaacaccttctgacttcagtcattctttgcaactctcttcatcccctagggttcacctttcaagcttttcgtcctctcttcttcgttcgttgttttggccaggatcttcccttgttcttcatctgaaactgataccttcagcgccctattcttcatctcaaacttgaggattttcagttttttctctaatcttcatctgaaactgagagcttgctgggttcttcatctccctcgtttctgccttttgttcccctattcttcttgcatttcgtttttcattctccataagttttaattttaatagtacgtgttctcgtttgtcatttttacggtttgtcttttgctgccacagtgcacatgttaatatttttttgtctacctaaaatcacaatatcttttatcacttgtgttctgattttgacttttctggttttgtctatcattttaatgtagtattaaaatttaaatgtattttttttatcaagtgctcattttagtgagaaaaataaatatacctcttgaacattttgggcctttggctgaataattaaaattttagcttgatgctaattgagaaagtgcttctctttggttctttcttggaatcttgattctcataaaaaaaaatccatttttttgtaatggatctaccttaactgcttaactcgtcaattcatttgaattgtgacattattcttccacctctagtcttgatctatctttttctatttcctttttattttaattaaaatcccctatatgatgatgatgccgaaattggattattattagggtttttatcataacatatcttcgtgatttgaatcgtgtttatacattcgatgagtatttcaaatatttcacatagaagttctcacacttgtcaaaataagcaaattcaaacatgttattcagttttgtctccaaaattgaattcatattttcttacaaaatcgaagtaatattctgtatgaaatccatttcatattttgcacaaaattgtttagtaaactaacttatttcagaatttcttttactactattttacaatcttataaacttcaatttttttaagatagcttatagctagtaatttttttttattacatttctctttaatatctttaatataacttcattttttatattcgtggttaaaatctctagtacctaaaatatatttttacctaaagtatataatttatgtgaaaaactttagaaacatgttttttttttgttatttcatactttcagctatttaatagttaactttgtcgaacatttctaattaaataatttaacttatcaagtttttaattagtttatgtcaactagttttgttgaatgtaataacaatatttttcatttctaatcctacaaatataagaaattttgttttaaactcttgcaattacattcacgtaaatataacagtttttttttttttattattataaatccgtctcatctctatgaggaccaaataagtgatgacaaatattataggataaaaactaaaataaaatttataaagaagcaaaaagtcatcatttttttgcagcaacgtaaaatatattgatgaagtcatttcttgaattaagtatatgtttagtaaaacaattataatcatttagcaatattaataaatatcttggcaatagataacctaaatgtttaatacttgacacttggtgacaaaaataatttttttggatgatataagtcatgggttctcttaaatactatcacggtgggtttgcatggagcatcatgcattcatcaattgacaccgttctaagaacaaacataaggcaaattaggatgatataaaggtacacgttcattttaattttcctctcaatatatttcattcattcattagaatgtcaagagtccttgaaagtgaccacatcaaaccttaattcaaaggctttggctgaagattagctactccggtgtgtgtgtgtgtgtgtgtactaaatttagtgtgaagcgcaacatttgattgaaagtagtcgttttcattgtaaggatgtctttacataaaagatatatttcattttttcttacatcttttaaaattaactaaacaaagattttttttttcattttttttagtcaaaacaactgaaaagtattttttttctctttccttcaactttttcccatactgttcctttcctcatttttttagttatatctagattgatgaaagaaaattaaataaagagaagaatattatgttctactatttaaattagaaaacgaggatggaatataatatatagaatgagaactttatcaccttggaatattacggtttggttggagtcccttcttcagtccaattggaggttggcatactcctcaatatcgttgtaaggatgagttattttgtattgaaaactatgtgatcagttttattaggaggcaaaccaattgggtggctcgtcaccttgctagagcaactcaattccatgttagtcaccaagtttatgaatagatttccacttgtattgtatcatacattatcaatgaaatgacttaagtttctcttacaaaatgagaactttattctattttagtttttccacaatatatctaaataatgaatataatgagtttgattctattatactacaaacatagcctcatttcaaaacatggcacaaaactctccgttccagacatatctgaagcagataagccccaagaattctagagattgagacaacaccaagaattctgcatcaacaaacgtacttgtaaatagtctgattcaccagagaatagttgatgtttattggacaccagagtgttcaacgtccggttcaccacacacatgtacatgcaacaatattatcatagtaacttcaaagttgaaccacacttttgaattatagcaaataatgatgtagcaatcaacgcatgctgcaatccaatttcaacacatcattaattggaatctcaaaatctgtggtgatctatgcatactccatcaatagaatcaactattggcctaagtttcacaaaaatttcacacttcgctgactaaaagtgggaatataattctgattctttgagcgactggttttatttaatcggcgagtcgtaatagaaaaagaaccaaaatcatagattctagtgggacaacgaaacatacccagaacaggtttatttatagggaaaaaaattgtcataatctactctggttttatttaaggaaagagtaatccttgtccacttgtaattattggtatatgttcgcttacaggaaagagtcaatttttttaatttataaaaaatatcatttcaatctttaaaattatgtacaacaaaaaaattctttaaattattaataaaggttattttagtctttgcatataaaatacttgcttctctaaacacatgcaccaaatgaatgtctcaatccttttctcaccaagactgaataatgaattgcactgacgacaataggcattttaacattttaaaaaatgaaaaaaaaatatttttatgacataagaaggaattgattagattaagaaaatccggtacaataaactaataactatgcccccgaagcatgcacatcacttgatttctaatcatatatatgtagaatataagtagagaattttgactagagagataaaacttatctcaataatttttactcctcgaaattattaattaactttcagttgacagatatcttagttaaaaaatcagggcagggaccggttatcatttgtcatcatgcaattgtgttgctttcttaattagcagtcaagatatttcattccaaggagttaattagctaaaaattccaaaaccgatccataaaaataaataactagaaaactaatgtcaactatcctaatttttataggttctttcaatttttactttatatatgatatgatattactttaggcaccggttggagggttggcagatgcaccctctcattttaaaaaaattattagtatttgtcctaaaatattatattttgcatcctctaattttatgtatttgaatttccttatcagttcatatgtaagagtaagtaaatataccatcttattttaataaaatgcaaaaaaatattatattttgcatccataattatatattttgaacctcctaattttatgtatttgaatctccttaccagtttacatgtaagagtaagtaaatgtaccctcttattttaataaaatacaaatatttattttaaaattttatattttgtatctcttattttcgtgtttgaattaaattatctcatataataatgataattatcaatttttatttttaaaataaattgctaggatcctagatctgccactgcctttatgaccaaatcgcttgaagaattggtcattgcgtcaattggactttagcatttattaagtcaactgtcgctcttttacagcataaatcaagggcgttcataggtttgaattaattccatgaatttagcaaatcaaccaaaacatttcagactttcagttgtgtcggtttgatttatgtgtacactttgcactgaattaaactaatgaaacttaatatacagtatatacatagcagtgatcaagttgatgtaacattaacttttttttagttacttttattttcactattgttttttaaagatctagtacttctaatgaataacttatcctaactatttcctaaacaaataaaactaatcctaactattggaagaaaaaaaataattctaactattaaatttcaagaataaatgatagaattaagagtaatgatctaaaagaattattcttagaataatttgattattcctatgtgtctctatatataattttaattaaaaataatcattcaaactcttttatgtgcttttttagttctttatgtacacaatttgatgtcgttttgtataatagacatgattatgtaaataaataagctttaagcctttcccttatttcaaattatgaaatacatatatttcatgaagtaaaataaaccaattcataattggtttgagctatgcttaatgtactctttttagcttaaaagttaatttaaagttaaagtttaaaataaaaactttaaaatactgttagacttaaatacaagtaaattttaattacttgatattatttaatgttatcatctaaaaaatatcttttaattaattaaagttctagtccaataattctttttatttttaatattaagtttcaatggagatcactttagaaaaaatattttttttaaaatatgaccacaaaaattaaatgacattaactagctttcttaattaatgtagtattagataaaatttaagatctgacgtctgagactaattttaagaattcagaaattataagaatttagtaaggattaaaattatgcaatatggcattatatataaattaaaatatatgataacacaaataacaatcaagcctaattttttttttggtacaagtcaattttcaattattgagtgttatttggtatggaacaaatttgcacagcttttctttccactaataaaataacaagatcacggaaattagaggaggtaaagacagaaggaaacaaaactccaatcaaaagcgttattatgtgaaaaccacgaatcgatcatttcctatcattggcattattctcattaaatttatgcaagaaaaatcgttctgtgaaaatcacgaattgatcattttcctaccattagcattattcttattaattttaataaagtaaaaaaatctggctcgtacaaggccacaaatgtcaacaataagaggaaatagggcacattgcatatccaccaatggctcatcacaacatgactagatcaataagtggttcttgattatcattgatggagatggaataaaaagtaatggtgctttcttgaaaaggaaaatatttgcgctgtagatagatacaatattctattaactaaaaaaaaaaaattacaatattctgcaagataatcagtaagttattattgagacaataagctaacaaaaaatttccgacttatgctagtgcatgtaaaaaaaataaaaatatatacgtgcaattagtatttcggtaaaaatatttatcccttaaactaatcaatgatcatgcaccataattttgactagagttgttattgtatgatattattaacaaaaatcgtacacgaattattaatgtcaggacctaattataaaataatctattaatatgaaaataaaatataataaatatattttaagataaccacaaaccataattgatgtggctcaagtgactttgaatacagcaaaaattatatcatgcacatttgataatatatccattaaattaaaaaaatatgtagttttgaaatatgaaatttatttatatgcactataatataaaacttatttacacaaacatttaataggatttatcttatcgttactttatgttaatgaataagatgtcgtgataaaataatcaaatcctattgcatgtatgtaaaagaaggttttacattaacactgcaaataaattaaattattagaatatcccttttaacattcataaaaagtttaataatctttagattattaagtgcatgctagtttatatatatatatatatatatataaacctttttattgttatcttgttaatttttttcatcaatagaaaattcacaatagactttatgaaaagaaatataatatattgtatacttcaattttcaacaggttaaactgagttgatgagacattttttttttcaatctttaaatagatctaacatactacttcaaacaaatcataattcagaacctataatgagaaaaattatcttaacagaggtgcatactgtcatcatgttaagaaattccaattgcaaactctgctgtttactttatcaacaaaacaagtcctgccgtggtgagattgtgtcagtgttatccgaatatcttgtctccgaccgttttggtacctaaataaatcctataaattccactttgcttcttacagcgccaccaacaactccaataactctatattgactacacaaactacccttctctcatttcttttttcctttcaacctcattattattcttgtaagttcctctttctttttataattcataattcatgtttagttctcttattattccaattcctgttttttacttgctacagatctaccaagggctattttgaatccgatttgtttacacactcttattgtttgtctcttgctttattatatctacacatttgattcttgtttcctgtactgtatgtactccttgtctagttaattggttgtcttaaaattgtttgtcctcctttcagaaccaaagggcaatgctaaaaacgtgtgttcgtgttttctgaaacctcagattcgatttggattcctttgttttttattttatttttttatttctcattgatctctgtgttctcaacagctgaggtttatgtacacttgcaaatttattaagatcctgtgataaagtctcatttataaatacataagaaaacaaatgctctttttattaactagtgatatcgaatttgtagtcttttaatttcagctaagagtatcctgggtttattcaataagtggtctcaaatttgtattcaggataagcaactatgttaaggagagttttgttattcataataatgttattctcaaatagtattgtctcctcgtgcttctaggaggatactattgggcataccaataaaatcaatatgaatctcttgtagtgaaaggttctttcttttggattggtggatttggatgtgtttttcccctttttttctttctttttctcttttttaaaaaaactcttgttagattcatttctttataaacgcatctagtggctacttttgctccggatttttgtgcaagaggacaattgataccttgtagttttcaattgagtggtgttaatatgacttcatctatgcctggatttaattcaataggggcaaaggtttatttatttatttaaaacatttctcacttagttcttttctgtagtttcttacttgctttgttttacatcacaatcttttgtggactttctggaaacactggaaggtggagttttgttagatggtagttccttgctatatttttagattatagtgcttacaaccatttagtatgctttcatgtccaagtgatatctgtaaaaggaatagtgatttgtttttgttaacccagcagattgaacatttttcaattgaagtctcgttccccaattgaataatcaatttttctaaatactttgctacttttttccgtctccagtttgattcattcagctgatatggagttaaagaaaatgaaagtttcagatggctaaggcttggcaagttctatggcctactctagtatgaatttacattttttgctaatgaatattattggtaaatttttatttttaactttaataacttttttccttaatttatagatacttgggcaatgtgtgagggaaaataaaactctggaagcttaagatataatttgcagaaaggcagtaagagggattattgtaggagcataacttctgttatggaatttgaatcagattggataaagcacagaaagtcatcttcttataccgctcatgttattcgttctgcgacatcttttataccttggtcttgtagaatcccaattggtgaagggtatcatgaatttctttaattagttgtactcactacttagtaagacattttcacattgtttggttgattggtcgtgacttgccaacgaaatttctctacatcttcgttgtacatcatatgtgtgattgctaatttgaaaaatacctggttttgtggctgaaaagaagagattcacagagccaaatatgtgttttaccaatttggccaaccatgataaaccaactcttacaaaaaacactcattgcttgaggtccgagtttctggatgatgatgatggtagtagccccatcctacctgggctgcctgatgatgtttcaaagcaatgccttgcactcgtgcctcgttcgaacttcccggccatgggtggtgtctgtaagagatggaggtgctttattcgaagcaaagaatttataaccgtgcgaaagttggctgggatgcatgaggaatggctctatatcttgatagcaggtagtgaaggaaaagggagccattgggaggtcatggattgcctcggtcataatcgtcgatctcttccaccaatgcctggtccagcaaaggctggctttggggtagtggttcttaatggaaagctccttgttatggctggttattcatcaattgatggaactgcatctgtctcagcagaggtttaccaatatgattaccaatatgattcttgccttaacaggtatgcttttcggctgtaaatttacctggatgccgtaggaacttattacacttgatatgataattcctgcattataattgagttaatggaggatcattttttccctgtatatttttgtatgggaaaaaatgatcctactgccagttctcttgtttattatagtttatccatttctgggatgtgttgattttagaaattaggactgaggtgcctgtatgtctatgcttagaagtctttctggtaaaaggttttaacttttctaacatgtgtttttttctatatctgtttcactcaaaacagtagaaagtgggaaataaagactataaagcttggatggaatggcttgacacaaattgagttgtttattgtatgattttaatttcccagttatgtaaatgttaaaatggttttcaagattaaaaaaatcattgtccacgttgttacatgaattctaaaacatgaagtatgcttgatcagcatcagcctcacttttgtagtgtgctttacacctgtatttatttgcttacgctccttgtataaatcactgtgtaatcgataaagttgcatcactttctctatgatgaccttttattattgatctagctatatattctgagttaccatgacatgtcacctttattgcaaggaaccatcttagcacagtgctattattaaactttgtaattgcaattgcagctggagcagattgtcaagcatgaatgtggctcggtatgactttgcttgtgctgaagttaatggcttggtttatgcagttggaggctgaagcacaactggcgacagcctctccagtgcagagatatatgatccggataccgacaagtggacgccgatagagagccttcgtcgcccaagatggggttgctttgcctgtggatttgaggggaagctctatgtcatgggtggaaggtcaagcttcacaattggaaactccaagtttgttgatgtctacaacccagagaagcacgggtggtgtgagatgaaaaatgggtgtgtgatggtcactgctcatgcagtgctggaaaagaagttgttctgtatggagtggaagaaccagcggaagttagcaatattcaatccagaggacaattcatggaaaatggtaccagtccctttgacagcgagttcaagcataggtttttggttcgggctattagatggtaagttgttgctgttctcactggaggaagagcattcttataagactttgttgtatgatccaaatgcagcaccaggatctgagtggcagacttctgatataaggccatctggtttgtgcttatgcagtgtaactattaaggcctgaaaagttggctgcttccgaatttagaaaccttgagagagctaaggattttgttgttttactaggattttgaatagtagtaattttgaaagtgactcgatgttaatttagtgtttttgcttgttcttgttagttttatcatgtcatgtcatgccatgtctctgatttatggttggattatttctacaattattcatgtaaccatcgactttgaccaagcactacaaattatggtgggcgagtttctttttctttttcatcttccttattttgtgttctcttggtaatattagaaagtgctaattggtaaggttggtaggataacattgacaaataaatgtgtcctttttaagtaggtggtcagagttcaattttctgactcgtatttatggaaaaagtatttgttggaaaaattattattttttatttaacttccattcctttgcaaggaaaaaaaaaatcatgtaatatttttttttaatcaaaacgcactcacaaagtttgaaaattgtatattattcaagacttaaatgtgtatctaatctatgttagtttattttaaaaaataattatttattaattttatgaaagatttttgaaaaaataatggatagatgatttataatccctttgtaaatccttgttcttggaatagggagagcttaccctcatttaaaacttttatgttccaaaaaacacttatataattgatatttgtagaaaatggatgttcatctggcccgtgtctatagtttttttttttcttctaataaataatattgaaaattctgtgtacatcatgagtattgatactgagcacttgatataatagatgaaagtggcttgctcgatataccttggtaagaatggcacatgatttatattaagggaaatgacagagttttgaaatgtagaagaaaaatggtaatgaacagtatgaatctttcacaaaagaaaatgatcatgggaaagttataacttataatggaggactgagcagatctgtcgatatgcttttgtgatatttaagataatataaggcgggctaggtgctgttacgaaaattacttttccaaatgaagtaactttggatgatagtcacttacactgatatttaatattttgttgatctgctgtatccagtagtaaaaaatatttgattagaagaaaaaaaaaatgatatagaaaattcttgaaataatatgcgataaacaatgaaatccttgaggaggtgcaaattttgaattcagcaactcttaattcttgacataatgtaatccatgaggaggtgaaaattatgattgcagaacactttctcctagtactaccggtaccagaaatacgagaacattctcttacactcttacttacaatgaggtcatttagtgagcaacaagaaatagcttagcagcccgagaagtattgaagtgttacactaccttgattcttgctgctctcttgagcatgtattagaatttgttgctgaaagagtagaagacttcttgggatgtattaaaaaaaatggacgtaatgaatatgaatatattttatttatattctctttcaacgatgtagtattatttaagcgtttcaaagtctccttttagcccataattaattcatacatgcctgattcacattggcttacagatccaagatgaagccattgtttcagatgcacagagattatgcataatccaaagcaatgtcaaacggtctagctcttcccctgctttgccaaagtgctactgattttaattttcatcatgcttgaccatgattttttaggggaccaaaatagtaaaatatatttcatttactaaaatttaaaataatataattatataactttttgttaaaacataattatataactcaaaacaaaaaaagagagaagaaagtaataaaaaatatcaacacatgttatactaatctaacaaataaaaggtatttcaatttaacataagagacaataaaaaatatacattagtaaaaaggattatgacttaagttttgaatccactattgtcgatcaaaatacatagtcaacattataaaaaaattaataattaatatttgtcgataaaaaaattgacaacccacattttgtagaataatacttaaaacaagcattaacataaatgcataaaacttaacaaaatacaattattattattacatttaaatatatatattatataaagtttaattacttatttgattcttatagttatataaattttatcttttagtttttatacttaaaaaccatctcttttaatccttatgttagttttcattatgagtttagacgatagggattaaaaggaatataaaatgatcagattaaaaaggattaaaaataatatgtgtaaggattaaaatacatgatttaaagtgtaagaattaaggtaaaattttgtataattataaaaatcaaatgagtaattaaactttaatataatactattatatgaaaaattttgtttttaagaaaaattttgagggccaattatctatgcctatataatggatatatgtcttttaaaaaaaattagagggaatctcttcgccctcaaataacttaagtaaaaattatgtcatttgtgtatgcataatcaactattacttaagtaggagataatgggttgatttggtggtgaaggagaaaagaaaaagagatagattgtaggtttgaatttctcactaacaaaaattaacaaattattgactaatatttgttgataaataaaaaaactctcgataagtaagcaacatgtcacgtagatatacagttcttgtttgagttgggactattagatttatattctcaattcctcacgcgaattgtttgggatagggctactaaatttatattcttaatttcctgcgtgaatattggcaagaattgattaaaattttagcatagactcatgaacacacacctttggctaatttgattcaatggaaagataaatcagtgactctttccattatgcaaacaagattgattggactagtcaacttttccacaagttatattttacttatggagtgttcttaattacctcggcaaatttagttaaataactttaacgaaagtctattaattcaagacttttttggaaatttaatactttcaaatacatccagtaatcgcgaattaagctttcaagtaacaaaaatagttatttagcctttatctgttcttcctatccctgttatttttggagtgaacgagtatctaaaagaaaaaaaagtaaatagtatttaagatttgaagttacgtgaaggtgacctcctccccaaaggtgactaaacatggcaataggtactcagtaggcccataacccataaatgcaatgcaatcattttcaagcccaaataaaaccaacaatccaaatcaaattgtcatagtgcttgcacgccaaaatcaggaaatttcagtgcgtcaattcactcaccaaaaactctgaccagcagcagtcgttaaaacaaaataatatttgttcgttcctcttagccgctattgccttcaattcaaccatttgcatcacaggcacacactggaccgaacaaaaaccatttgatcaatttatataaattataagttaaactaaacttaacacttaccaacagaaacaacaaacacaattcagcttctcctcctaggaaacgctgctgacatggctttcgggtcttccgaggatgtctcaggtgtcaaattgcttgtccttctggctgtcatgtacggactcttgtcggcgctgacatactccgtcatccacatgaagttcgtgaaccctctcgggaacgacgcgccgctcgatcgattctccgaagccagaaccgtacaacacgttcgaatgttgtcgcaagagatcgacggtcgtcaagtgagccatttttttgttttttaatttcgaaatgtgaaacttgatcatggtatttgcgtttttaattgtatattgtttacaattagggatcttaactgtgtgacatgatgatgtcaatcgctttcgaacaggtggaatctgatagcgcttttttcatcgccatcggtgttatgaactgagaaatgttattcgtacaataacttttaaatattttatatagcaattttaagtagaagaaaaaatagaacatacactgacactgtaaatccaattacaaactagtatcaaatatggtaagtttactgataactaatttaaaatagttgtcagtgtaaaaacttttagtctaacagtatatactcgctaaactcttatttttatctcttttgtcacattatttgttacatctcatatttctctcttaatcacagataatatttctcttatgaatctggcatgcttttgtgaattgacttatggtgcatttattattaggaagggcgtcctggattgaaaaaggcagcaaaatatattaagggtcagttggaagtaataaaggagcgagctagctccaatgtcaggttgcaatactttattattattattattattattatttgtcacacacttctttttctcatttgcctttttggcccacttatttatttaacacacactttttagtgtatgtttattatttttttttctttctcggagtctgattttattttatttccaatattttatttgcagaattgagattgaggagacaactgtgagtggctccttcaatatgttgtttttgggccataacatagctctgggatacagaaatcacactaatattcttatgaggtaccttggctgttcaatataatcatttgtattagattcagttatgttattaggatttataaataatattcttcagcaatagattacaccctatagttaagcaattttcacatttcatacatgaacttccttgttttaagcctgcagtttgtccattgcttactttttaaggaaaatatcaccactaaagatgcaaacttaatatatgttagggcaatgtattccataattcaagtattatctaaattcagcccatagttgataggtcaccagtcaccactttgttatccaaactgaccaacaaagtgatacatttgctaggattcaactactgaattgagtataaaccagacataaaataaaggtatggatgccttgtcaaagaccaatgcatgcaactaaatgtccacaatataggaagggcattctggagtggccagaactcatgctagaattgcagcataatttcattggaaagggataaggaaagatgttccgcaatttgtaagcaaatgtttcacatactagcaagctaaatttagtaacatgaaagcaataatgtaatttcaaccttttccaatatccaattacatgtagaggacatagagacatggatttttaactggcctacaactatcagtctaacactacactaggatgcactgtcctgttaatatttatcgatcatttgtctaagtaaggccactttgcagtcagaataactaactattcaaggttgccaattgcagaacagttcattcacaatgggcagtttattgaatcattttctttctggttgtggcttattaaacattaaagatattgctgtgttttttacttgtaccacactgagtgctatcttactctgttttttctcacaccagtttaaatttttctatggaattttgcatattcctccagcaaattcaaagttgtattagtatcattctgtttcccttcttacatttactcccacccttcctcttattttcagttccctgctgtgatgttaatttctagcaaagaaagacataattaggaacaccatacttgaagtgtgtttaactcacatgcactacatgtgttataacttataactggcattaatcatgaaccaaagttaagggttaagtgacacagagaattgaaagggctatttgagaagggtgaaactacatgggagataaagtgtaattatccctttgtctgaattacatccctgaaagttggttaacattgaaactgttaacaagtgtttggttttttaggtgggatttcatgtgaccctttttttaactgttttgtcataatgttgaaaaaaatacctcataattataaattagaagtgttaagatgtctcacactgactaggaataaggctagaatacttcttataaggcttgggcaatcctcacccttgagttggtttttggtgtgagcagagttgtcaatagcagtgtagcggccaagggctgcaataagcactgccaaagcatcacacttcaaaattttaaaatagcagtcatcccactatgcgctatactgctatcgtgttcttaaggtcagccgctgcatgctgctatctttgacctgtaacaatggatttgagttaacatgtcctgctacattagctagtaatatgggcagaatactccttataaggcataagcaatcttctccccttgacttagcttttggggttgagttaggcctagttcatttctaataagaagtaataggatccaacaaggtaaaagagggtgagaaaaaaagttattagataagcttgcttctataatctgagataatcctatcaatggggtcacttgctagtaacttacaacaacactgtaagaatcatacagttatctaatagttttaaatataaacaatgttcagagggttaattgaaaagaaaacagagctttataaatgtaatgcaaaatttgaatgaagtacatggggtggtggtaatctggatttacccttcttgcaataaacaatgttttttgatgcaatctctctctgtctgtttactttttaaaaaaaaaaattgttgcaaatgatatttgtcctaacatgtgcacacgtcgcccagaaaagtgatatataccatttcttaactttagagtgggagtgaacataaggtgggaactaacatgacactcttaatataaattaagaaggctccttgaagaagggttttgcaaagactgataaaaaattgtgttctcattagtagataatgatatgcaatctaaaggtctttgaaatatggacatttggatataatgatttgttattgaacatattatgtcaaaagtcaagactatagtgaatcattattgtaccttgagtggctacacatattttctgtacatcatgtaaacaacaaagtttgacatatctgtcttagtttaaggaatgttgactgcatttcatttttattttactataggatatcatctgtggattccaaagagactgatgcatccgttttagtgaatgggcattttgatagtccccttggttcccctggtgctggtgactgtggttcatgtgttggtgagtagtggctacatttgatgtcgtctttgaatttaagagattattatatttgggaaatctaccttgtcaccttgagcattctaaatcttattgttcatctgatttccccacttttcagcatctatgctggaaattgcaagactaattgtcgactctggttgggctccctaccgcccggttattttcctttttaatggtgctgaggaactttttatgttggtaggatgttgtctatggaagatgaatggttattcatgaatggattttaccatgatgaaactaatgaggtattgtttgcttttgatgcttaagggttcacatggattcatgaagatgcacaaatggcatgacactataggagcttttataaatgtggaggcatctgggactggagggcctggtaaatgtgaagcaaaatttctattattagtagtaggataataagctaatcttcaatatctcagtccatcacttatgatgtgtgctatacaggacattttcactgaataatgttgctaaaattaacagatttagtttgccaatctggacccagttcttggccttctaatgtctatgcagaagcagcaatataccctatggctaatagtgcagcccaggttttgtttctcttttaacctccctatatctataatactctactgtgttgcttagccattgttttcccctttttatttactaattcaaacatgaattttctaatttaacatacaggatgtttttcctgttattcctggagatacagattaccgaatattttcccaagactatgggaatattcctgggcttgacattatctttctacttggtggttatttttaccatacctcctctgatacagtagagagactattgtatgtatccttgtgcttggtttggtacaagatatttgattgaaattgcaaatgtgtttgatgtattactctgtctcagacctggaagcatccaagcacgtggagagaatttgttcagcataatcaagacttttactaattctgctaagctacaaaacacctataaaacaaattctagtgaagttacagctagcacattcaacgatgagcgggctgtattttttgattatttctcatggtttatggtatgcactgaagttggtagattcctgcttttgctaatgatctgatactcctagcaatatgatcttcataattgggccatctttctctttgttgtcttatatataaattatggattttcagatattttatcctagatgggtagctaaaattcttcacagtattcctgtcttcttctttcttgttatgcccttcatgcatggtaggtcacattcttggtcagcagcattgtgtgattttataaaaggtaaattagtacatgcttactttcatttacttctttgtaagatgtttctaattgatctccttgttaatcactttaattttttcccataatctccataatctatattctaggagatttttttggcagttatcctagaataatttaaatattatttgtagacactttgaataatattttgtaatttgttggacttgcaggatttttgttccatgctgttgggattatattggccgttgttgttcctgttgcattttctatgctgagattactgttttcttctcagacaatgaattggtatgttcatttaacgttaactttaggcttcttgtagttagtgacagatttttttcttgtttaactttggtttcttgtagttagtgccagaatttttctttcttaatcaaattatacagtgggagaacaaagtatgataagtgccttttttttgtggccattgaagtatctgaggtgtaataatttaaaatcttaatgcattttctgtgatcatgtgttaacataattgatgaaacccaggtttgctcatccatacttggctttcgcaatgtttataccttgtgcacttgttggacttttaattccaagaattatctggagaaactttcctctttctcaagatatttccattgtcaagacatcgaaagaggtattgcagcacatattgaaatgggtttaacaagtctattgtgatccatgtttcatagtttttttttttttttttgatgaaatgattcattaataaacatttactttattgtttgggtctcaagctttacttagcaaatcttaagttgcttttgaagagtacgagttttatatcttggttcttctagttatcaaatgaaatttattgtccgatagaaaggcttaaaacttccaacaacagtgtctacaaaatcagcatacctactttggcttgtgctgccttcatgcgtgatctttataaatatgattgtgtggtcttgtgaatttgaacatattcttcatgagtgattccattttgtcttgttgttgcgagtctgaactttttgatttgacacataattgccaggcgctatctgatgaagcaaggttctggggagcatttgggttctatgccgtattaactttggtgtgcagatttaataaatagtcatgcaccaacacacatgcacatacacatatatatacacacacagcatgatttaatgtattctctttaatacttttgtgtggctaaacaactttagtaaaagcaggcttatcttgtagctgggttgagtggaggctttgtgactttttttgtgtgtgcttccctgcttcctgcatggatatccttctgcttgtcagtcaaatactttggacaacagtcactcaggttggttgtgaattcttatgtaattgtaatcattgtatttactattttcgtacaaataattgtgtgtcttgcttcatcttcggtcgtactgccactaatgtcattgactcccttcacattatgatagatttgtcttgcgtgtttgctgtttttatatgcacgctattatttaatctattttcattttgcatctgctattcatctccataatttttttttactctccaggtcaacaatgttttacatactacctctagttccatgccttgcgtattctgtttattttggtggctttcttacccagtttctgatagagaagatgggaatgatgggttctcttccactaccatatggttagtttatatatacacactccagtaattaaatatatgcatagtagattggccagtaattaaattaacttataatagagtggtttttaaggcctgggatgataactggaccattgtgatggaatcactaagctttatgctactgcatttgaataagtacatttataagtttatttatttaaaatcaaatgaaatgtatgtatgggattatctcgcttgaggtttcctttattgtaactcatcactttgtatcatgctagcaatttcataatggtcaaaatgcttgtggctgaccataacttcttcttgcagggcactatgttcccgatgttattgtggctgcattaattggaattgtaactggttggtgcacaggccctctaatgcccatatgtgggcattggttagccaggtcatccatcttgcaatttctgctacatcttagtgtgtttgctttggcattatcatctcagttctttccttacactatgtctgcacccaagaggattgtttttcagcatactttcctaactgcaggtattgattatcagaaatggcagtatggtggcaattataattttcttgatactctctgaagtaatcaattaatctagtgtctataattgcttatataagatcctcttatttgttttcttttccattatcattgtagtaccccaaatatcacctttttccccctctttgatctaatttctaacatttttcctatggtttggcaggctcaagtcagattatggaatccacttatgatttttctgtaactgactccaattctttactattccttttcaaacattcacctagagtggcaaaggaattgaatattacttcagagttttcatttgaatccacatcattgtctaaacgcaatgattggatggtaagttgcatgctgatataactatatgaatctttttctcacaggcagtttttcatctcactcaaataaaatgggaaagagtgaaataatatttttgtccacgtttattggttgttctttaattaatgaagttcaaggttgagtcagactcttcagtagttgcaaaatttcaagttggtgatctagctggtctgtttatttgttcagtagttgccatatttgtttatattacatgtattaaccacttttagatatactgttgttatcatataaattcattagtacaaaaacaactgtttttttttaatatatttaggcttgtgatttcatgaaattaactttctctttgcaggcaatttttccagtttcttttctcttctcaaatagtctcaagttccctgcaaaaagggatgatattttgaaacagtatgaattctttcccaaattgtctgttcaaaatccatctttaaatcccgaaaagggacccagaagagttcacttggagctttatttagggtgagtggatcatggtaccagcatagttaatttacagagttaaaaatgcatggtgtgatttcttgtttttaataccttggcctagtgtggaaatcttgattatactaattgtttagttgcataaaacctttttccatgttggtatcatactataacagtcaaggcgtgagaattagtgcaggggtcacaaattgtgatggtagttggactagtagtctgatttttttcaacttggttgatcttgtctccataaagtattttattatttcaatcattgtgaatttttgtctataaaaaaataactttcatctgacagtttttagctgcaatttgttttcgttggtctgaaatctgtttgacaccaaggtggtgatctgaaaaaagttgaaagaaaatgaaatcttaaaatacctaactttttactttgttttcatgtacaattattttcatttcagttccttggaagaggtttgggttgcggttctcaacatcactggtcctttatcaagttggtcatttgcagataatttgcttccaggtatgaaaattgtttcctccacttagttaggcgcaaactcaattctaagatagtattaaaatctatcccagtggttattggtggtcctatgagacctgttattgaatcattatcagatcacctacaaatatttaatcttacaaacttcatacttcagatgtctaattctcagcatgaggagggtatattggaaatcccatattgactagtatgtggccaaaatagtgtatataacttaccttataaattagcttttggggttttgttaagctgactcagatgtctaatcctcgacatgagtaggttaggttgaaaatcccatattaactagtgatgtagtcaaaatagtgtatcattgtatataacttatctcatgagttagcattttgggttgagttaagttaaactcaaaattctaaggggggtgattaaatgttttcattgcctaatgtagcctgcatttgcacaggaaccgaaacctatggtggtggtccacaatcatatatatgtcgtctcagtggacctagcgatgggaattggaccttctggttagaggtaaaatttgatgctgtattaaacttctctttactataacagcgtaattttattttgtttgataatgtcaggctaacagctctgaagcattaagagtggacctagcggttttagaccaaaagttggttgatccagtaaagagattgaagaatctttttccagactgggttgatgttgttgcatattctagttttatgtctagctatatcttctaattctttatgtaaacatttttagaagaaagagcaaacatggcatttatagatgcaaaaccaaaaccaaaatttgatactagatctggactgtcacaaatacgtctttcctgaatttggcttttttggggggaaaaaattaggagaagctatccctattacaggctgcagaatgcaaagtcatagggaatgcttatagtttatcaagaataaaataaaaataatttttttgctgaagcttaagagttaaaccaatgggttgcaaccgaaatgctcttttggtgctgaacaataattgaaaatcaatgtttcgaaattcatccattcccaattaacgacagtcaagcttcctggtacgtaagaaggcttaacttctaaattaatctcttttgtctgcgtttgttcatcttaagtttgattcgttgtgagttctgcagcatttgttgttcagtgtaacagaacctctttattagttataaacttcatcgttgaagattggtggtttggcctcattcaaaacttttacgtagccgaaaacaattgtattaatagatattttgcagaaaatggatgttcattaggcctatatctttttcattttgttttacttttaaataatattgaaatctcatgcaaatcatgagcatttatagtaaggcaaaggactcagtttttaaacaaataaatggaaagtattgatctttgacaaaagaaaatgataatgggaagttacaatggactattgagcagatatgtcgattttgtaatatttaggataagttaaggggggctaggtgcaattacgaaaattaaatttcagatgaagtttaatttgggtgatagtccggcttttacacttggacaccctatatactctttttttccgggaatatatttatggactagcttgtggtcatgggtccatttttgtagaaaatgtcggttataataataaatttagtttactatttaatattttgttgatctgtatccactagtcaatatttgattaaacaacaacgttacatgcactcttactgcgttggtattcatggacgaaaaatgagaaggaagcaaggaatgtttttcgcaaatagactctccaccaagctgtgtttatcctaaatatttccatatgcttctgccatgattaatactacaagcgttgtccaaccagtaaatggatgtgccccttttcccttacccttcgtctgttcgtactgttcccacaaaaatcccgtatgttgataattgcgcactatatttctgcagtaaagagaaaatatattatctaaaaaaacaaccaataactttaaacaggatttcaatcgaactgaatacagtcgacaatacctaattaaattgcttctcaattcttcgtagatggttttagctttctcttgatatggcccattctctacaagattcaacccaaagattagtttcaggaagaggaaggtataaaatatagtgggaatattagcagatattttgccttggccagtccatattacctttggagtaatggtggagcgctgaaagaattctgtaattcatgtttatccaaattggacctctccagtatggagggtcatgctctgtgttgtgtttcatgtacaaggaactgtgtaataagaaatattatttttggttcactataatcaacatatgctgaataatgtcgttcaattatatccattaaaaaatgcattagagcatagggtgcaccttgttttggcaagagaacgtaatccatagttggtccataagaggctgcgatttgaaatgagttcaagctgcttttccagaatccgtgatccctgaatgaaacagaaaataaacatctatgaactgaaatcattcaagcaacgaataaattcttagttcattgcataaaaagacatgttaatgagaattaatgcacatcacttacagatggaatgatcctccccatgaacgggaataaactaacataaccaatgtgaggaaccaatctcaatacaggcatatccataacattccggagaagttggcgagtagcataattttgtgctgcctcaggttctttccatttaagttgaacctatcatggttatgtaaagaaaatctcattcttggtcatgaatagggaacccatgtattggtaatcttgcaacagtatgcataaataatactaaatacaaataactatatactctaccttctctgtatgatttccaaaatcaaagtaagcaccatatgcatcatcaaaatgcatctgtatggacatcaagaacaaattaggcatacacactattattgtagcaaataactattaaaagtcaactgcatagtttgctttcaattttctttttattaaaaatcatttaaaaacaaaaggaaacttagattatcattattttctccatgtcaaacaccatatgttatccatgataaacacatagaatcttccatggaacaattgctgccaatagataggaaaaatagttggaaatttcaattgtcaagagaaaacttgaaaaaaagattccatgttaatgcagtgtgttcataatcaaaggtttttatatataaaagatgttcacattcttcaataattccataataataaacttggagaaggcctagatgagtatcccccacaaggatgagcctcattttctatgaaaagtcaagaaaaaagaaaaacccaggaatgtgtgaaagttttctaaatataaaaagttttctttcccataaaacagtaatttgttttccatgtttaaaattcaacttattctataactgtatgtgctaagaaagttttcttttctcttaattccccctttttatttctctcctctttatcttcactattttgctcctgttccagtgctgcatcaccaagcagggatgcaccaccaccacaattacaaggtgtgcaacagctctaaataaagggagatgaggagcaaaggtgcaatacctggttcagtaactcaaaatccaatagcaatttagcagtagaaccataatcctgcattatttcattcaatatgtcaattaaataaggggattaatctgctgccaacaattaccgtactagtaatttatttttcaaattataccatgccaggtttgatttccatatccaacaactcttgaatggaatgcatacagtctgctgcaagtaacatccaacatctaagatccaagtggcgttcatcttcacttgggtgtgaagctcgtggataatcatccaaaccagaggacagtgtctgaaaatgccagagataatgtttgttaggagcaagggtcatcatcagggataaggaaagctttgtcaaaattgaccaacataaacaccgcaactgtgttatgtgatcctaggatgtaatagatcaaagaacaactaactacaagtgagaattctggattcaaactcattcagtgctcatgtttatggctttctagtttctagtagcaacagagaaagccatccaatagactcattttattttcaggaaaaaaatgtgtcctattgtattctttgagtaccatcaaagatatggaacaccaacagcctacaaattatcaaatatgtaggaggcgggcgaatttcttcgtatattttattgtatttggcaagaaatctagagcaactgtgtttgcatctctatgcttaattaggattttggtctctgttgtagtagctatttatcaatgaatgtggttgccttaacattaacttcttataaaaccatgacaataatggtaaagtcaatctgctgaaatacctatatagtatatagttcagattaaaattgtagataagtgctgaaattaaaaagtatactggggatgcatattagaaccttaggatttatttcacgcattgtcctattgtcccgtccgtgccaatagtagctgcccatctgtttccctttattaaaaagtgatgataacaatgataataaaagggtcaaaacaaagcaacctatttctagtgatcaagcagacagcacgtgcaatagtatatacctgactgagttgtattgaaccaatggaaccatgcttccaatcgaacaaaggcacgttccaggaatagagagatctcacttctatccattgcagtaaactcattattcttcaagccattaattatatctacagaaacagatttttaacctaattcaaaatcaccaaattaatgtttcacatacgtctgatataaagtgatatttatagatataataatgtacttcataaaaattgtcactttccataaatttattactcagaatcatctaatgtatcatcaaatccagatcagttatgcataattcctaatttaaatgaagaatgtgcaaaaggagttacatggatatgctaccacagaagaggtaaaaaataaccaagcaggaagttgttaattatcatccctcaatgaaagggaaaacctgtcacatgcagcctggggtcctggactcaaggctcaagctatggcttgcttgaagtaaattattgtaacctatttataacaaggagaaatagaaaaggaacattagcatataccattcaatgctaaaaacagagttggaggatttccattagttggatgctgaggaacaaattcctctgggacccgactgcaagtacagaagaacctatatgtcaataggaaagctaaaaactttaaatttactgcaattatttgaacaaaatgtttagtaatacacctcagtgcttcagcccccaaaatttgttcacgcggtatccatccatcaacattcatcaaatccaaccaatgcccaatgatatccaatgaaatatgaatatcccaacgcctggttaatgtgcacaagtgcaaataaagcatatgtatacatcaagagttatttatttgttaattaatacaggtaagtcttgtgcattcaacgacaacaacaataataacaatactagtggtggtggtcatgaaggatattactaaaacaaaaaaactaaccagattataagttgatgaaaaccttcatcccataaaaatcctcttggaaagaaagatcgacttggtacagctgtgtaaagctcagcagaccaatacgacatataattgacatgttctctaagctgcaaaggaaaccaacccactgcatatctatccaagtctaaattgctgacagctaattaaaagtacaaaagttggcaatatcaagatgtaaaaaggaaaacaaaagtcactgacagcaattaattgaagagtaccaaattacactgttagggagagaaatatatgaggaaatgaggcaaacagaaaattaatacaaacctagctactgacacaggatttgttttcaagcctaaaaagatagacaaatgcttcacaacatcaaatctaattaaacttctatgatgaaccagagtgtgaccacctatcaagaagaaattttacaaaatggtggttctacacaaggcaatggttgtgcttaagaatattgccttcgctagcaaaatgattgtagtggtttcctttagagtcagattctcaattccctagcaaagggtaggattcaaaggaatggggaatgagaagcatacagtcaatgtaactcacaaatccttgaatacttatgttatgaagttacgcttctttcatttctttgtttttcttccgatgtggagatcgttcttgctacagaatttcagaggattccagctggggatcacccatttcctatttctttgctttctactttttttataaagcaaaccattttcctatttcttatcccagtcaactactgatgcaggagctttttcagattcaaatttcttattggtttaagtcttctaattctaaatccattgatagttacaaggatttaaactttagactaaatatttccacttcactcaatctctggttgttcaaaaaaatattattttattccatttgaagtctaagatccactctaaggattaatatcacacacatgatcaaaatctctcctattgaatcacatgtccggcagttagatatttgtggtgtaagctttgataatattggtgaattgtgaatttgtacaaagagcttagaacattttctccaattagagggttctaggagaagggatatgaagggcaaggcaacttggcagtataaaatgttcactgttaataggtgattatggttagtgagagatgcgagaaatgcaaggttacatttttttttatattggttttacaataaaatagttttactctttttagcaacttcacagtgttcagataatatttatttcaaagtcaaatctttattgatctgcagcatgatttgctagttaattagcttgtctaggttttcagtaagcattaattcatttatggatgcaactgaagaaatttttaatttagccagaatcctctttattggttagcaatcctctgttctcgtacttctttttctcatctctaaaatctcctctttaccaacagaaaatacaacacaagaaacaaagctttcacatttatgataatcacatgtcaagttatgcactattaaggggtggtatacacttcaataaggactataaaaaacaaaataaggtaacttacattaaggattcttgaaagagcaatctttgactggccatagaagtacccgatgccacctaataagtttccaacagcagccttaccaacagataaggcttcggaatccacctggaaatccactactatgataaagaatttatatccatcaaggataagcttctaaacaaatttactcaagcaaatgaaatttgagagatccaggacacatcaaaagacaaaacaagaagaataagggttgttttggtaaagaacttaatttaagggcttcttgaataagtatttatcatgtaagcacttgtatagtttttataatcaaagaggaaataggtttaaactattttcatataagttgtaaggttgctttcatgatattttggagaagttactgaaataagctaaaataacttatgaagataacacaagttgttttcgtaagctttccgaaacacttacactgctatatcataagataagtccaagtaagtaataagttcttccaaacacaccctaagtaattgaatttgagagaataaaataaaaaagaagaagacaaaggacaataaaattagtaccttcttggccaaattgaaaatcttctcaaacttctcatcaaattcttgttctttatatttcagtttattggacagtgaggtacctaacaatgagcaaaataacaaataaacaattacacactagcatgtagcatcctaatgccaattagaataaaataatctgtacaaattcggcagttctctttaaaatatataatatttaatattcaaacaagaaaacatcctaagagaaagagacaaaccaaaagccttttttttttggtcagcaaaaataatatatatatatatatatatatatatatatatatatatatatatttaaagagaagaaagaaacagtacaagtagaaaaaagacaaaaaggatccaagcaaacaggacctatggcagcctaattcatgagaaaaggcatgaattaaactgccagaagtctggctagatcgaaagaaaaccctcaaaacaggagaagacttatacattaagtcctcccctgattaaaaaaaatgtcacccagattacaagaccaaacatgaaaaagaatattgaatcctttttctaaaattttaatccacatccagcaggtaaatatggcttcttccataagcaagtttataaaccccaacaatgtacatcaatatgagaagcaagtttccaaagcaatgaccaactcgacaactcctacaacaatgtaaaggactagattttttcctcctttttgatgagagcatgcatatatacatgtcagattttgtacaaacattataaagaagcagagaaaaacctgtaagcatactaacacgctcttcttccctagaagtttccaaatcagttccagagattagtacaatatctgttgtgaaaggaaatccaccaataatctgcagcacaaataaaaaaattgagaagcacatatgaagtgaaaccgtaaggaaagatgttttcaagagtagttggaaagtggttgtgtgtgtgagtgagtaagacaaagagactcaaagattaaaaatgttaaacgggtattacaaagtgtacatggtctatttacctgaaaaactaacacatttggagaatcatctaatgagtcagatagctgcagtcgagcatgcttttgtatctactaaaacatgtacataaagcaaagatatcaagggaaaaccccaaaaaaaaaaacaaaaatccataaccacattcttgcattacatgaaaattatatatcatcggataaattgaattgaactgaaataccctaacctacttgtgatgcaagattttcctctacgagatcagacaaattgtgaaagtgaggtgtgcgaaatccagcataatgcagctgcaaatcatcctgaaaattattaagcataagaaaatgaatagcaggttaccaccaggcataatattacagataatcaagagataaaaatttctacattaaggcaagagaggaatgatttaaatgggttatttatcgatgaaaggaaaaaggaggactgggaattttatcaaggtagttaaaatattaaataatggcatatacatgtttgctataaaatggggacacttattggtttatcatattcttaaactatttcaaagactgaaacaggaattgtgggtgcttctttaaggaagtgtaagtcaatcacaagcagtaaaccataaaatctataaaaaaaaaaaaaatgtccaatggtagtacaagtaacagaatcttgaatgttcaatcattaccgttgatttcaaatgtagctgccaatctccaatatctgctcgagagccagatgcaagcaaagaatccacgtgaatgttcaagttttctctaattacatctagagcattaccagcttcatcagccaaatagaaaaagagctgggcacctctcccaaattcctcattcctcttggatctgaggttcgaccacaagaacaaagacactcaatagatgaaagtcactgaatagagctattctaagaaatgtagactcataaagggaaacaataagaaagatccacaggaaaattaagtattacttattatgttatgttataattaattcaggaaataagtcaatccaaaagctaacttaaaattaacaagggtgccatgagaatctctaacttcaacaaactggctagcatctacttagcaataaagaaaaactacaaaaaaaattattctgtcgcaatacatatatgaaagtgatttgaagttgataacatcactcacttatccatttgcacattaattcgaaccgcccaatctccaccataaccactgccttcctcttttgattttaaaaacccagtagtcaaggtcaggccatggtcaaccagcacttgatgtccaaaatcacgtccattgtgccttgtccaaccataagtacctaggtcatcctcatgtctgcaaaaatgccgcaagtgatatttgccatccttcacaccaatccacattaatccagccatcaaagattttggagtcctgaaatagaaataccacccaaaaaaaaagtgagaatgcttgcatgctgagtcaaatatcgtcgacatccgtatcctaaacacaatctatgccaaaatttgggcacaccagtttctgtgtgatgcacaatttgcatgcataaataattcaaattactcacaactcgaaatatatacaaaccctgcaccatcaacaacagtataaggctataagccttaaccaccaaaatagtctcttacttcataattccatttcagcgcaaacaaaacaaagctgagtctgaatataccttgtggtttcatcaatcaataaacaaaaaacacacctcaagcatacacacacacacacacacacacacacacacgaattgtgcttcagaaacggtaacatacctggcgcgaattccgagatacacgtgaggacgataagttccccaatacaaactctccttgtgctcaccttcaaactgcaacagcaccaaccaagtcattcttctttcttcacgcacgctaaaatcgtcgaattctcaaaactgaaaagaaaaagaatggggaaagttgaaagttgacctgaggaaggtccattatctttggcgcgggaaatggcgtgacggcgcgaggaagcttcggttccgttacggaattggagaggtggtggatcataaaccagatgatgaagaatgcgacgaagcagataccgagcagcactttgagattggcattgttgtatatcggaatggaacttccgtatctgcttctctctctttggcgattgaacggaggcctcttatgtcgaagagaatcggcgtcggcgtcggatctcactctgcttcgaacggtacttcttccacttccggtcatttttggcggatcagagattcacgccaccgcatgcatagggatttggagttcgagtggagggagtgtttgcgtagcagaggtttcggtgttaataggggatttcgcagtgtagcagtggagtttggaaggaagaatcagaaggaaggagacgagtgacttgaccgataatgggcacgagcaaggaaattatcgtgggatgaattggactctgctaaatagattatataaatttctaatgggaaaaattttatacacccagaaaaagactcatacaccattctatttttttaaatggttaaagtactctcgcattatacaagcacggattcgtgaattcgtaatttctttttaagtcatacggattggcccaatccgtacgtaagtttttttttaagttaaaaaatattttttcaaataatgacacatgtaagtttcaaacatgtgaccttcaggttattaacacaatgttttaaccaactgagctaataggtcaattatgctaaaaactaattaatgttgatacatataacattaaattttttaatgtatatttaatacacgtataagtttatataataaattttgtaacaattaattttgatataataattaaagtattttttatatataaaaatcatagataaataaaaatcataagtttaataaaaatttgcaggtttaataaactataaatacagatataatttttaatttaacttgtaaatacaaatataatttttattagacctgcaaatttttattaaaattatgatttttatatgtaaaaaatactttaattattatattaaaattaattattacaaaatttattatgtaaacttatacgtgtattaaatatacattaaaaaatttaatgttatatgtatcaacattaattaggttttaacataattgatctattaacttagttggttgaagcatcgtgttaataacctgaaggtcacatgttcaaaatctacatgcatcattatttgaaaaaatattttttaactaaagaaaaaacttactttggtgtataaagtttttcccatttctaatacactatatatttcttagaaatttatatattgtatttaacacacaaccacaacttgctgaagtttggactaacctggcccaaattcaaccttattttagtaaggctttttcttcttacactatagaattttcaacatacactatattgtaatagtgtataaccgaaaatacctatgtttaggtttttattttgaaattgttcaaaaccatcagctggtgcacgcttcctctactttgacttccttctttgtttgtgctttcttcttctctgtggtggtttgacggtggtggcattgctccggtttgtggtggtcaatgagttgcaggtggttggtgatcgtccttgggctgcgccgtcggttacccgtgagcgtcatttgatttgatagggtgattagggattgtggaatccgtggatatgatacgaattagtcattccataaaaggggtttggggggcttacggattggacaatccgtatgaggcatacggattacacaatctgtaagctttatacgaattgcctaatccgtaagcttcatatggattgcataatccgtaaactttatacggatttgtttgataaattgcttgaattgcctaagtttttcatatattattatgtttgatttgagaaattacaataaactaaattggtaaatgtgatgtgtaatattgatttgagggggttttaatttgaataattatcgtttgacatttgttttaagtttgatgttttgtttgtgttactttagtttttgcacttgcaatttgaatacttattgttcttgcaagatacctgggctatggaatatatcagttttctttctaaatacttattttagtttgatcattattgaaattatgttgaatttccactaatgataaacttagaaatggtagtttgttgaaaacttattggccattaggctatgtatttgttttgtgttattgattgttcttgcaagatacctggttgggctatattcattgttttgtgttattcattgttgttgaaagattaatgttaggcatagtgatacctgtgaggggtatacgtgtgatgtacttttatcagctaaccttgttgaaccaccatcaacaatgcgagtttcaattatgaatgattaatctcagcataacgatacctgtgtggggtatatttttgttttgtgttattcattgtcgttgcaagaaacctgtgtgttggctataactgtgttattcattgttcttgcagaatttggctattgttttaagtttgatgttttgtttcatttgttcttttattttgatgagtatgtgtgaaaagttcgtgaactgaataagctcttggattattattggtagaggaaatggtgaaaacattaaacttgcgtaaaaatctggagagacctgctgctgcagaggaaggcattgaacgccgtaggtctaatgcctatgctcgaagaagacgagcagttattcctgttgttgaggaaccagttcctcaggacgtgcaagttgaggctaacactacatatgtggtagatgacataggtagtaaatctgaaggatttccaggtggtcaggaagacccttcgattttgaaagggtatagtaaccacgtcgcccttagagtgtgggccggagaggtaatttgacgccaaggtaatttaatgcacatgtaagttttattttacaacattaaattattctagtatttttgttgttgttaaaatttaattaaaataataataatacacatgaccacccttaaaatatccaaattattaccaccggttattaattatatatgaaacaaataggtttttttttctttttctttctaatgaagtataagcgtataacaaatataaccatatttttatatttatatatatatatattaatcgttaattttttatattcttaatttgttgcaaaataacaacacattgatttattttttatacaagtgaatttatttcttatgttaatgcatgtgattgtatgtttgtgaccattagataattattgaatatttgaaattgaatattacacaccaaaaacaaaatgaaatttaatattaccgtgaaatttaaaatattaattcttaatggcaccattcattcacaaatcatatctcagcatgtaaaaatttctcaagcttagcatttttggtgtagttcaagataatctgtaggttctcttgttaattcatttttcttactgttttgtatctttgaattcttttattttagaagaaaagcaataacattacttagatgacaggacgccagctaatgctgtttttctttctttctactcgcttagaacttagacgaagtctaatatgaagtttaacttcttccctcatccgtgtactcccaattttatcagtaatgataggtttgtaacaggaatatatatatatatatatatagatagatatataaattaaataaaatcattttaaaattattattttttattttcttttttttaatctccttccctacaagccttcctgaatgctcttttatacgaatttatatgttacaaaataaaatttatagataaatttgcatgtttgataaattaaactataaattattagataaattaaactataaattaattattatatcaaaattaattgttacaaaatttattatataaaattatatgtgtattaaatatacattaaaaatttagtgttatatatattaacgttaattatttttaaacataatgggcttataaaaaaaaacttacggattggtccaatccgtaagattacggattcgtcaatccataaaaaaaaactcatacggattgcctaatccgtaaggttcttacgaattcgtcaatccgtatgaattatgcggatccgtatgaaacaaaacatgtaaaatagtgaaggatattttggaaatttcactgttacgaaaatggtgtattagaaaaacgaatggtgtaggaagcaacattctatttattttgataatgatgatcattagcggataagtaaaattacaaaattaaatatatttcttatgactattatatatcatgttaaaattacaaaacaaaacaattttttatctaaatattagattgcatatcatgaatcattttgtaaaataattaaattaaatttacttgaccgtatatcatgttatatatatatatatatatgataaatatgattatcataatgtaataaaaaacatgaaaaaataaagaacaatactttaaattaatttttttaagaaattgaagcgtagtaacaaaatggcaccaagataacaataataaaaaaatgtcacctatataagatagagcaagttacctttcttaattcatgaatcatatccataatgaattctaattaacaacatattaacactaaaaatactaatatagtattttgataatttacaactttaacatcaattagcgtcattagaaacgtaaatgtgatattttgataatttacaactttatcactagctcttgtaaatagaaaagtctttcccatttaaacttttttaacactaaaacagtaatatagtaatttgaagatttaattggcatttagttttgtaaatattgaaagacataaaataaccaaatcacacaaattgatagtgttggtttggttgagaggtttggggaggaggaggtaaaggaggcaatatggcaatgcaagtgacaagttggaatccatatgatggagagatctaaaaaaattgtgtgggggttgagtggtttaagatggtttgatgaaggactagattggaaaatggaaaaaagggataaaataatttttgttgtgatgcataagagggagagcaaaactttgccaatttatatctcatactattcctcattttattgcaaaaatttgacaaaattgacaatatgggaaggtgggaaggagagacgtggagatggaaatttagttggtgtaggaattatatttcttaggaagaggacttgcaaagaaagtttcaacaacttgtatcaagtatgggcattgataagaaacggttggatggttggaggtggaaacgaaatgtggatgagtcttattcagtaaagacaatatataatgtcattattgggaatgacaggaaccaacagacaaacaaaattgttgttctatatggaaggtaaatattcctccaaaagtgatcttttttttttgtggagattgtttttgaacaggttggccactttggacaacttaaaaaatgtgagggtagccgcgaaaggctctatattgtcttaccattatcacctgaggagaacttttggcaaaaacttgggtctgcaacttctgaacggaacacaatctagtgtgtgatggtctgacacatttggaatttgtgtaatgctattatttttggatgtgtagtttatgttttgtaaaaattgttggaccaaattcttttcacgagctggtcatggttgaaaaatagttcgaaaacatttcaattttcatttgcagagtggtctctgaatacggttgtctgcttatacagatcttaaacatggtgtggaggcttggaataatggaaattcaaagggtgataggaggagtggtggccaacaacttgggagaggaggaggattcaaacttgataggaggagtggtggccagcaagaagaagcgagacatcagcgaacagaagtgagccaaacaaatttagtaaaacgcaattttggacagcaaatcaaccaaaattaactcctagcagcacagagatgtgtgaaatgagaaattgaagcccaatctagaccgaacgcaaacagaagcatgaacaggaacaatcacgagccaaataatgtcgtgcacggacaagaattgatgttgaacagtaacgaacatataaaggagtccaaaccagcttcaatcagcacagacaacaccaaaagaaagatccctagctcaaaagaaaccaatcaaactcgtacgaatgaacaggagcaagcgcaatgaagtttgcaatcgtaaatcagatacgcatgaacaataaagaaaattcaatcaagaacaagactgaaacaaacaggaaatctaaacagaacttgtgagattgaacatgatcagtgcaaaatttttgctgttgataccatgttaggtaaaatgaacgaaagagagagagagagagagagagatggacagctgaatttcttttatttcgaaagaatgaaaagtagttacaaactgtacacgtgaggtatttataacctcttaccactaacttgatgaaaatacgggcttctctaaaacaaccctgacaagttggagagcagtatgattgtgtcctatctccacttctttctatttaagttgaattgagcatggttaagtacgtgaagaatatcctcatattttcagacatgattaagaaacatgcattgctattcttgcaacggtaagcaaactaaaactgaacctaaataactagacatttccatggaattgcagaaattttaaaaatcttaaaaatgaaagaatttgagataataactacaagtatacgaaaaaaaaaaaagataccttttttatatgatttccaaaatcaaagtaagcaccatgtgcatcatcaaaatgcatctgtatggtcatcaatcacaaattaggcattgcacagttatggtagtaacaaattgactctgggtcaccatgcaaacattaatctgctttcaattttcttttctcaaaaacatttaaaatagaaagaaaaatcagattattttctttatgttactacatcaattatccggactatattcaggaatcacggtgggaaacttcaattgctaaaagagaacatgtgaaaagattccgtgtacatgtagagtgtttatacttgaaggtttcatgcatgtaaatgcagcaggggtccttaaataagtcaacaattcactttaaataagtcaatagtctaacttggacacaacatcaatccacattaatcttttatagtgatcaattagtcattttctttgtaaaatccatgcccaacactttttacgagtccgtactttgtaaaatccatggtattgtaagggcccttgactagaaatctctaaacattatgttacctttgttttacatgaaataatctttttatgttttgaactctttgagctcactagtctaatcataagatatgctcccttactaattgcaacgaaattacttgtttataatgaagaacttcatgcctcttatcactaatttattatcatcatcgagtcgaaagaattttagaatcctgccttctgattaccaatgtagtacaattggaaatttcctggaatgttgcggtagcttctgaaaagtatgaaggtggaggaatgttttaaccccgaaaatgtgtaagaggatctttgatggtgatgcctaaacacacagatgaacttttggaatgataactttttgcctccacttatttttgttgacagaacttttaatttgaaatgacccatacattatacattattattgacaatttgactcccaccaagggagttggagggttattatacattgttgcagtatgatagccttatgagaaattagatgaccatcgtgtaatatgctatgaagatcttgttggtttgattactccacagtgaataaaaggtccagtgcttgggtaacgtggtttttctaaattatgtcatattcttccgccatgattaatactacaagtgatgtccagccggtaaatggatgagacccttttcccttaccgttattctgatcgtactgttcccacaaaaatccagtttgttgataattgcgtactatatttctgcagtaagatggcaattattatttaaaaaccaaccaatatcttgaaacaagattacaaaggtaccaaacaaaatcaaacaatacctaattaaattgcttctcagttctttgtagatagctttagctctgttctgatatggtccattctctacaacattcaccacaaggtatgaatgaagtgaaatatttgcagatatttggcctaggccagttcatattacctttggagtaatggtggagcgctgaaagaattctgtgattcatgtttatccaaatttgacctctccaatatggaccctcaagctcagagttgaatttcatgtacaaggaactgtgaaaaataattattttttggttaaccataagcaacataagctgaataagaccacacaaattcaatccattaaaaatgcatttgagcataggttgtaatataccttgtcgtggcaagcgatcgtagtccatattcagtccaaaagagactgtgatttgaaatgagttcaagctgcttttccagaatccatgatccctgaatgagacagtcataataaaattatgcatatggagttattaggttgacttaatgatttaaggaagaagggaagaggaaaagattgtgggtttaaatgttttccactaacaaaaactaattaacaactaacatttgtccgtctataaaataaaatatgcatctaattgtgaagtcagtcaagcaaggaaaaatttctcagttcttcttagcataaaaaattcatgatattgagaatacatacattacttacagatggaatgatcttccccatgaatgggaatagactaacataaccaatgtgaggaaccaatctcaatacgggcttctctaaaacaaccctgacaagttggcgagcaggatgattgtgtcctatctccacttctttccatttaagttgaatctagcatgattaagtacgtgaagaatatctcatattttcagacatgaataagaaaccatgcatagttattcttgcaacagtaagcatactaatactgaacctaaataagtagacatttccacggaattgcagaaattttagaaatcttaaaaatgaaagaattcaagataataactacaagtatactaaaaaaaaaagataccttttctgtatgatttccaaaatcaaagtaagcaccatgtgcatcatcaaaatgcatctgtatggtcatcgatcaatcacaaattaggcatggacacagttatggtagtaacaaattgaatctgggtcaccatgcaaacattaatctgctttcaattttcttttcttaaaaacatttaaaatataaagaaaaatcagattattttctttatgttaaactacatcaattatccggactatattcaggaatcacggtgggaaacttcaattgctaaaagagaacatgtgaaaagattccatgtacatgtagtgtgtttaaacttgaaggtttcatgcatgtaaatgcagcaggggtccttaagaagttcacgttcctcaatatgttaattaataataatgagcttgaagaaggcccaaatgaagattacactcagatgagactcattttcattatttatatttaaggaaaaagtcaggcaaagccttgcttttcaaattggaacacttgatcttccattttggataaaagctcaataaataactaaataaatagtcttctaaataaagaaataaaaaagttttcttttccagaagagtaatttgttttccatgttatttctagttctatttattctatagatgcatacactgttctatttcctcttttttcgtcccttttatttctctctcctctttatcttcacttgttttgctcctattccagtactgtatcaccaacagcaaagaagtgcaacaaccctgaagaaagggagagagggagcaaaggtaaaatacctggttcagtaactcgacatctgatagcaatttagcagtagaaccataattctgcatcatttcatacattatgtcaattattttaggttatttaactttctgctgcctacatttaccctacttgatatctaaaatttacaatgcataattacaatactgttgaatttacttttcaaatttatactttgccttgtttagtttccttattcaacaactcttcaatgtattgcagactatcggttgcaagtaacatccaacatctaagatccacgtggcgctcatctgcacttgggtgtgaagcacgtggataatcatcaaatccagaggacagtgtctgaaaatgccagaaataatgtttgttaggagcaagtgtcttcatcaaagacaatgaacaccttgtcataatcaaccagcaaaacaccgatggctgtaataagtggtgcttgaatgtaataatagctcaaacatacctgcaagtgagaattcaggtttcatgctcatttttttggaataaaaaagtcctattattgtatcctattagtaccaccaaataaattgaccaccgatgccaaaaagccaaaaagtgacaagaaatctacaacaatcgtgtttgcagctttatgcttatgtaggttttggccttctgtaatagcaatctttcaataaatctcatttgtggttgccttaccattagcttctttttgaagcatgccaatggttgttttggtcaagttaatttgctgggctatctatatagttcagattgaaattgaattcacagaaagattaaaaataaatataccaagaatgcatattagaaccttgggacttaattcatatatagttctattgtttcgtccatgccaatagtagctactcatctgtttccctgataataataaaagggaggtgggggtcagaaagaagcaatctatttccagtgctcaatcagactacacgtgcattatagagtatacctgactgagtaatattgaaccattggaaccatgcttctaatcgaacaaaggcacgctccaggaacagagagatctcagttttatccgttgcagtaaactcattattcttcaatccattaattatacctacaaaaatagaattttaaccactttggtaagaattttttttcgtggtgtggcgagcagagagatcaagaaatatacagaaaaaaagttctgtactgcttcatagctaagtaaaagagggggcaataactttcatatacttgcattggatctatgtcccatataaagcatttttccacatttcagcagcaccaagatatttcaacaagtaatacatcaccaaactaatgttaaccatatttttttacctaaagatatagttatagatataattacttcatacaaattgtcaaactgtctccataaatttattactcggaaatattgaagtatcatcaaatccagatcaattatgcgtgataccaaagatctagaacaagcgaagttacaagggtatgttatcacagtcacagaagagacaaaaaaataaccaggcaggaagctagttgctaaagtatcgtccctcaagctcaaggaaacaaaaaaattaacatacacaaccaagcctaaagtcatgctagctcgaactcattaatggcatatatgtagccttcttttttaaataaagattctcataactagaagaaaaaaaggataatagaaaggaacattaacatataccacttaatgctaaaaacagagttggaggatttccatttgttggatgctgaggaacatattcctctggaacccgactgcaagtgcagaagaatctaagtcagtaggacagctaaaaattttacatttactgcaattatttgaactaaatgtttttactacacctgagtgcttcagccccgagaatttgttcacgtggtatccatccatcagcattcatcaaatctaaccagtgtccaatgatatccaatgaaatatggatatcccaacgcctggttaatgtgaacaatataaaaaaaaacatatttacagatcatatattatttgtttgctaaataataccagtaagtcttgtgcggtcaataaaactgtacttaaactgaatttcaaacaagacaaatgataatgatgatagtagtagtggttgaggtcatgaaggatattattagcacaagaaactaaccagattataagttgatgaaaaccttcatcccataaaaatcctcttggaaaggaaggtcgacatggtacagctgtgtaaagctccgcaggccaatatggtatataatcaacatgctcactaagctgaaaagggaaacaatccactgcatatctgcccaagttctaaattgatgacagctaattgaaaggtacaaaggatagaaatagctatacacagctatgcttatgcctatgacatactcttcaataagaactataaataacaaactacactaccaaagtaacttacattagagattcttgaaacagcaatctttgactgaccatagaagtagccaatgccacctaataagtttccaacagctgccttaccaacagatatggattctgaatccacctggaaatccactactatgataaataatttgttaacttctaaatcaatttactcaactaaatgaattatgaaagattcataacacatcaaaagacgaaacaagaagtataaatcatttaatatgagatagttaaacaaacaaaaaaaacaagtcaaaggacaataaagttggtaccttctcagctaaattgaaaattttctcaaacttttcatcaaatgcttgttctttgtatttcagctgattggacagtgaggttcctaacatcgagcagaagaacaaacaaacagatacacaaggacttagcatttagcaagctaatgtcaatcaaaataaaatattctacaaattcaataaaaagttgtctcgttctccttagaacatataatgtttaatgcaaaagaatcctgagataaaccaaaagttgttaaactatacaaataaacacattgaattcagaataaattatagaaataatttggtttttaagctagatttgaatacaaacacagggttttcccctaacacggagtttcctccttcaaaacaccagaaaaagcaatccgacatcttaattgccttctacaagtctgtcacacaacctatatatcactataactgtcattaatccgaaattaatataaaaataaatgcttaacaacttcctaatacaaaattatagtagcctaattcaaaacttggcctatcaaaagccaaaagaaataaaactaaacacataagcccctatgtcgtccttcaacatgcgaagtaggttttcagagcaatgaccaactcctacaacagagtaaaaaactaaaattttatctgcttttacgtgaaagcacataaatataaagcgtagtttgaacaaacactataaagaagtagaagaaaacctgtaagactactggcacgcttttctactgttgaactttctgaatcagttccagagataaatataacatctgttgtgaaagaaaatccaccaataatctgtagcatgaataaaagaatgagaagtgcatatgaatatgataggaaaaccatgatattatccctccaggaccagaactttttgtttcagaaggtgaatctatcaaacttgatcagccattaacaagtaatccaaatgtgggtagatttggtcagggggatgcggaaatagtacttcaagtttgaagagatgaaatggaatgggatatactattcaattaagctatattcaataggagaaatagagttaggtccaagtcctgtgggcttgcctcaactaatgagactttgtaacaaggaaaattagtgacaagttagttagtaaattatactgatataaatagaatgtagaaagaaaaaggagtcccttttaattggatatcggaaatcattattccatgaaagaattcaccaataaagatagttccattctttctctatatacttgtattgcctgatacagttccttagagaatcttagaaaagtgtaaacgctgtattacctgaaaaactaatacatttggagaatcatctgatgagtcagatagcagcaatcgagcatgcttccttatctacaaagacatgcacaaaagcagagatatcaaagcaacacccaaattaataaataacttccataaccacatgctcttgaattacatgaaaattatatcatcagataaattgaattgaaataccctaacatacttgtgatgcaagattttcctcaacaagattggacaaattgtgaaagtgaggagtgtgaaatccagaataatgcagttccaaatcatcctaaaagagaaaaaacataggaaagtgaataaccggttactaccaggcataaattacagataatcaacatagggcaagagtggaaatggtttgtatgggataattaaaggtcaaaggaaagaggaggtatgaaaagtttgttataggtagttaaaatactaaataagggtgtgttacatgtttgctttaaaatgcggagattcataagtttagcatattctttgactgtttcaaagaaggaaacatgatcgtggactcttctttaaggaattgtagtatgactgtatgattaattaaccatgaactccaaaaaatgtagtacaagtaacagaatatttaatattcaaccataacatcacttcctagcattaccattgattttaaatgtagctgccaatctccaatgtcttctcgagagccagatgccaccaaagaatccctatgaactttcaagttttttctaattaagtttagagcattaccagcttcatcagccaaatagaaaaagacctgggcaccgctcccaaattcctcattccacttggacctgaggttggaccacgagaacaaattccctcaataaataaagtcactaaataaagcaatactaagagaggcagaggactcattaatttaatcaaatttgtttatcctaagaccccgtaggaggtttttattttattatttttctttctattttgatagtttgaataggtttatgcatttatcaaaaatatgaatggttcactcgtacaggtcaaaaataagaaacttgagccggaaaattaagatcagtgtttttattttatgtgttgtcattcgtcttgccttacttcaacagacctgctaggatctactttactataaggaaaagctacaaacaaaattgtttagcctcaatacatatatgaaaataatttgaagttgataacatcacttacttatcaatttgcacattaattcgaactgcccaatcccctccatagccactgccttccacttttgattttaaaaacccagtggtgatggccatgccatggtcaatcagcacttgatgtccaaaatctcgtccattgtgcttagtccaaccataagtactaaggttatcctcatgtttgcaaacatgtcgcaagtgatatctgccgtccttcacaacaatccacattaatcctgcaatcaaagattttggagtcctgaaatacaaagaccaccaccaccacccaaccaaaaatgaaagtaagaatgcttgcttgcttgatgagtcaaatgttgttgaccactttctctatgatgcacggtttgctgatataaatcagttagatttcatactacacaacacattcattataattagttattgcataaggagaaaggctaacaacatagtcttagagtgtatgtcagaaagtacaatcctcttggattaagtgtgaaaaatatttctaacaatcaattattgttataattaattatgaaaataagttttaaaattagatatattagatgaaagtaatttgaaaatattttgttacatttgaattgtttaaaaactattttttatggtaaaattagaaaaataatataaaattatttcaactaattagttttatagttaaaatgattaattcttgaaaataaaatagaaaaacaaatgcctgtttggtttaagcaaatgatttttatttttattttctgttctatttaacttttgtttatattttatttctttttatatgatttgtaaaaaaaagtaaaatagttaaaagtgaaaataagaaatgaaaaaaaaaatcaaaataaacaaacccggccaaagtaacttttaatcataagttctaaaattttgcacctaataatgggaaaaacatcatttttataatttttccaaacaattagattttcttaaacaaaatgttttaaaccttaaaaaagtttctacaaaattaatcatatccaaacatccactttgagtgggaaaaaataagcccaaaacatttttaaaaacaaaattatatgtttgacaaaattatcaaaataaagaaaaagttgtttttaatataaaatatttactacaaacaaaattttaaagtttataactaaaacgtatcaattatttattattaaagttttatttttctattttatctcaagcaattaattaactaaaatgtaaaattaattattacaaaatatttcaatttattttctaatttcattgttaaaaaaggaatttattaaaaaatttaaagaaataatttatttaaaatttattcctttttaataattaattataaacataactcaaataatgttttttagctattaaaaaaatcaggtctgtttcactacagtaatacagtgtaaagtaagaaaaatatttcatggatacccatgctataatacatctacatttcatgagagagaaaaatataaatattataaaatttatgatatgataaaaaaaataaaaaatattagtagaatgtttaaaataaatgactatttgtatataattgctgataaagaaaatactcaaaatagaatacctggtacgaattccaagatagagctgaggacgataagttccccagtacaaactctctttgtgctcaccttcaaactgcaacaacgccaaccaagtcattcttctttcttcacttcacgtacgccaaaatcattaaattatcaaaaaatggaaagaaaagaaaaacagcaatggaatacctgaggaaggtccgttatctttggcgcgggaaacggcgtcacaacgcgaggaatacgatcttctgcagctgaattggcgaggtaataatggctcaaaaacaagacgataccgaacacaactttgttattgtcattgttgaacatgtacatcagattgaagcttcggtgtttgcttctttcggaagacgatctctctccgctgtgagtggttcttcttccatttccggtcattttaagtgcagacagtgtttgtgttaactgtttagcagggtaacgtagcggaagttcggggaaggaagaaacgagggagtgaagtgaagtgaagcaactttttttggtacttcaaataaaattctcatttcgataaatacaaatatcttctacttggagtttgatgcatacgtaagaaatgcaattgaaaaagttaagcttttttcttaagagtttaattcgtaagtgtacaaccaattaaaaataattgttggtaaaactttatgataatcattatgaaaaaatgataactatatttttcttgcacaattattacataaattatgagttttttttttttaatttggataaattagaaaactatatactgtaaaagacaaatacaccattattaattaatggtgaaaatcatcaggtagttaattcaagttataacatattcaatttccctgacgtaatgtcgttggttcaaatttgtagaaaactgagataaatcgatccgtttcattttatatgattcttaagattttggcataaacattaaaaaatgtaattaatattttgaatttcataaattatattatgtcactttctaatatactattgtgtttctaattaattacatttttctcatttattacacaataataacttttttatcttcaataataactattcttgctaagggtattccatgaaaaatatttaatgtttcattattttttaaaacaacaattagtttgtaatttttttttttaatttaaacgtcatcagaaatgaaaccgaagaagctatattatagatgtttttaactcaaataaaaatttatgggtgatttagacaaactctactgattacctataaaaatatttgggataacaataacaaaaaaatataacataaagaataaaccaaagttaatgacaaaaaaaaatagggtggaatcttccttttatttttttactttttttttataaatcctttttatcaataaaaataatatcattagcttaaaatagtcatattttgacatttgccctttctgaaaggttagaaaaagaaatatacaaacattttggcatttgcaattaaaaacgttcacaaattcaaaaagagttggccttcggtgtggtcaaagagatgcaggcaattacaattacacttcatgttacttattttacttgttaaatttgtttatccactcttacgaataaaatagagtcaccattttaagatgaaataatttttaattataatattgctttaagacatgtaattttatgttttttaagagattatatattcttcaatagagagtaagagaccataactttccttacattgggaatgattactatataagattgtttctatttatatacaaaattaagtgttcttaaatttaaatatgattaaactgaaataataccgtggcaatttatttatttatttatgtgctcgataaaaaatattactatttactattttttaccttttatatttatttaaaaaatttaattaccaagtatacaaaattaacactatacgttaaaaaacaagttgacttttatatatatatatatatagatagatagatagatattagaaacaataaaatcaaatgattcaatgaataatagaatgagatccacacaaaaattttcaagttttagtcagttagtttgaatcctactttacaaaatattttaagttttaatgactctctcgttaggtaagacttgttacccaactttttagtacttgccattaaatgttgttgttgtgatattgaggccttgttgtctcgtgataggagtgagtcgcacttcaaaagaaacaaatgagtgtgtggattgattgactaaatttggaacaaaagagatgtttcattttaaaatcttcgaaagttaatctcctaaattatgtctatcattgaacttgccttctgatatattgagcgaaacttatattagagtagtcttttgtttgtctttcttctatcaatctagtttttaattgtactttcgttaaaattgagatcttcaaacgaagaagtcggtagtgccaaaactcttgaaaggaatgtaaggtaaggtgacaaatataagaattatcatatacccatctcaacattcttgaaaataaaaattttaacaaggaaacaaatccaaccttcatatagaaaataaagccaccaacaagaaacaataaatgccagacccgaaagaagaagaaaaaattgaggtaatcatattaaccgtagtagttcaatgattctaaataaataataaataaaaaatttccttgaggcattctatcaagcatatgctacagtcgaagagtctacccatgattctaaaactttaaaaagaaaattgttatcataattataatttcccaaatgaacattatttcactttatatgcatgaattcagagatccaaatccaaacaaaatctaattgagcaatttaccattggatttcaagtacgtctaaaaccagtagggaattaaagattggatcaattaaatacataaggtcaagaaaggttgagttcaatgcacaaggtaagagtgttgctttatacactatataatatttctaatacactatatatctatagtgcaaatccgaaaatgcccttctcattattttgcagaaaatccgtatgcacatcccttggcaattacggatcaactaatccgtcctatcatccttggccaattacggatcatgcgatccgtgctctcatccctgccaattacccattttcataaattaaaactagcaacatagcccctatggatccaatgatccgtatgcacatccttggcctaataaggatcaatcaatccgtgtgtgtatgctggcctattgcagatcaaatgatccggacgcgcatcattggcaattaggcaattactaggcctactgcggatcaaatgatccgtacgactgtcatttggcaattacggattcattaatccgtgcccatcatttgaccaattcggactactaaatctgtgcgcattccatggccatcatttggtcaattacggatcattcaatccgtcagcattcatggcctatttccttgcttagcacggatcaatggatccgtaagcattccttgcttagcactgattattcaatccgtgtgaaattcattacggattattaaatccgtgggatttacacggattcgttaatccgtaacatgacatgaccaaactggatgcattgatccgtattttatacactataccaccatcgaaacataactttactcacccagctgaaaatggcatctccgacgagtcctgagctcaacccagctaccaccgaccacgacctacctcctccaacaccaacagctccaatgcacaacaaaatcgcagcaagggaccaagcaaaatggaaatcgcagcaacggagaaagtaaaatggagagcacacagtgataagaaaagcacagaataaaaacaaacaaaaagggcagttttggcattttaaaaaattatatagtgtattagaaatattatatagtgtataaagcaatactcacaaggtaaagagtgaggcttaacctgatggtacgaagacccaaagaggatgggagcatgggccttgatagtacgaagacccaaaggcccagatctctgattgtgtgttttctcttaagtacagcacaaaacccaccaaaacaaattaattatgactccacacgagagattttacttgtgtttaaaaccataaagatatttgtttttgcttgaaaaaatctagatacaataactaacagagtaactaagatatcaatgttagttaatggaattgaaagtgatattgagtgcattttttaatacgtgtttgtaaaattaattttaaattaatgtgattttataaaattgattttaagttaagttgtaaatgttaaaatcatacggattgcttgatctgtaacactcttacggattgccaaatccgaatgccctccacggattccataatccatacgctgcacaatccttcctacagattgtccaatccgtttcctacccacggatcattcaatccgtacgagtccattttttaaaaatctgtgaaaattggcataggcagcagcatgtaacagcttttcaacaatgttatggttaatttgagaaactacaatggtgtatgtggtatgaaatatggattataagctttgtttaattgtgacattaacttatgaattagtatgttatttgagaaactacaatgttgtcaaacaatcctaaacctaaatagtacttcagtttatggtaagcacaaattcataattgttttctacatagtcattaggatcgctaatcagtattttgttctgcatcaataccctaaatcattgatatagcttctgcattgctttgggtaatagacatatgagtgttttttgatgcaggtcatgcaacatgttagcaaacaggatgttagacaatgaaatataaatgaaaattaaatagtcacttatgaacagcaaaatatgcctaatactgagttcaaaattcaggatttcccaattgccaaaccaacaatcagtgcttatattcaccacatttttgacatgaatgcatggattatcatttggctgatgttttaagtttgatgttttgtttcttagttatgttactgtgacgactacttacccattgtgtgcatgaatatgtgttggatttatttttgtgcaggatatggtgaaaacattgaacttgcgtaaaaatctagggagacctgttgaagcagaggaaggcgttcaacgccgtaggcctaccgcctctgctagaaggcgacgagcagctggtcctgttcttcaggaaccagttgttgaggaaccagttcttgaggaagtgcaggttgaggcagacacaacacatgtcgcagatgacatagttagtgagttggaaggatttgcaggtggtccggaagaccctaccattctgaaaggctttggtaaccacatcgcccttagagtgtgggccggagaggtaatgtgaccctgaagtgtatcctataatgatgatttaaatttaaaatttgatgtcgtataacaacttttctttcgcaggatcgtcctgagcttaagctggcctctcatggacgtaaggttgcgaagtttggtccccccgcacctgagatcgaaggattggtcgcttgtactgggttaagcccactggtttcagccttaattgatacgggagaccggggattgatatccgcctttgtggagtggtggcacccagagactagtagttttcacctgtcgatcggggagatgaccctgacattagatgatgttgcttctctcttccacttgcctgtgatgggagccttctagacctacgatgtagttgacgtgggggaggccattacattattggtcgacttgcttgatgtgaccgtaactgatgcgcatgctgagaccgaacaatgccatggggcatatgttcgactctcgtggctccaagacttgtatgctcagaagtgtgaggcccgacagtgggttgtagcggccagagcatatttgctccaccttgttggttgcacactcttcgcgaacaagagtgccacgcacataagtgtggtattcttgaacgcttttcgggatgtggaccaagctggagatttttgctggggtgtagctgcactggtccacatgtatgatcatctaaactacgcctctcagcatcacgggaagcaccttgctggatatatatcactgttacaggtaattgtaaaacattatctaagttaactattattatgacatcacctaagtttactaagttcaattgttatttgataccgcagtactggatctatgaacactttccgaccatcggaagtgtgagtgctgatccttattatgatgagaggttgccctgggcctgccggtggaaagcttctaaggctttaccggttgcaacctacagacggcgattggataggttgaccatggatgacgtgtgctggatgccatacgtggaccatcgttcccacagacagttcgagatggtttcgctatttttaggtcaccttaggtggggaccacatattgtcagatatatgccggagagggtgatgaggcagtttggttttgtccaagaaatccctgatttccaccactgtgatacgccttcagcagaggaggttgacgacatctggactcacttcgccgaccatcttgtccccactggagaccttgtcatttatcccagccaatgcgtcagtggctacatggagcgattttatcggatatcccatccatttgcccgtccgccagaggttggtgagcctagtcgacagccgactcgagtgacccgtgtgatgcatgatccccctcatgttgatggcgatggatgcgttggccagacaggtccagttcagccaggatcagatgtcactgacatgccccagcatgaagtggtagaatttcctataaacatttcttttacttatattttaataaattgacacttatcaaacacctaccaattttcatatgcaactgtgcgagcccatttcaatacgtcctcacgggaatcaaacacctaccaaaatggataattcatttttaatcaactaaattcattcatttaacaacttaaagtaaactcaacttcatatccatacctgagatgtactgaaagctgcagaacaatccacaaaagaattatcattttctggggcatcattttcttcttcaatgtcctcattcataatatactcgtcatacataacactgtcatacatccactcctcgtagttcatcttcacaaaacaaaaaaagattctaacatgcccaaccgacaattacgcaaactcaataatatttatcaataatgcattcacaaataatcacaaattacgttgaagcataccatacttaattatctaatttatccatactcattcatcatcaaacttttcaactcataaacaatttactttttaataacctattttaaatttttttaaattatttttcctttttttacaaaataacacatacggattatgtaatccgtatgtatataggtaatccgtatgatacatacggattacataatccgtaatagtaatacggattatgtaatccgtatgcatcatacggattacctaatccggaaatgccatgatattgcctaatccgtaagtatcgtatggattaggtgatccgtaagtagcaaacggattatgtaatccgtacaatacttacggattacctaatccgtgtgctacttacggatcacctaatccatacgatgcgttaacagcagctcttacctttttagaccaccaccagccgccgacgaccaccgctaaccaccaatgaagctccgacgaagctcaaaacaatggatgcactcacaaagttacctataccagcagccacaacaacggaatcgtaaagcactgtgcaaaatcgacaactgagttgaaaaagcatggaatggcttaatattgtgctggaagggtactttggtcattagcagaaatatatagtgcatgttgaaatttatatagtgtatgtagaaattcccaaaaattggggttcatgattggacccacgaaactggttgggcttacttacttgtggggactccgagaaatcctgaacatgctcctagtccagattctaaacattcattatgctgctacagtcacaaatagatatagaccatgagtatgagtatgagtataagtatgagggagtgtaatagacaaacaaatgaacattgtggatttcaggggccatgcacttgtagttagctggattctttacttcccagtggtgttgtagctttcatgcaaagaacgtggcctctattacctctcttgtaggagacaatcacgtgccatccatgatccatcattaactccattctacaaagtaggtcatgctattttatttctattttttattttattgatcttggtcaatgaagataataataacgacagagttttagaagttcttaattaatttatgcttttcatccaaataaggggaatgtttacctgcattttagtaatgattgccataatattcctcaaacgaagtccacacagtttctaaatactcgttaaatgataacttgatattgcttaatccttttagacagtttaagcttaatttacaccatcattacaaaatcatacaatcaaattggttaaagtagaaaggaatgtgaaattattcaaattctgccaaattattcttgatcgttgatacaactatgtttctttcttctttttttttttcttaaataaaagggatgatgtattacgtactaaggtgagttgtggagaaatcataaaagcagtccgatggagaggggcagatgctaagggggacaagcgtgccccggtcccttcccttaatttttttaataatatatatatatatatatatatatatatatatatatatataaacgtcatacattaatgggaaaaaacacttgattagatttgttctcttagatatattatttgtctatgctcaagtaggattcgtactactagatttatccacaagtaccgaaaattaacatacatcaacagtgttttatattatcatcattatgatgaaaaaacttacttctacaacacccctttaaaatactgctcaacaatattcttacactttcatatatccatttttctttaatgataaaaaaaaattatagatattctcatacgacatctaaaaaaacgtattcaacactaactcatgaaaatagaatatttgatgaaaagatctctagtggaattttacaagtcaatatttggtatgaactctcctaattaaagactctatcattcaagtcgatcggcatttacaggatttctaaggtaaatgaattagagaatgtgtgtaacttttgccttttatgttagtaacgagcacgagcttttgagttggtactttttgcatcatgatgtgtggattaagatgttgggttgcttttcacgagatcatatattgagtcttatggttttggagtcaaacaattttgttttattttttctcttttgatttcatgaactgaagtgagcctataataatagctcagaatgaacagcatctaacttctatgcataattgttctcatcaatcaacccactatctttgaatttaagactcattttgtattgagaaccatcaacagtttaatcaccactatatctaatataattaaaataaagtttaaatatgttggagatctctaaaatagacttgaattttacaactgatctttgaaaaaaatttcttttttgttaggtccctaaaacttcaaaaattttgtaagagatccatatcgttagtctctgtccaaaacataatgatgtgtccgttagttagatacgtcaataatataagtatgaagccacttcagacgtccaaacgggtgaactacatcgataccatcttccccacctcctcccccctcctcggttggttctccacctgccgttcccccctctctctgcccctccattttttttctttttctttctccctttattgttgtccctttcacctcaccaactcctatagcttcaacatcgacgtgttcttagatctttaagatatttgtttgggtgaaaataacattttttaactagaggtatgaagagagccattgccttttcacatttgtggttttccatatcattctctgacaagtgctttagttgggggcaacggcttcggagtggatgtggtgacgatgaaatgacattgtgctcacttgatctggttgtttcgacgtcatggttctcctactctacctccctattgtcaatttggttgtttcacaaaagctaaaccctcaagcaaaagcccctttttcagaaaactccaatgtccagtaacatctcacacaggaagaatcgatgtcgatgcagatgttgctgtgatgttcaatctttttcgttgatgggaatactagacgtagagcaagagatagaaggagacaattacgtcgatgcattcacgtttattgtcgtgaataggaaaaaccttgcaggatgttgcacatgacaatgaacgatcccaatgtcaccggcaacagagaagacagagataagaggacaaagggagaaagaaaaaaggtgtaaaaaatggaggggtagagggcagagcagcaacacgtggagaaccagtcaaggagggggaagagggggaggtgaggaagctagtaatggtggcgaggaggaggaaacaatgtagttcacgcattttgacatcgttattgttgacgtgtccaattaatggacacgaccatagagatctccaaaatttttgaaattttagagattcaacaagaaacaaaaaaaaattctggaatcaactacaaaattcaagtatatttcaatgatctctaaaatatttaaagtttaaaataaaataaaaatatttcttcttcttcatatattgaaaaagcaaattattaatgcattttgttagaaaaaggttgctagttaaatgtataataacatgaaacgtaaatattttattttacatggtacaattttgagtcagctttatttttaaaactaattatttattatttataattaaataaaccgaatctagtttcctacatagaattttctctactaaaataatttaatgaaaacaatttccgtattatataagttctaacgtctaagtcaactaagtgacttctttgaaaggaaatatcagtcggccaacaagtacataaacaaatatctaagtttatgccttccaaaggttggtgatgaatcgctcacacggataagggttggttttcatatatatttagatttttcagccacgagaaaaagatttgcttgtttgatacttgtgataggtgaatcagaggaagagtcgttatttatttggaatctagtgacgttagattgtgatcgttaatctataatataacataacaagtcatgaacttgattatttgggtacaggtgatcattttttaagcaacggaggaaatcttggtcgtaaagctttaggtaatcatatcgttcacatgaacatcttaattcaaatatgctattgtggtgcttaaacatataaaataaatttgttatttaggtataacgtgaatttgtggtttttatttatttatttatttatgtccagtggttctgataaaaaaatgttcagaggtttaggagttgatagaatttaatgcagagagaattttagtatttagtaaggtttttttttttttttttttttctggtgatatcaataaggtcacccagtttctcgcttctcataaacatatttgaagcattgatgaaaggtgaaaggttccacggcgtggatgagttgctgactcattcttcaaaagccacgcgatcagattcccgaaaggattgtcttgtgccagaactgattgcactaggagaagaaaatcaattgtttattcccattccctttttttaagtcagggattcgtttaaagccttttgctaccattacaacaaaaacaatgacatcagattcataattgttgctataaaacttttctacaagatgattatttttattataagtaaaaattaaagataaataaaagatgatttataacaatttatatattttattcaactaattaaattagattttttaaattttatacacgttaatgtaagtatatgtttacattattaaaaaaatatttagtgttattattattattttcattttatcattaagctaatatcataaactacatatataaagtaaatgagaaaaacaaatcacaacagtattagagaaagaaaaaaattgcaaaaataatctaagaaaatgaggaagatgtaagtgattatcaaataaatccaaacgatttttatttatttatttattattattattatttatctacagagtaattcagataaaattactagtctacattctacaaaaattttggtcctcttacatataatatagtccatatctataccaataaatataattgagttctcaatacatgttattattgtaagaggatatctaggttcaatttttataaaatatacattttagagagagatgataaattttaaatatgactaaattttgaatcgatgattaattctataactagttcaaagagataagacttatgagaatactttgaaatctcatcgaaaaatcaaagaacaattttgttaccaaaagaaaagaaaaatataatgcatatgtactcttattatataataagtcatgcaaaagacactttgtgtcccaataatttttcaaaagtaaaaataaaaaaaataataaaagttaaataatactaggttgtttatactatgtgagtgaagtgtgaattagttgaacaaaatagttataggaaaattattttttaaaaaaaagtaattattaagataatgtggataaaaaatgtatacatcaaaaaccatatcttttatatatatatatatatattagttatatatgacaaaaattgttttaatttaatttttttttaaaaaaacaaaactataaaatttagaaatattaatgtaataacttaatactagattataagaatattttgtctatacatacacaaatctgattttttaatgcaaatgcaacaaaatgatcttcgttcaagacgtcaaaataccatttgaaaccaaacatgatagcaccatgtcttttttatttaggattgcaccatgttttagacgattaaacatgctcttaataattttggtcaacaaaatttctttcgaataatcaaatgtatttttctgacaataatttgttcgtcctacccataaataccttttaaagtctttttactaccccttgttataaaaaaaaacagacaaactttttaccccttcaaatgtgtctactccttttctatcgtttcaagtttttaacattttttttttggtgaattcaagtttttaacattaaaaacaataactttgaacttcttataatctgtgtaggtagacgttacctaaatttttgagacattgatttggtgacaaaatcttataaaaaactgagagatgaattaagtaactaatttttttaaagaactaatgtgatgacgtttgtaaatttagaggactaaattaaaagttttcttcataatccaataaaaatgtaattcttcaaaagacttcttttaatgattttgtattaaagtaataacgcatttatctttaatatataagtgtgttaaatttatgaaagtttatattaaaataagaactgatatattattaccttctcacattatactatttattttatcttatgaaatagtaaatatttgtgtaagtgttctagagaatttatgaaaataatttataaactacccataagttgttttaatcttattttaggaatcttttcacgataatttatgaaaaaggattaattttatatgaaagcaatttaatcttatttttttcatttattataaaacaatttatacatatatatatatatatataaataaaataaaaactgtgtcattacatgtttaataaatatctaaacagaaaaataatactactccactaaaaaagaatcttgtaagccattaataatcaaagcattcttacaaaactagatgttagaagtaatcatggcaaaagtatatttgaatttgaatttaaatttgaacatgaatagtaaaaatgaatccattgaacttcttccaaatttgagaaaataacagggagggacaaaactgtaattgcggaaaagtcatgacaattcgtcaattccgctgggggacaaaaacaacgcgaaaaggtcggtcggcaactgtgggccggaattgaaccgggggagataaaagcggcgcaaattctaactcttctctttcaaaaacaaaacccatttcaaaacgtcttgtaaccaaaactaatctcaaaacaaattaattaacattaacaataataaattaataattgttcatcctcaaacccatccacccaaacaaaaaactcaaacggataacgcaatacgtaagactcttctgagcctttatatatgggagaattatttatctaataaaggaatttatatttaattttgatgtgttaaattcttttgacccattataaaagaaattagtcggagtctgaaacacctttagtgtatgatccacaagactaaaaaaaataaaatcatccactcaaaaaataaaataaaaaacaaaaatagacactttggttttaattcccacttaactaacaacaaagtttcttaaaattccactctccaataaccatatcttcttcttctctctttctccctctaacttacttctcactgctctatccacactcaccctccgattccaacaccaataccctaatgccgctattctccaactgtttttttcttcttcttcttcttcttcttctttcgttctctctctctctttttatatgaagcctccttggctgtgatttttacttattactattatttttcagctcggtatgtcgttttgcttctaaaccctaatcctaatcctgcagattttactttaatttgttttggtgaaagttctggattgatgaaactgctgtatcttttaaaatcagtgttctgcttctgatagattgcgatgtttgtgttgtttccaagtgtgttttgaaaatttagcgacctttacaatctgtcctttttttttttttttttttttttcttgtggcctattattcagttcggtagaaaagtgttgcgaaagaagaaagaaaaaaaaaaaaggttgtttgctattttgggaaaaaaattgagggcatggcaaatctaatggctgcttggctttttttttttttcttttttctttttcttgatttgctagcttggtagccgttgtttgtttgtttttattttctctgcctaaatggaataaccatgcctgggatatcatgatattttataattttataaattatgctctgcaagtaaaacaaggttgaatttgttgttttctgcttcctgattctttcaaagtttactgaaatttgattcgtgtgtttggcctttagtgatttactctctgcttacttcataataagtcttgatgtaaggaaagattagagagactgattgtgttttgaatttcgattctgagctgattttttatcgttgttttttttttttttaactttctttccttccttttcctttttggttctgcagctagaacagtagaagattatttggtacctaagttaacgaagaccgtgactgtgaatgatggatgttgctgaggttgaggaaaatctgtttgccgcaagtgatgccaaggtatgatcatgtctttgattattttgtatgctgttttgggaattgcttttacagcgtgcacagtcctcatgccaaggtttaattgaagattcaaatctgttttgtattaatttctttatgttcttcatttaattatgtaggaaaagaaaacccgtttctttattattgttttcctagttattgtatgcattcagctaagaaaacagttgaacctgtctaccttttaaggtgcatgaacaatctttttacattgtcatcgtatctgctatttaagccaatgtttttcattgctggcctaatgaaaaagaaaaacagcaaggggatgtttgagttctgtttttcttgctctgtttttttttgcatttgtatccaattcagttacaatttatttttattgtctgtaatgtagtctgactaatatctatctggtttcttatgcagttacatggacagatgtgcaagactctttctataatatattgcaaagtattgtctgtatttccttctttagaagctgctaggcctaggagtaaatctggtattcaggcattatgttcattgcatgtagccttggagaaagtcaagaatgttcttcagcactgctcagagtgtagtaaactttacttggtatgatttatttcttctatagttttatttgctgattatgtttctgagtacagtttttattttaccttatcccatgaagcagttatctcttcttggcgggtaaaattatttaacctgaaatacatttttgtaaaatatcttacaaatgacattaattatgatgcaggctataaccggagattctgtcctcctaaaatttgagaaggctaaatgtgctcttgaagatagtcttagacgggtggaagatattgttccacaatctattgggtgtcaggtaatattactcagcagcatggctgatgctgtaaacttttttttctccttgtgggtggtggtggttagttttaggttcatgatccttttattataatattatgtggagggtcttactcattcttgccaattgctgttgtgatcatatgaattctaggccctattgtagatgttttattttgttattccaaaataattgaaatattgaatgcaccttgattacattactctgggtttggttttctgtaacactggcctttgtatattcaaatgcacaaaattctctccttcttgttatcattgtcaatgttgaacccagtctgaggtttgattgatttcctcttcaggttcaggagattgtgaatgaatttgcaacaatagaatttgcacttgacccatcagagaagcaagttggtgatgacttaattgcattgctccaacagggaagaaagtttaatgactctaatgacagcaatgagcttgaatcttttcaccaggctgctactagacttggaataatatcttcaagaacagctcttgccgaaagaagagctctcaagaaactcatagaaagggctcaatctgaggaagacaagcggaaggaattaattattgcatatcttttacatcttatgaggaaatactccaagttatttagaaacgagttctcagatgacaatgattctcagggttctgcaccttgttctcccgttcagggatctattgaggatagtgttcctggtagtcattgtcaagcctttgacagacaactttccaaattcagttgctttaattttaaaccaaatattagtaggacatctgggcagctgcctcttccacctgaagagttaaggtgtccaatatctctgcaacttatgtatgatcctgttatcattgcttctgggcaaacttatgaaagggtttgtatagagaaatggttcagtgatgggcacaacaactgcccaaagacccagcagaaactttcacatctttgtttgactcctaattattgtgtcaagggccttgttgctagttggtgtgaacaaaatggagttcctattcctgaaggccctcctgaatctcttgatcttaactactggggattggtattatcagagtctgaatctacaaattcaaaatctgtcaatagtgtcagctcttgcaagttgaagggtgtccatgtggttcctttggaagagagtggtatctcagaggaatctgtggaaaatggaactgaaagtgtttctgcacaagaggaagacactgagcagtattttagctttctggaagtcttgactgaggggaacaattggaggaagcaatgtgaagtagtagaacaattaaggctgctgctgagggatgatgaagaagccaggatttttatgggggctaatgggtttgttgaagctcttttgcagtttttgcaatcagctgtgcgtgaaggtagtttgatggctctggaaagtggagcaatggctctcttcaacctggctgtgaataataacaggtctgctttgtatttctagttttaatcattaagtaaaagtaaaactgcttttcatatgattacaaaatcaaaataattcttgatatttgagattgatatttgagaatcacaaccttgtgttttagccaaagccattgatgatcaaaactgatcactgagatttgcatagtgctagtggatgtaaaaaattgatcactgcccacattgaattttgttcgttcagttaatatgttctaataataaatctggcttaaatttaccaatatggtagagttgatgtttcattagctccttctaaattcacataacttttgtttttttttaacctctgcaaactattaacttgaggttgatctttacttttcaacagaaataaggaaattatgttatcggctggagtattatcattgttggaggaaatgatttctaaaactagttcttatggttgtacaactgcactttatttgaatctctcttgcctcgaagaagccaagcctatgattggcatgagtcaggctatccagttcctaatccagcttcttcaatctgacgctgatgttcaatgcaagcaagattctctccatgctctctataatctttctactgtgccctccaatattccatacctcctttcatctggcatcatgagtggcttacaatcccttcttgtaggcgagggggattgcatttggacagaaaaatgcgtagctgttttgataaatttagctacttctcaagttggaagggaggaaatcgtatcctctcctggactcattggtgcattggcttcgatattggacaccggtgagctcatagaacaggagcaagctgtctcttgtctcctaattttgtgcaatagaagtgaggaatgttgtgagatggtcttgcaggaaggggttataccagcattggtttcaatatcagtgaatggaactccaagaggtcaagaaaaagctcagaaactcttgatgttgttccgagagcagcgacgagacccttcaccagttaagacacatcagtgcccacctgaagctagcgatttgtctatgccgcctgctgaaatgaaaccgctatgcaagtccatttcaagaagaaagtctgggagagcttttagctttttctggaaaaacaagagctattctgtataccagtgttaagttccattggttgttgtaaatctgtgttagcatctttacttttgtggccctgcttttatcctcctcccgtggggtgctgcttatttttggttcaaagcgaagaagatatgtacaggcctttgtaatttatggattttgttttcttctttcgctttcctctttgtaatatcatttttccaagtattgttgtttttcttttctttcttttttatgttcgagggtgtttatatttcaatggggcttcaattcttaggcttaccattttgaagttaactgtgaataataatatcttaaggtgtttcttggtgaacaaactataaaggtcacacaatagtagttagtaaagagtgcaagttttcttagaagctagcggatgtcgctttagccattagtttcagctttaaacagtcatgcttcttctttggtccgtgtttcttgattgctttaccgcaattcttctcaagtaggatttcttataattccttaaaaaaagatgtcttatataattcattttgaaacaccataaacgtcaagtaattaactatttctcatgaaattaaattaaatttctcttataattatactcagtcacttgatttatcacagtaaaaaaaacacattatagaagtcactaaaaaaaagtttaagagcctccaaaattgttattaacttaaacaaaataacatccattttgcaagtatcatcttttttttttgtcattcatttttattatattttataaattcaaattcatcacttttttttataacagaaacatatttttaaagaaaaatagtaattacaaaatgtaatttaattttttcttaataatatttcttattaatattatgtatatatcttatctaaatctaatctaagatatatacaaatgtgaatatacatataaagataatattttgaaaaacacataaattaaataaatattcttataactatttatatttatacaatataaaactgtaataaataactataatgtaaggtaggaattattaactataatgtaaggctagccttttacaacatttctaaaaaaataattagaccgcggggtggtactcctttaatttgattgaggaacatcacgctcagtcacttgcattacatctttttgctttctcgagaggaatacgatggtttctcttcccatagttcaatatgaagagaaaatcatcgaaactgttgagcgcaaccccgttgtcgtcgtcatcggagagaccggttccggcaagagcactcaactctctcagatgctccaccgccgcggctacggcaaaatcgccgtcactcagccccgtcgagtcgccgccgtctccgtcgccaggtaactattcttcattttcactgaattgtgcgtaggactcctcgcgtcgtgtttccgtttctcactaagacgtggccgtttaaatcccgcagacgagtcgcgcacgagctcggcgttcatctcggggaggaagtagggtacgcaattcggttcgaggataggacttcgcacagcacacacataaagtaattgcgttttcgttttttattattccattgacttcacttggttttattttcaaattgtctctgattgtggttgatttgattgaattaaggtatcttactgatggtgtccttctccgagaaagtttagctaatcctgagttgaatgagtattctgtgatcatattggacgaggctcatgaacggagtttaaacacgtaagattattgaatactgtgtgctcttgttgttgtcaagtgtttggtgtacaattgttctgcatgaaactttttatgattggtgtgtttattgtcagggatgtattgatggggctaatgagacgcttggtaaaaatccgttcctccgatctcaaggttttgatcacgtccgctactcttgatggcgaaaaagtatctaagttctttgccgattgtcctgtattgaacgtcccgggaaagttgtatccggttgaggttctttatagccgtgagcgtccctcaagctatcttgagtcttcgctgaaaacagctcttggtatggcatggaatttgaaccttatcagcgtgttaagttaaatgtctgcttgggtcaacatcaacatcaataacacctttaatctaagttaattgggatcaatgatagatgaacacaatgatagatagatgatgttgaaaaaaaggaaggtaaaagcaaagaaggggaaaatgagaggggagatgaagagaaaaaagactaaaaagagactatctaaaacttagagataacaatgggtctaaccctccaccaaatttataactttttttcattcgatcctaagacataccgtccatcaatctatatctcactccattaagtcttgtttaattacatttcctcacgtaagtttcggtctacctctacctctcttttgtcgaactcttggtaacaaacttttgtttttatgggagtatccaagggttgtctcattaaagtgtccaaaccatctcaatttatgtttcctcatcttttcactcaccagtactactgttctctttcatcgaatatcttcattttttattttatccatcttcgtataaccacacatccactttaatatcgtcatttctgctatgcttattttatgctgatgttgcctatgtgttggtcaacattcaactccatataacattgcaggtcttacagttgttctataaaattttccttttagcttaagggaattttgcagtcacacaacaacccagatgcgctctgtcatttcatccatcctgctttgattctatgatttacattctcatcaatcccttcatcttttagcaaaattgatcacaggtatctaaaaccatctttctcggataactcttgatcaagtagatgcacggggtcttgatgatcatttcttactagtgaaaactcacatttcatatacccagtcttgctctggcttaacgtgagtcttttagactccaaagtgcttctccacaattcaaatttcctattaactccgtctttggtctcatcagtaagcacaatatcatatgctaaaagcatacaccacgacactttttttgaatatcttttgttagttcattcatcactaaagcaaagagataaggactaagagctgaaacttagtgtatatctaccgtaataggagaataacttgacatttcattacaagctttcacatatgtggtagtcttatcatacatatccttgattgcatttatatactttaatggtacttttttcttctcaaaagtccactataaaacttttcttgggactttatcgtatgctttctcaagatctatgaacatcatatgtaagtctttcttcttttcttgatatcttttcattaattgtcgcattaaggaaataacttccacggtacatcttcttgacataaatccaaattgattttacagaaaccttggtctctgtcctcaagcgatgttcaataactctctcccacaatttcatagtatcgctcataagcttaatgcttctatagttagaacaattttggatatctttcttatttttgtaaatagacacaaatatacttttcctgcaagcatcatgttgtatactttgcttgcttttgtatgtaaataaatttgccttggcatcatgtagttattccaatgctatgtcaaagtgttaaatgtttgccttgccctttgcttattgataaaaacttatacgagacatacctattttttttttccgttaaggtaacatttccttaaaactggtattggctcttaaaagataatggccatggttaaaattgtttcatgtgagaacataagctgctaagaggggggatgcattttaaatctgaattgggaaatctttcgttcatgacttcatgttgatgtaaataatcacattcacttccttcagctcctttactgattgaatggcttgtaactctgcaagtagaaagtcaggaaatgttgtcatattcctgttgttttgaacacattccgtttcagatgtattatttcctttagttgtatttttatttttatttctagtgattgactaagtattggttttgcagatatacatatttgtgaaccggaaggggatattttaatattcatgactggacaggtgaacatttttgttatgtgctatttatcgtatacttttctactccacaatttaaatcttagtatgtattttgattataacttatttaggggaaatagccccttttctgttttgaagtttcccgagatagatttcctgtttctgtgtgtataagtatttgttttccagaactaacctgtatcctaaatccctcgatttctgatatgatgcaatgcaatgattgaacatctttcaatgatcttcatgtaggatgacatagagaagttggtatctaagttagaagataaggttcgtgctctcgaggaaggttcctgcatggatgctataatcctccccctacatggttctttgccccctgaattgcaggcaagtagttactcactctaggttccaaatacaatcacaattctataaactgatgtgatgatgcatgctgatacttcagataaaagaaacagcaattgtgagaatatttggaaaggcattttaatttcattcttatacataattcttagttttctttttagttctgtctataaaaaacttgactaatttgcatttgaagattgttgctggcttaggtgtgaaactgccttgagtgtatttctcttagttcattcctcttttaacttgttgcttaccttgtttgctttgtattacatctcaaatgatatttcttagcttgcaattaacactcataattgttccttttcatatgggggaaaaccttaaatatacaatggttggtgtttgagatattttatcccagaaaataaaatttgaggcattataatttttttggtgcatttgatactcgtgtgtaaccgacttcacctagtggggtaaggctgttgttattattttgtcgttgaaactcatgcatttattatttaatctttcaggtgcgtgtatttagtcctccacctccaaattgtagacgaatcattgttgcaacaaatattgctgaaacttccttgactgttgatggtgtagtgtaaggacattgattcttgattaaatattgttattttatgatcatcatgaagataaattattgtgtattattattgttgttgtaattgctattattacttattattataattcaaatgttttttttttctctctctatagcctattaattttcatcttaaccagagaagagattaaaagttcgttgaaaaccaaaatttcctgtaatacatttattgaataagtactgaagttcatgattaagctattcctgtaaaagcaatgtcaatattgcttaatgttgcacccagacgagtatgaaaacattgttggcaaaataatagtgagtgcttaatatataccacaggcctcagctggtgatgcattctatttctttctgacaaaatttaaaaatcacatgcaacaggatgtatcattgctttaacttattttttagattgcatatgttttgaggtatgtaactatgcagtttttgtaacgacaattaatttaaagactaaataggggtagggggagataatgacatgtagcatattatgagatgcaactattgagacaagtcagacaacaaaccctgctatttgaattcacctattgtgatttggagtgtttttcagtcatttactcctttagatcaagcacataaacttgtcttctcatagtttctgaaactgtttttaattttatgaattttaggtatgttattgactctgggtatgtgaagcaaaggcagtataatccatctagtggcatgtattctcttgatgttgttcaaattagcaagtaagcaattaatagtttggtacctcgttgtggccttcataaatttttaaatacccaattcagtagcggtaagatgatttcaaataattcatgtgcagagtgcaagctaaccagcgtgctggccgagctggacgaacacgtcctgggaaatgctaccgcctatatccttcccgtgtttacaatgatgagtttttggacgttacagttcctgaaattcagagatcttcccttgctggcagtgttctttacttgaagtcattggacctcccagatattgacattctaaaatttgactttctggatcctccatcatgtaacatactatcttgggaatctttttttgtcatctcaaacattttaattcctttttatatttttgggggagggggtcggtccttatattagtttcttgtagtttcaaatattctttatccttgactagcagctagcaagttaatgagttttgctcaagtttactctggtgatttaataactgggttttctgcagctgagtccttacaagatgccttgaagcagttatttctgattgatgctattgatgaaaatggtgcaattacaagtattggacagaaaatggctggtacttgatttctttctttacattttagtgttgaatttttaatatctgtatgtagaactaacacattatgtaacattgttatcttcatcaagattttgataatggctttcactagtttaccatatttctgtctattattttcatagaagtttctttctgctaggcttgacatgaaagttgtgcttggtgttgaccataaaatttattcttttcttacccattcattttcctaatcatgtgtacttctcttggttccctgagttgtttcttgattctatgcagagcttccattagaaccatcgttggcaaaaaccttaatggaggcaaacaattatggttgcttatatgaggctttgactgttgctgccatgttatcagctgaaactacattgctaccagggcagaggtggactagtctgaactctgaagtttatatagatagatagagatagagagggagagaaagagaaagagtaggaggatcttatcatcctccacgttttcaattatactgaaaaggctactgtctttcaaataaatccattcttataaaatgtttaacaatttacatacttgtgaataattctactatcagtgaacaaaacaaatgaaaaaaaaacaggaacataggatgatgtgtatcttgtgttttaccatgacgaggcttatacgtttatacatcgacaaggactgagtaactgagcagtaacaaaactcctttaatgtgcagaaagactgagaagaagaggaaacatacaatatctaaccttcctgatggctccggattgggtgatcacattcaattgctgcagatatacgaggctgggatcaaactgattttgacattggctggtgcaaagataatggcttgcaggtacctatatgtgatctagtaatgtcaactgtcaaggctgacataaatttgggactgagcttttgcaatgtagtctgttaaaaatgtttagctagaaggctaatatccttgtggaatatttgtcttcactcttcacacatttgattcagatatagtatcctttaaagaaaaattcttatgggtcattgtgaaagacgtactgttatttcttgattataatgcatgcttgcatttttattttactgtcagttatctaaaatttcttgtcttcataggagagccattctaaaatatgaagtgatattatgtacatatggatcttttgtatttgttcaatgcataatatatgtgatcattctggaataactgattgaaggtgcgagggatgttgtttgtcagagacgtccgtaagcagttatcccagataatgcagaaaatatcaaagggttcgtattccacaatcttgaggaatttacctgtataaagtgaataataatatacttttacatgctgtgataatgtcactacactagtaaaaacgaaccagcattttgattttgacacattcatatcctctttaatctttttattcgttaattttaattgttcttttccttttgccttgccttcatccttattgtgttgatatgagcttgtttgtaatttgtataggattaatggggtcaaaactcttaagttttggcaaaactattggtttccactatatctatcatgttatgtatgttgtttcctccccactttacatattttttcaatctcgcaataggaccactggatgtaagggaaagtgggaaaagagaagagttcaggcaggattatcgaaatttgaggaaggctttatgtatgggctatgcgaatcagctggctgaaagaaagatgcatcacaatggttatcgaactttgggtttccaagctcaagtagtccaggtaatataagtttctagtcactattgcatgtcaccattacttttagcagctcttttgattcatgttgtgttaatataatatctcctttaagttttttcctaaattcttacacttttactgtgaagtccatatctaagggtgatggaacttacagaaatgtcccaatgaaaaaaaaagtctatgtactgtgaatttgtggaagttcagaactagtaactagtctttgtgaatttcaaccgaatccttggtttgtagatacgttaattttctgaatcttctatactaggtgcatccgtcatctgtgttgagtcttgatgacctggggaagttcccagactatgttgtgtaccatgaactaattgcaacaccacggccgtacatgagaaatgtatgtgctgttgagatgagatgggttatacctattattaaaagctcaaaaccctggatgtgtacaaattaaggtaggtaaatatggcatgtgtggacagtttttttttctttttcattttttgggtgggagggggggctatgatcattgatggctctaattcctttatctgaagcagtggtggtgttcatcatgttgaggaggaacctgagaaaaagcttccagatttacccaagaaggatgttgaggtggctagtactgctgatcaccgtgaaagtagaatccaagctgctagagaacgatttcttgctcgtaaaggcaaaaatgagcctgaaaggatgaagaggtcaaatacactagagatgatcttggcttgtcaggcattttattaggtggtatagttacctgaaaggatggaagagtctggatgagctgatgcttttgagttttccacgttgtcacaacaccattttcgtgctatgatgttatctcagcttgatcctcatcagttgtctctcgcaaacattacaagatttatcacagaaacctgagatttggtctcatactgttctgataagttggttgagtggctgaatgcatatatactttgtgctcatgcttttggtttgaaatatacccagaagaagaaagaaaaaggaagaggaaggaaagaggagacagaaagtagcaaatccccttgacaagtaaatgttaattaaacagttaagggttttgaaatgcaatcgtggttactgacatctgattgagataattacctttgggtggcacactttgcctgatagttaaattacatttttgtttatattgaacccgtttagatggagataatgcctagctgagattgcattgggagttaaacatacaaaacattatggtagttatgtatatgaaacaggatcaatctttgtctaataggtgttggttctcaacctgatgatcactaattcaaggtgtctggacatcacatataatcaatgattaaaaaaaaatgaaaaaggttttcaatttgggtcttagtctaaaaaaaaattggattataatcaacgtaatccagaaaatagaaatcaaatatatttgatttctactatttgagaattcgtccattttttttttaatttcatctatttaatttgtattgattctaatgaatctaaaataataaaaaaaaacaactcttattcttttagattttggattcttttacaatccggtatcataataagaaaagaaaggggaaagactgagttgattgtcctctaacgatggcatattctttgctttggtgtattaagatttcaatctttgcgtatctcttgtcatgtttaatcacgttagcatacataccatagcatatgcaaaaatatttatgtttataaaaaatctttcctggccagtgagggtgactcaaatgataggatcaagagttatttagttcaactaatgttgattaagtttagcggtaccgctgtgggtcaattgtaagtacttttatacattagaccatattaaatggccatgattaaaaagtcatttaaatttgattcatacaatatatggatgattggaaaatgatttatatgcagtagtatatatatatatatatatatataattttttacaataattaatactagttttcactttatatatatatatatattataatactagtacaaatattattgtttactattttccaatcgatcagtgaaggtcaattcaaatggtactactgtattaacaggtcaattagaaatttagaagtatttcatagactggattgtcatggagatttatgttgaacttttgactttagtgatatagtacttctttttacataaacttttatttcaaataaaaaaaggaaaaaatcacgtcattactactatatacggttgtacaccatgcattgaaagtagcaaaacagactcacgggacaatcgacagaaccgcgtaacacgtagaaggagcccagaatgacgatagagagatattttgtcgatgcaatgtacgttccaaagttgataactagcgtacagaattaagtatgcaacagcaatttcaagtaagagaatttttatgataccttcatgaaaatgatatttaatgtgaattaattacaaagcgtttatcaattactaactttataataataattttaattttcaatatagttaataaaaaagcttcacaagtcagcttaataattatgctcatcattcttaacatagtaagtagtaaggtgtttttttttataatcttttttatagaaccacgactttctttgatttaaataagattattatagacgataattattttgagtacttaatactttatattgcttcatgttctaagctcaaagtcaagattcaaaaatcaatcttgtatcaatttattttttgcacattatttaataaacaataagtttgatttttggacaaaaggagacactactcattccgatgctttcatttacgatagagggtccacacacttgcatgcagcttctatgccaaggtggcggcttgtatagctcctatattgcaaggtggcacttcgtctatatagtttctgctgtcattgttgacaaggggaaaaactttctgctttaagtaagaaccatgaatctcatactcttctagtcttctgactctctttgtttcatgaaagttaatgatgatatagtataatcactatactatcactcaaatattcaggatctagttatcattcttttccccctataaaaatttcctttgagttttcagcttctgttccttaggagtttgaagttttcaatactgaaaaatgaaactgactccaagagaggtggagaaactaggccttcacaatgctggctaccttgctcagaaacgtcttgctcgtggtttaagactcaattattctgaagctgtggcactcattgccacgcaggtacttgcatttgtatatattttctcttttttttttggtgattaatgattatctaacttgcatgcttttttatttatttattaatgattatcttccttgcatgcatttgtttttatatatagattatggaatttgctcgtgatggtgaaaagactgtggcacaactaatgtgcattgggaaacatctattggggaggtattgtatttttgtatatatatatattatgtcatttttcatcatctcattctcaaaccccatgacatatatatatgctttagataagagtttcatcgaagtatatgaatggactccatcttcttttagtcattttgaactagaaaaagctgaatgagccattttaaacaggagacaagttcttccagaggttcaacatctcttgaatgctgttcaggtatttgtctcactatggaaatgtagctattatctaccaataaaagcactctcactaatggctttgtagacattacacgaagtctcattagttcagttactaatgacaatctttctttttgcccgctataattcaaactacatatttttttcttatagaaagtgttaatatatttcctcattatttaatctatgtattatggatcttgaacttcaaatggataagtgtatctccaattttgtcgttatttatcttaggactctactctatccctctgattataaaattttgtagtcattattaattattattacctgtatttatttttaatataggttgaagctacctttcctgatgggactaagctggtcacagttcatgatccaatttcgtgtgagcatggagatctagaacaagcactatttggttcttttcttccaggtttgcttctattatgatcttgaaaattgataatttgttagttggtatatctctctctctgatgagtgtttccagatgtgatcatgccatgcatgtactttgaagcttcgcttaaccatcgcatcgcttacaaaatgcatcttttattatattttattcttctgtatatttttctgttttggtttataatcaacattttcattgtttattgggaaaggaggaatctcttgttttttctattttaatattgaattatgagaggttaaaatatctatgaagtgtaatttgaggctaaattttttgataaaagattattgactagtcaatgatggtcagccatctggtttttctttttaaattaaaatagcttgaaacatataaccagtcactacattattccaaaaagctaaatattcctccaatatgcatatggtttgaaaacattcactcctttagtgtatagtttgtatggtttcatgttgaaattgttgggtaccgagcaatccacaacaatcgagatatgagaaagagagaaaggggaagaaaaaacaacacacataatttacctgattcacacactgtacaattgcactcagattacaaggaaatatataaacttagaaatcctaagcatatagctattatgggcccaagcaaactaaaataataaaacacgagccaacaacagtactaggcctcgaaaaaaaagtttgggggcgctgcccctagccccccaggaaactcccccgggccctcgcctgctcacccccatgcatatctgctgatggcatagtatgagccatatcaacaaaaatcacataacacacttaaaaaacatgaaaaagtgaaatctatatgaagttccttcgtgttaacatgaaaatttgacacgattttcctaaaactgatgcaaaaccaagcatattatggttatggatatgcacaagtacaggtttattctgtaggtacattagcatttctcttgattgggaggaaaatgtgtttgcagtaccttcacttgacaaatttgctgagatcaaagaagataatagaattccaggtgaaataatatatggagatggaagtctagttcttaaccctggaaggaatgcagcgattctcaaagttgtcaacaatggagaccggccaattcaggtgtttgccttatattgtctacaagattttttccattgtcttgttcctaccaccttaacattttaaacaatttttttagttttctttatgcattaaaatgtcaaactgatttatacaatttaaaaatgcccaagatttgctattgttacatgcatggctgcagcttctgaatgcagtgtgataagctgtttttattaacttattgtagcgtatgaaataatgaagtgatgttaacgactgctttcggtttgtctggttgttgtttactggttcattatttgaggatttcatagggtcctctggagactaaaatctgagtatgtgcatgctgttggcctttttaattcaagtgttgcaaatgtagacaatttttttcatcttgtgtactactgtttcacaaatcagaagcttttgagttttttcttgtcagaccaaatattgttacaattttgaaacttgtcagaataataaattttaggagttcaaatatccaaacaaatttatttcttgttagcttttccaagtgaattgaagcaaacattgcctaatagttatgaaaatttcaggttggcagccactatcattttattgaagtaaatccctacttgacttttgatcgaaggaaagcatatggcatgcgcctcaacatagctgcaggaactgctgttcgctttgaggtgcaattctacattgctgcaagttatttatttatttatttatgacatgttcaacagttgaacacttgaacttattaatttaataggttctaaatgattaaccacatacatatttgctcttaaaaagccaggggattgtaaaagtgttaagcttgtaagaattggaggtaacaaagtcattagaggaggtaatggcattgctgatgtcaagttaatgaaaccaatcttaggaagcaatggaggcagtgtgcaaacggggatttggacataaggaagaggaagatgcaaggtttatcatttgttactgaagtacttgttatatacctttgcttacatctttaactattccacatttgagaataaatgaagatttcttacctcaaatgtaaatttcccagtgaaggtattactggtgaccctgactgtccattcaccacaatcattcctcgtgaggaatatgctaacaagtacggtccaactactggtgacaaaatccgtcttggcgacactgatttgtttgctgaaattgagaaagattttgctctctatggtgatgaatgtgtttttggaggtggaaaagttttaagagatggaatgggtcagtcatgtgggcatccacctgcaatctccttggatactgttataacaaatgctgtgataattgattatatggaatcatcaaagcggatataggcattaaagatggtctattgtctcaattggaaaagcaggaaatccagacatcatggatgatgtattttttaatatgatcattggggtaagttcccttccaaaaatctgaagcaattaactgaattcatacaccattatcttgacacaacttatttgcatgtcattatatcaaggctaatactgaagttattgctggagaagggttgattgtaacagcaggggctatagattgtcacgtgcattatatatgccctcaattagtagatgaggccatatcaagtggtgagttttacaactagaatcaatttataaagaaagatttcattacagggtatcttttaaatattaacgaatggtcaaggaagtacaggttctcttactttctctcatgaataataaacactcccaatctttggttaaaggggagaggaattccttcttacatttctcacctcatctccttttccccatggtagatatcagcctatgcagatgaatttgatggatttaatgagtccttttgtactttgtatgtaggcatcacaacattagtgggaggtggaaccggaccaactgctggaacacgtgccacaacttgtacaccagcaccatctcagatgaaactaatgctgcaatcaactgatgacctgcctctaaacattggtttcactggaaaagtgtgttgcctttttgatatatcttctgtttatatgtcttgtttttcttggcatattgcaaagttattttttttgttccttgctcaatgttatgtgatggatttaagacctctctttcttcaaataattcaattaactttctattggttgctttagggaagtagttccaagcctgatgaactacatgaaataatcaaggctggagcaatgggactgaagctgcatgaggactggggaagtactcccgctgcaatagacagttgcttgactgttgctgatcaatatgatatccaggcacaacattcttcattacattttttttgtaatttttatcaatatctgctgctaacttttatgattacagattaacatacatactgacaccttaaatgaagctggatttgtcgaacatagcattgctgcatttaaaggaagaactattcatacttaccacaggtataatactaacttcaaaattgattcccccttataaatctcagacatgacatgtaaattcaatctataggagtattagtgtagggaaagcagctaacatatatttataatccatcatttttctattgttattgaatatgatttcatctgtgattaataggtgatagattaaaacttatgtctttcctagaataaattttctcacttctacaaatgccctatgcttatggatattgctctttcctttgggaatgatgacttggacatggtttatactttatgttacatattcacttcttgcaatcacaaatggaaatggaaaacacaatgcagcttttattttctggtctaagttgtattggctgattcttgatgtttcatattgtttacttgagcagtgaaggtgcaggtggtggtcatgctccagatatcatcaaagtatgtggtatgaagaatgttctgccctcatcaacaaacccgacgcgccctttaacagtcaatactatagatgagcatcttgacatgttggtaagatataaatctggtagaggtactaatgatgtgcattgtgatgacatgtggttctcaatttagactttctatgacatgcagatggtctgccatcatctgaatagggatattccagaagacttagcttttgcatgttcaaggataagagaaggaacgattgctgctgaagatattttgcatgatattggggcaattagcatcatatcttctgattctcaggctatgggtcgagttggagaggtttttattcaagctcagccatctacatatgattttcttcctgactcacctttattataatgaaaaatgaaaaaataaatatggtgcttcatacatttgtctaagtgttgaaatgaaatgggtaatgtgcatgtggcattttcacaatatgttttcttttaagatctgttactgtgtcatctttatgtgttgtgtccaatacccccatttgtttttttgtagttcactagtactagtaactattggtgaaaatttagctttttttcccctttttgaaccctcagggtttgataagttgcattatttcttccttaggtgataagcagaacttggcaaactgccaataagatgaaggtacaacgaggaccactccagcctggtgaatcagacaatgacaacttccggatcaaacgatacattgcaaaatacactataaatccagctatagcgaatggtttctcacaatatgttggttcggtggaggtatatgtgatttttaaatgtttaatgcatgctcaatatatgcattaattttctaggaaaagaaaaaagaaaccctgagatttccttttgattaaataacttattgtatacaatgtgctttaccatttaactgattaaagtacaaggtcactgtttcatatttttttgtcaaaaaagaatgttacactttggcactttgccatagcctatgacaatctcattcaaaatgagaggagtgaaacagaaatgcagaaattactagtgatatttcccgtgaaaaagcaaggttgcaaatgtcatcaatacttgctgacctatgttggccattggcctcttgtttacctcaggaaagaagcatgcacatgttagttggtacttggtaagaatttagtggattagataagttcgtagtataatttatgagtagtgctataatagtgaatacttgtacttgcttagctattcacgtggctgcatataagttgtttaagcagttcttattgaacatttgaacttgaactttcagtttttttattttttattttttgaaaagttcagattgagaaaaatgaatagttaagcatataagctactatacaagtcggttttctcttctctcataatttaacttcaaacttaacatatcagaggatagctataaatctgactctaaaccttctaattttagcattatcatctagatcactgcatttatgtgcctaactttgcaggtgggaaagttagctgatcttgtgatgtggaagccatctttttttggggcaaaaccagaaatggtgatcaaaggtggggtggttgcatgggctgatatgggtgacccaaatgcaagcatccccactcctgaaccggtaaagtttttgtatctagctaactagtttggctagagtttttaagtagagtgcctcttgcttagtctttttggtatttagattccttaatgttgttctatatttcctgatttgaccataaaagaatttaattgcttatactaatggagtctattttagttttcttaagggcacacacacctcacctcacatcggctaatgcatttaggaaaatgaaattggtgccaaacttccaatctaagattcgaacaccaagcgtctcgagtaaacgcgtgactgaaaattaaaattatataagatttgcttaatggtgacaacggtcaaacgtattacactaatgatgataaacttttcattacttgtttcattagcattcagaatcaatttcatgcaccattgcacaagttctaatgtaaaatttgtggttgagactaatttggacacacacctcaatgagattagaaaatctatattactaaaatataaaatagacagacagacaattagtttgtgttttgattggcgtttcaaatgtcccaaacgtccgttcacactttctaatgcacaaatccaaaagctacaatactgaagctttgagaaaaatgtcttgcaaacgtgctcttagttgttggacaattagcattttgatgaaactgcttccactaaacttattaaacacaatattgtaggtgaagatgaggcctatgtttggaacactaggcaaggctggtggtgctttatccatagcttttgtgagcaaggcatggaaccctctatccctcatacttacataaacaatttagtactaaaattacaaactcacgttattgttgttgtttcacaaacaggcagctgtagaactgagagtacatgctctatacggactgaacaagagggtggaagcagtaggcaatgtgaggaagctcaccaaactagacatgaaacttaatgactctcttccacaaatcactgtcgacccagaaaagtacactgttacagcagatggcgaggttctcaccagctttgcaaccacctttgttcccctttctcgaaattacttcctcttttaagtactagctccataaataaagcttataaattatctctcttctaaggttttaatgtgtagcactacctttataaattttttagttcccctactcttgttcttatgaattcagatgcaataaaactaagtgtgttggtttggtatctgttatgttttttgttctttttaaggcatcaattatgctgtggtgaagatgcacaagatagaataaatcactagatgaatccctgtttaaagaataagaagaaacttggtgaaaaagtagaacaaagctttaaggagaggcaaagcttttattgccgaattttttggtaacacatgcatggtgcaagagatgctcttcataaagtttttttttttttttttgaaaaattgtaaatgcgactctattaatttttttaaggtgaggtaaatttaatatttttgtaaatgctttgcaattcagatatttttgtatttttttctttagaaagaaatttatatcatcatgaaagtcgaacatcattttttccaaaaccgaaaaaacatatatctcttttatacatcttttttattggatgtctttttcaaaagcacatttagtggttagaaagttcagttatataattaaaattgaatagggccctaattggatgagacgcacataattgaatgatccctcatttttctcgtgtttgtttggaagtatatatcataacagtaaaaattaaaaaattattattattattttgctttataaaaatgtaaagaatattttagacaaaaattattcgaacatgagcaattataaagtaataaaaaaatgacctcttaaaagtagcattctcgcgtttccattagggttgtaacctctattgattatcacatttctttagtagaataaaataaaaatattaaaattaaaataagtttatggatttagttaattaataaataaataataaaatattggtatattttacataaataattaattaataaaattttgtacaaattttaaaataattattataagaatcaatcatcttaacatattatatatatatatatatgaaaataagatggaattattttgataatatcaattcgattttcattgaacaataaagaatctaattagataagactatatgagaaccatatgttcactggtacctttttttcacactgtggaaagataaaaggtggaagaagagagagtaaatatctaattttaaaaacattttttacatgtgagagtaattaactgttgttatatggaagggtatttt

SEQ ID NO: 5 - DNA, 750080 bp, Glycine tomentella
  source 1..750080: mol_type = genomic DNA
agagatgccacagaggatttcaatcctgataacaagattggagaagatggttttggtcctgtctactaggtattagagtgaacggccttttttcttccaagcataaaaatgatgttcctccctagcatttaaaattctaaacaactgttggattgcagggtcaattatctgatggtacaggtagcagtcgagtaacactcatcaaagtcacggcaggaaaccatgaatttttgaatgagataggcaagatatcttgtttgcaacaccctaatcttgtgaaacttcatggattttgcatcgaaggggatcaattgatattggcgtatgagtacatggaaaataatatcctggccagtgctttattcagtgagtttctacccagagtgcaaactattatgtttgtcttttgccttgtcatttattatatattttgtaagataaggtgccaagtgttaattatgataaatcacttggagatctgattaatctgaagaagtttgtttcccgcccttttccatttttctggatacaaaataaggaatgaatgagtgctatagctagttgtttttccttccctttgtctagacaaattaataccctgtgcttagattttatgctgttaaacttttcctttttcccatttctatcactttagcagctaggcaatagaattttgcaaccgtgattcatattaattcaaccataacttctttctgcatcttttataggctcaaaagatcaactgaaacttgattgggcaacaaggcttaggatctgtattagcatagcaaaagttcttgcatttctacacgaagaatcaagactcaagattgttcatcgagatatcgaagctactaaggtgttactggatgggaatttaaaccctaaaattaacagattagtagctttggatatcaaagctactaatctgttaattttgttttacagagggtatatggcaccagaatatgcttatggggttacttgtcttacaaggctgatgtttacagttgtggggttgaggtcttggaatttgttagtgggaagaactataagaattttataccaagtgataattgtgtttgccttttagacaaggtattctactatgcttcaatccctgatacatttttggcattatgaatcccttttgttttggtagttatccaatgcaaatatccatattttcaccattctaaagaaaggtaacaaaatttccattgcaggcatttcatctgcagcgtgcagaaaatttaatagagctggttgatgaaaggttgcgaacagaggtaaacccaactgaagcaatagctttgatgaaagtagctctcctatgcaccgctgtaacaccttcacataggcctacaatgtctgaggttgtgaacatgcttgaaggaagaatcagcattccaaatgctatccaacaaccaagtgattttagtgaagatttaaggtttaaagccatgagggacattcatcaacaaagggaaaatcacagtttgagtacaagccgaacaaacaatataacagaagtccttacacttagctctccctaaacatttggcaatgacctggtgttagttcatgatttcattgttgctgaccatattgcaacatgagatatccttagagcatagctgagatttaatcttttgggataaccaactgtaatgatcaccatttttaggatataacatttttcactccgtctttcagagaatatatttatttctagatccgtgtaaatttctaattgctcttgaagggtactttttttaacctgggtatttcattttgagatattattgtatggttcggtgcagtcccagttaatcttcatatgacacaatcacaagttttcaatttatgaaaacaaaattggcgtgtcatgtggagattgcttgaactaaaatgatctcggaccatataataatttctcatttaagaggtgcatatgaactccttttcactggatatacacaatatttggaggaagaatgtacatacgcacccttgaacttgggtgttatagcaaatagcaacttggagaaagaatgtacatacgcgtcttattaatctttgcgcgactgaaaacctgtttgttatatcttgctcaacttaagaacggcacattgagtttctcctttttatcaggtgtgtggtgtgtgggttcactgggttggggagttagtgagaattacaagttcagtgttatgctccgtatgacaatttttagggtaaaaagtaataatgggtgaagtaatacacctacgtagtgaagaagtgtttctaaggaataagaaatcaagtttcaacgctgccagccatcacagttatgagaaaagaaaacttcgagcttgttcagattaatttgtaaactaagccaccttccccctctttgacaatgatttagttaagactgatgtgtctaaaaaataacttcagtaaattttaaatctctttattttgaatattctactttggaaaaaaaattattattataaatttttattctcaaattaattccatctttgattctaatccattataaaggtgctgcaaacatgagcataatcaggtattaaaggtttaggaagagatgcaacacaagcaaaaatgaaaataaccatcataagttgataaaaagaaaccaaacatacttcaagaaaatataactaaaaagacaaattaaactactaatgtgcattccctaatgatcagcttggggcgtaggacgggataatatagagaataggtaacattcatgaacactttcaataatcactgtgggttccaattcggtcaattatgttagcaacagtttccttgctctcccttaggactttgacactcctctgcagcttttcacgctttccagaaattgaaggtgactcctccaacaacctctcaatcccaccaccactaggggatagcagatcatgaacaatctccttttccaaatccttgttaacaagattgttaatactcagcataagatgtaaggcaattgtgtcaatcaatcttttttgcactatcttccagtacgaaatcatcctcaccttcaaatcaaatgcttgagtaagcacagatgggtattgcctcaagtgaccaacttcaattttgcccacaccttcaagattcacatgcgatggattatgcggattgttcaaaacttcattcagaaaagtatcttgctgagatattaacttgttgtattcctgcacaaactccggattacaagtgtaatcagtatacatctccatttcaatggcctctattacatgattggtggaacttctctttttcttagaaataagaacctggcttgctcgcctggtagacatcaaaagctgatagtagttttcagaatgacgcgtgataactgaaaccagcacatcttcgagatagttccacacattttcaacaaaacctataggcttgttggcaatccctttcaccttcccttgcaatatagaaagaaaagcagtgcgaggcatgaaatttggaagaccaatccactttgcctcctccagcacctttatctcttgcataagaaaattcttgcttgcatcactttcagcacaatggtaaagatcattcgagtaggaatcaagcatctccaccaaccgggcagtacaatgcatgtttttgtcctccaggtactcatcaaattctcctctaagcaaaatttttctgagagattccttagtcaatccaataatatgcataaaagctgtcatggcatcagctactgaagccaagtttgttggcaacttttccaactcagacaaattgttagctagcttctcattgatttttttactatttctggcaaagttttagatatgctcatagcctgaacctgaaccagtttctgtgctagaactggaacacccacgatagacttgtctattttggaaagaagtggatggaactcaaacagtttctgttcttccactctagcatcctcatatgactcatcaccaatgcggtttctcacacaaacataaccaagaccaatgttcacatcatcggcagtaactttttctaacaagccctcaggagacttgtctgcctttgtgaccacagccagtgtcctgaggccagtttggtcaacactctgagacattctaatagactcacaagtagtgaaatcaacactagcagaaagaacattcaggataatactttcttctggcttaatgtactccatgatcatgtctttaatctggtcataaatgttctcaggttgaccatgaactggaacccgagttataccaggaagatcaaccattgtgagatcaggaacaccattcttcttcaccagcaaagtcaaagggttgttggaaatccctttaccatggcctgcaagctcttctgtggcagcatttatggcatgagaaacatttgcttcatcagtggaaacgattttgccattgaactccaagataagctctggggttggaagagggtggttttggagcctcatgaccaagggcaccctagtgcaaatgccttggccacgtggcaagctgataccagcaagagattcaagaacacttgatttgccagatgattgatcaccaacaacaacaatggaaggaagctgaattccctcctttgtaatgttaaggcgcctgagattttccatagcatcaagaactggacgtatcctctcattgtaagaggacacaattggtgcaacaatagcaagaggctgaggctgttctgcagatgggtcagtttcacattgagaaacagatagtgcaacaatagccttagtgctaggtctccttcctccagccattttcaatcacaatcacaatggtaaaaaatatagagagagagtgagagagggatagtttggtatgcttattcttattatgagtgagtgagtaaaaagccagagcttaaatgcatatttatagattaaaaaaaaaaaaaaaaaaaacttagaggaaaatgaaaggaaaggacagtttggtttggtatcttgaaagttgaaaacaagcgtgaattgagcttttcatgggaaccgcagttacagagctgttggggtcttccatgtttaggtaattgaaaggtttctcgttaaatgcatgcatggtagtaattgaattgccgtaaatattagtaacgaaaatttcttacattaattaattcaactcaagtagttttagtaaaaccaaacctgaaggggaatatgtaccaaaaaagaaaaaaactgaagggaatgtagttaaggaaaagggacaattcattttataattcatctgaggaagctataaagttttatttatgagtagttattactattgataacatgcttcggcagtatgtcctctctagtctctcacatactatggcatatgtatggtcgtgacctgtgacctgtgacctgtgacctgtgagaaaatctttgggtattgcttttgttgtcttaaaataaataaaaaattaatggtgctatttaattagtatggaaaatggtgaatatatactttgtttctttatgtatttttttgtgtgagggatttttgtttatttttggatgtatgacaggaaaaggaagggataaagagagaaaatactaatagatgataaaagatgcgatggaaaataaataagttttcatcattgataaaaaaaatactattacaatttaataataatataaagttctcttagtatttggaattttagacttaagatagaaaaaataatttgtttcattttttttatttttaaagaatttaaaatatttaatataaactctaacgaaataaattatagaggtttagagtaattctattctctataattatgaaattatgagccagctattttaggagaagaatttttatttttatgacttttagttttcgattaaatcctagtaaaactaaaagtttatagtcctgcattagttattcttctaaaatagtattttcgtttacaaacaaaagggtgaaaaaaataaaaatgaggaaaatacaattccatacaataaaatcatattttttttattttttttttatcattgggtgtttctgttacgtaaatggaagtaaaaaaaataaaacacaattttattatgcaagtgtgcatgagaatcatatttttgttgtgcttttttttttatccgatttacataattgaaacacatttttgtttgttgtgtttccattcaagaggcaatttggaaatacagctaaaaggcccccacttcgctagtgccaataggcaatactctgtagaatatgcaaaggcccatgattttcattcttctactgggccaacacaaacagcctcgggaccatcaattttatatgttcgagttaaggcatgtgcttcatacaccatttcattttcttatacaccatttgtttttttcgtaatacccaaaatgccctcctagtaaatggaaaataatatataaaggttaagcaaaaacgaccgagagagagagctgggagcagctgccgttcatgtttgcaatccattgtttgaggctttgagcttgtggcattgcttggaatcgccattggtgaggtcgttggaggtgtgcgagctgcagttcgaggtttggtgtcgccggagaggaagagcggaggttggggctgaggtaagctgtattttctaacgtacggattcggtaatccgcaattcaatggtgcatgcatttacggattaggcaatccgtatggtctaaacggattactcaatccgtatggactatacggattatacaatccgtatagctcatatggattgcctaatccgtatgatttgcacggattaagcaatccgtatgatctttacggattgtgtaatccgtatagtccatacggattgagtaatccgtttagaccatacggattgcctaatccgtaaaggtcatacggattgcgtaatccgtgtggatttgaaccatttaaaaaaatattaaaaaatggaatttattgtgaaaaaaataattttaaatattagtaatgccattttaatataaaaagtaattcatacaaaatagatcaggacaaaacatcagaaacatgataaccaacaatagctaaaaaactggagatagggatgacatgacgttgtaacaataacaattgtcaagtgcgaaataagcaaagtaatcatcgttgattggttatttaggtttcctgggtgactgggttgttgaaaatagctaggatttgtattggaccaaaacgtttccagtagttggattccgctaagacctttaacacatcttcatcggttatcaactcttttatgtcatattggattgtgttgtctgaatacgcgtagtgggatggttgtcgaaaaaataattttcttaccacctgtgagttgtgtattccataagggggaaccccaacaggtgcaacttgcttgatgacatccttgagtgtttgaatgttgcatcctgagggtatttgaaacatttttggatttgttccattgaacgaataacccacaccgtaaccgctctgtcgtgttctattccatttgccgttgtaatatagcattgcatcatgtgttcggccaattgtagattgaagtaagtttagtataccgtcggctgttctgttgattgtacaacatatttctataggaccaatagttgacatgttctcactagccattaacattgtgcaaacatcatcatcatttgttagttgtagagaatggaaaaaaatttcctgacctgcatttatagatggttgccgatagtacatttcatcaacaaattggtcatgggttagtacaagtgtgttgtgaatcctggtcttcagtgcctgagaagaacattcatcaggaactcgcattggcactggagtagaacattgaaaagaaacaccagtttcgtcgtgtatgattgatccatttggaaaaatgaatgctaatttggagttagcaatggtttgagtgctggtttctcctaagaatgccatagttatgggtgattttattttgcagatgtatgttatgtgggagaatgaccaaacaagtagggtgtccgtgttatttatagtagggtatgtgaaatttgaccgttgcacatggtgtgtcaggcatgtgtcatttgaccgttgcacatggtgtgtcaggcatgtgtcatttgaccgttgcacatgatgtgtcgagcatgtgttgtgtgcagttttttgtccagcagtgttgtctatgtcgttatgtcattttaccgttgcacaagctttttgattaactgtttaatgaatatgatttttgtgtgtggttttaacatgattaactgtaattatttaccgtgtatgtgtgtgttttgttagaatggacgacgatgagtggatgtatgagagtatcatggctgaagatatttacatgaatgaagacattgcaccagaccctaatgactttgaccacaaagactgttttatagattgttcggcagcgttccaaacaaatgaggtgagagtgtggatgacttataatttagtaatatgaatgtagtttaagtcgttaaacgattatatttgaaactttaaatatcaattatccttttgtgtaggtgtttgaatcgcgtgatgcggtattgaggtgggcccgtactgttgcgtctgagaatggatttgtggcggttatcatgagaagtgacaccaagaccggtaaaataggaagaacgtcatttgtgttaattggttgcgaaagaagtggaaagtatagagcgtggaaaaaaggttttttaccttcaagcacaagtagtagaaaatgcgagtgtccgtttaagttgcgggccaagccaatcgcgcaaagtgaagggtggatggtgaaggtaatatgtggtagtcataatcatgtaatggccaagtcattttgtggacacccatatgttggccgaataaatgttgaggagaagacaattgttgctgatatgacaagagcgatggtcaaaccgaaaaatattttgctaaccttgaaggagcacaatgcagataacgtaacaagtttgaaacaaatttacaatgcaagatatgcataccggacgcgtacaagaggtgataatactgaaatgcaacagctaatgaagcttcttgagcgtgacatgtatgtacattggcatcgagtgaaagatgaaaatgttgtgcgtgacttgttttgggcacatccagatgcaatacaattgaccaatgcatatcatatggtgttcttgatagacagcacttacaaaacaaacaggtatagactacctttacttgacattgttggtgtgacacctactgggatgacattcagtgctgcatttgcgtatttagaggcggaacgtacgaacaatgtggtctgggcccttgaacggtttagagggatttttcttaaaagtgaattttttccaaaggtaattgttacagacagagatttagcattgatgagtgcagtggagacagtttttccagaggcaaccaatttgttgtgcaggtttcacattgacaagaatgtgaaggcgaaatgcaaaacttatatccgacagcagaatgcatgggattatgtcatggatgcatggggaagtgttgtcgactgtgctaaggagaatgaatttgatgattatgttagtaagtttgaggttgcatgtgctccgtggccaacttttgttgattatgttaaggacacctggttgacttcccacaaagaaaaatttgtgacagcttggacaaacaaagtaatgcattttgggaacacaacaaccaacaggtgactttctttgtcttaaattatgattcgcatatgtataaatgctgttaaattaattgttttttctgtaaattgtagagtggagtctgcccattggaccttgaagaggttgctgcagaatagtcttggtgatttatgcacggtttgggatgcgatgaacaatatgataaccttgcagcatactgaaatcaaggcatctttggaaaggagcacacatatggttggacatgtttttaaagtgacgttatacaagagactcattggcatggtgtccaggtatgcgttaaatcaaattgctgctgagtatgagcgggtgcattatgcgggaaaaaacccatctcgttgtggatgtgtgcttagaacagcgtatggtttgccttgtgcatgtgagttgtataagtatgttcttgcaagcattccaattaacagcgttcatgtgttttggaggagattaaacttttcggataatggtcaagatgaaaaccaagtaaccataacagatgagatggaagccatatctaatcgttttgataagcttgatttgtgtggaaaaataacactaaagtcaaagcttaaagaaatagcgtttcctgataagaattcgatgtgccctccagctgctaaggtcaaaactaaaggtgctcaaaagaaaaacatctcaaagcacgaacgttcgacaagaagggacccgtcttacttcgagtatgtcgatgagttacattctgtgcagaatagttgttctacacccgtacagtgcagctcctcatctgatgttctaatgaggaaccggatggttcctatgctcgatcaatttcatccatttatgcagaaatttattgttgacattactgatgtcaaagctgatggaaattgcggatatcgagttattgcttcgttattaggttacggtgaagagggttggtcattagtgcgcaatcatctccttaaggaacttgcacaatggaccgatcgatacattgcgttgtttggtgggatacataggtttgaaatgttaaagcgatccctattggttgatgggttgtcaaaggtgaaaattcatttttattttacttaacattagttgccaatctgttatgttatccaggcatgttttattaaacaatgatctgcaggtgaccatggagaagtggatggatatcacagacatgggacatgtgattgcatcaaggtataacgtcgtcctagtatcgttgtcacggcaacaaagtatgaccttttttcctttgatgggccaacctccgacagatccacgggttcatcgagttttgtgcattggtcatgtctttggaaaccattttgttaaggtaagacacctcctaattactttggatgcatgcttgaaatttaatatattagattcatgatttctgcattaaacaggttactctggccgacaattgtccattaccgttgacggcatgtttgtgggctagtcactgtacaaccgaagctcaacagtggccttactattacgttgatcgaatgcagttgtatacgaaatcaatgaagatacgaacagaatatgttgatttgggaaatgtttagacaatagacgctcagttgacaattgaattgtatgcgttttcttatttaatgcataagaatcattaaaaacatgttgtgtgtcttaaaaaagtcaagcgcgaagtaagtgcaacataatgaactatactttaatatcgatcaaaatatatatcaatcactgtccagtaaaataatgctagtaactcatgtaagtcgaggtcaaatgtatacaactaaaatgtacaaaaaaaaataaacatcaatgtctatgctaagcaagacgcctcctctgtggtcggaaactccgtcgacctctgctgtagacaaggccatcctcagtgacgcctctaacatgctgaagcagctgctcaaccatggcccatgcatctgtgccttctgtcaccatcctcatgtcaagcatatgctgcaggccctctgcaacacgttggcacgcatgctgcaaataaacaacacaatttggttaataaactgaacatctaaaatgtaatccgtagagactgcaagaaataaacaataaataccaaggcatgaagtggtctctgctcatgtccaccactaggtggctcagatgaacgagcatgtccacctgtgggtgcatcagaaggagcatgggaatgggtcggtgcacgctgaggcagtggtggaatctgggaagtcgcctcctcatacgcagatggagtcatgaatggatgggacatgcggaagaaccaccccaggtatgcagcaccacagtgacctggatagtcaaccaagtctccggtgtccaccatgtgctccgcaaagtgaacccacctgtcctcgatgtcttcaaaagaaggaacaccgcccacaggctggggtggaatatgctgcacatggccaaactgcctaagcaccctctctggtagatacctagtaacgtgagggccccatctaaggaaaccggagaataaactgatggacggaaactccctgtgcggccgatgctgagtgtacggtgtccaagaaatatcagatggggtcaacctatctatacgtctacgataggttgccaccggtaaggccttcgcactcggccaccgacaggatcgaggctgcctctcgtcgtagtgctcatctgcaggaacatttcctatagtaggaaaatgctcgtatatccagcactaaaaattcaaaagcaagccaatcagcaaaacaaacgacctataaaacatgatttttctaattatacacatcaaacaacattactacctgtaacagactgatgtatcctgcaagatgcttcccgtgatgctgacatgcgtagctcaagttctcatacatgtgaaccagagcacccgcaccccaggcgaatcctgcagatcggtcgaagtctcggaacgcctccaagaataccacagctatatgtgtggcactcttgttggcgaacaatgtgcagccaacaaggtgaagtagatatgccctggcggccaaaatccactgcctcgcctccaccttcgtgtaatatgtgtcccggagccatgaaagtctgacataaggcccatgacactgggatgtctctgctgcagcctcctccagagtcacgtcaagtagctccaccaacaatgtcatcgcctcgcccacatccatctgctcgtatgagtcgaatatcccataacagggagatgcagcagtgatgacacgtcgtcaagtgtcaatgtcatctcacctacaggcaagtgaaacgaacatgtctctgggtgccaccgctcaacaaatgcagatagcaaccccctatcacctgtctccactgagcatcgaatcaatggactgaggccagtggcagccacaaagccctctatctcaggtacaggcttccccatcttaatgaccttacggccatgggaagcaagcttcaactctgcacgatcctgcatttaacatattatttaaggtaaaattgcatggataaccaaatgcatgacgacattcaactatgttttttggcatgtcaatacctctccggcccagacgcgtacggccacatgatcgcgaaatccgctcagcagagatgaatcctctggcactccagggaaagactccgacactgggtccatatcgtccatgaccgcatgaccctcctcagtgaccggatcagccgtctccacgtgtggttcctgcacggcaggaacatcgtcaatagcaacgcccgccctactacgacgtgcagatgcagtgggcctacgcctctcaggggcaccatgctgatgacctctcccatgtgaaatcgctgaagggtcaggacttcggccaacaggccgacgcactcctcctctggtcctagccataatctgcatccgcatggtgtatttcagtttttcagcttcaacaacaacatcattctttacttgacttgaccttgtctcataacatgcaactatagtactatatatctaggttatctcagccatgcttgtcacaattgtgaccaagcataaaataaaatgccataaaaatgactaaataatgggagtgttcaagttagactttaattactctattgtatccttatgttgtagttagactgttctatttaggcttctcttggtcttgctttaagaaaacctgatgatgggataggattcttgaaaataagcatctcattggctccattttactggagtgccacatgtgattattacaatccaggttattctcttctcctgctcaggagctaatattacaatctttaacattcattcctacctttcaacattaacaatactatttaactcttccaagttttggcttttgtaactgcttatttagtgtacctatctaaaagattgttatcactttaacactgtttttgcaggcaaatcaaataatcatattcataaccgaagcaacaggttttactggtagaaggttggattcctccattaggtgattcactaacaccatattaatggttcaactactgcaattcacaatatgtgtatacattaagtcctactctaattaaaagcaaccaatacatattttcaaatttcgacaactcagcctcacaagcatagttaatttctaatcatataaaaaattaaattatatttttttcggcgcaatcacatatattgacagctcctctttaattattttccagttttccaaaaaaaaaaggcaatttttatctgcagtgacatgctacggattacaggatccgtacgaatattacggattgttgaatccgtaaaattcatacggatcctgtaatccgtagcagtggcacggattcctcaatccgcaagatggacacggatcatccaatccgtaggacttttatggattacgtaatccgtatcatgggtacggattgaccaatccgcaggatttccacggatcaactaatccgtaagacttttacggattacataatccgtaaaagtcttacggattagttgatccgtggaaatcctgcggattggtcaatccgtacccatggtacggattaccggatccgtgtccgccatgcgcgaccaacagacctccaccagacctccatgaacggcgattcacaagccttaaccaacaaagaactcaccggggtgacgacacggactaaaacgcttcaccaccaaagcaatgtgcttgccctgtcgctgcaacaaaccttcgacaaactccaatgctgcggcgacgacaacacggaaccgaatgcgaacaacaagcccggaagaagtctaccctctcaatgatgctgcaacagagggaaaatgaaccgtaatagagtgatggtgttgccggaggagaggaggagaggagaagaagcttgaaccgtgcgtgtgggagggagggagaatggaagaggaaaagctttttcaaaataatagttaattttttttaaattgaagggtatatctggaattacactgttaaaaaatggtgtataagatattgtaatggtgtaggaagctcaccactcgagttaaatccctttttatggcccatgattttaactttttcaaaaagatatttttaatttacatgtagtataatttaattttagtttaccagataattttttttatttctttcttctataaaattttatgaaaaagtttattcaaaaggaccttaattaaaataaattaactttaactcattttttaactttcaaaataatattcggtaaaacaaaactatcaaaatagtaaaaaaaaaaggaaaaattgtatgagaaattcaaaacaccaattaataatgactcgtggcatttgaagaatcacaggattaataagtaagttgccataacaaaataaacctcgttttaaaataaaaattagtatttgcaaattacaaaaattatgaataaaatatttatgttttatttctcttaaaatttcaataaaaaattcaggatttaatcccacaaagatgataaatcttacattgataattaattataagcatatattttttaattactcccttcataaaagatatgtgtataataataaattaataatggagggagtataatatcaacaatttttttcataagagatactccctcaatcctaaaagaagagttatcttagattgtttacatatatcaataaaattaataaataatgaaagacaataataattttacaaaagtaactttaatattaacatttattacatttaaaaactataataacatttagtggtaaaaaataattaatattatattaaaattaaaatacaacacttattttaaaatacttttttccaggaactttagaagatatattctctccaaggttgtattattctatatggatcaaacatagatcctccccacaaacacaacttatattgttaacggaattacatctattccattggattgttgaagttttatctattcctatgttacaacatttataagtttaaggtttcattcttaaataaaactataagactgattttaagagttattccattcttcatctaatcatgtatgtatggtttcttttctatagactattgagcatcttattttacttttttttatataattttttattcttttcaaatactattactcaattttagtttttattttatttcaattttaaattctaagtttttttatagatatagttaaattttagggttattataatcttaattaatgcaaataaatttattttgaattttagcattatattatatataccaataatgaggatttgtttaaaatgattatgatttatttccataatttcttctccaatttggaaagtcttatacctataatttattcctatttaatataacaaaatattttattaattaataaagtactgatattctccttaatttttttcattaataaatttatgaaaaatcatagagtgtaaaaaaattagaaatatttcatccataattgaacaaaatataaaaaaaaattaaatatactgtcatttaattataaactactacatgtatgataaaattgttattgtttataataattatttttataaattataaataaaatcaagttgattaactttacattgataacataaatgaaaactatagtcaaaaataaaattacaggtatagtaagctagctaattatatccattgcctgtgtgagtaaacgaagatgacgaatcgatgatacaatattttaaagtgaactgaatcaactcatcttcgcagtcatactattatttagccggctatagcttgctaattgaatttgtatagattgaaacatcatccaatggctccaagtgtcaagtgggattctgttctgctaccctacctgaatcgaaaagataatcaataaagcaaattaatataattttcaccatcatccaaatttatatattgtatgatgtgatgtgaaccccatgatgtctataatatctgttggtactcttttaaattttatgtaaagtgtatgaacaaaattattttctttgtgacattcataacagactggagtttataagttaattaatttattgcccagtcagtattaattaattacgtactaaaccatttttctcagcaaattgtttagttttaataaacaattaatctccaaataagaagttttagtatgccatattttatttttagccgtgagtgattgccaacgattcaaagggtgccctggcgttgattaaatagaaacactcaagtgttgggaagctcttgtcttggatgatccccaagtctttttcttgctggagagttgctttggttacatgcataacctacaaagaagatttcaaatgcctaatattttatggaacttcttccatgactaaaaataaagtaattaatcttaatttttttataagaaaattaacggatattttttttaatatatatgtatgatttgttatatgtgtatacacacgaatatatataaactttatgttgattttttcattagcaatgaaaattagttattttattttctaaagtaatcctgtagtttaaattggactacattactgaaaacaagtacgtgatgaatctttttaataaaatatgtttttttttatctttataaatatccttaaatttaatttattatgtcctttatttttatttttttaaaaataaaaataaaagacatgataaattatacaagattaaattgaacttatatgaaaaaaatagttaaacaatgagatatagattggtcttctctgaaaagatggtgatccaactcatataatccattttttagtcattttttcttttcatctctccctccttctttcatcattcttttcttttatttttttaatctcctcgtatttattattgggttcatcaactattaatcccaattaacttaagtaaaagatgctatagatgttaatgttaattgtcgtttatttttatttttatgaatttggttttgataagtttttttaaacaggtccctctcatcacttaatgacttaatgatgatgtgtcagtcagatttatatatatatatatatatatatatatatatatatatatatatatatttctaggacactaaattatatgatttagtaagaatttaatgttttcttttttattcgtgtgagaatcaaattcagatatcatcaattttatattaaggcagaatgcacgtatgtagattagattatgttagttgtttctaattttagtgcttgagaattgagtttcactgtgttataatcataatttgagatcccccaatctattttggtaggatatagccattttgtactcgtcattatgcttcttgctgacgctgatggaaaactaccttcgaatcttcctgttctagagtcggcgaatttccatgtaactcaattttgctatcaaccaagaacactacattctccttctaattccgcagaactgatcataagccaataaatgatagtgaccttattaattaattatgaggcatttggtgtgtgcataattatcttttacacatgcattgcctaattggatggatgtatgtatatatagggaagagaatgctcttcccttgttgtattttactacttccatttcttttgaattggctattacaagaagttttaatttctacagagtcatggtatttcattatttttgcttcatttgtttatattattacatgcttgttccttactgttttcaagtttcttgcatgccacttactacttcatttgcacgcaggaaaatcgtgttgttgacgggaatgtggagaagatgcagcgggaggagagagcagatgatctggttgttcatggaaaagttgatcggaaaggaagaaaagctttgaaacacaaacatggggggatgaaagtttcattgctcgtacttggtaaactaggattgacatatataatatgagttcataaacagtaattaacatgaaaatgcatgtatatacatatactaattaaggtgtggattaattatactacctcgtagtactaattaaaccctgaagtgatggcaagtccttaatttaatgaccacttaccatgtgtatataaaacaatacaagtttggtgtggattaattatactacctcggagtactaattaaaccctaatgtgatggcaagtccttaatttaatgaccactaaccatgtgtatataaaacaatataagtttcattacatattgttgtgtctttaatgtttaaagcaattaattaattaagacaaatggataaccagttacacttactacattggtaaataaattaaaaaatatatttttatgaaatacataaaattatattatttataatttttttttacattcttttataatttttacactatataaatatattttttaaaattttttaaccaatattctaaggagaggtcgacacaagactcattaattaattgtgcacagtgcatatacacctcgttcattaattgatgcagtaagtgttaatttgggtttgcatgggtgcagcggcatttggtatagagaacttagcaactctgtctctagcagtgaacttggtgtcatacttcactggtattatgcattatgaactagcagatgcagctaacatggtcacctattacatgggtgttaattacatgctctccattgtggtggccgttcttgctgatacttggattggtagatacaaatccgttgttatttctggaatcgtcgagtctttggtaagatccaaacttaccttaattccttattgcataataacataagttactaatcgttattggtaaacccaagattatatatattgtttatgtgagtttgaccacatatagcaacgtaatctattttttaaacccacctttatacctattctctttttttttttcgattacctcatttattatttttattactttctttcttttatctctcaaagtatgtatataaggaataataaacctagattcaaaaaaaaaaaaaaaaaaccgttgactctcaagtatatagtgggaagagatatacatataaagaaaagaggggggaaaataaatgtgaaagattatatgattggaaaacatcaataaaaacgtaaaataaatataaaaagtgaaaaatatatggtgctgatttttctctatcatgctcttgaccaatatatttacatgaatcataatcaagtattataatttatttcttataaaatgtgatatttttaaatatgtgttacatataaaaagtgattgggatgcatgaataggtggttgtctagaatcatctaataatttttctttagtaaatagatatgatttttcttgttcaccaatagttttcactaattatgaaataaaataaaagatatttattggacaaaatatgaaaatattgaagataaaaatgttttttaatagttttaattacttattttgatttttggaaaatatttttaaaactaaaaaggttaccctaaacataatataacagcccagtaacatcaagagctggaacatgaaagagaatttgataattaaacatataaatgaaaaacagtacagtaaacggagatgttaaactttattaaatgacacctttagtttttttttttactctaaatcaattaattttattattaaatttaaattaaattcttttaaagttatatatagttaaataattagtttatactttattattttattttaatgtatgatatattttatatatctgccaatatttaaattaatcatctaaaatttaacaaatatatataattactgaaataataccctatttctctgtcactcggataacagattctagctagggtgattattagacattatataattgcaggtactcatctaatgattaataatgatatcaattatttaatttaatcaaataaaacaaattagataagaagtatttttaagttattatttaacaacttatatttaagtaaaaagtttaatatctttaatagaaaatctcattttaagatcttagttattatttttacgaatcctacaatgttatattactttaagattttatttatattttattttaataatatatctcattttaagattttaaatcattttttgtatatcctacttacactaatagaatacaagtcaattttgtgaaaagagtaaaaaattattatttttaaatggatactctaatagtcatatgcactaacattatacattgtccaataaataaatcaattatatatatatatataaaaccaataaacttatcacatataatatacaaatgttttacatattatcttttttctcttaaataaaaccaattgaaagtaagcccaatttatatatgcaactaatttactttaaataattttctaaagcttattcaatcacaagtgcatatatgcatgaatgtgttgtagggactggcattgcttacgatacaggcacgcgtgggtagcctgacaccacccatttgcagcctgtactatgtgagagatgcacattgtgaaaagcttagtgggaagcaagaagcatttctcttcattggcctctacttgttggcctttggtagtgcaggtttgaaggcttccctgccatcacatggtgctgatcaatttgatgaaagagaccccaaagaagcaatgcaaatgtcaagcttcttcaacggtctctttttagcactttgcgttggtggtgcagtcagcttaacatttaatgtgtatatacaagacaataatggatgggtctggggctttgggatctccaccgttgctattgttttgggcaccattatctttgcctctggattgccactataccgaattcatgctgcacatacaacaaacggaatattggagatcattcaggtatacactcttttgcaaaccttgttctgcatgtgctgtatatatttcaatttgaaaatcatatttttttttatactcacgatattagtgtgaaatatttattgattttattgataatcgattaatctccatcgaaaaacctagttgacctctttaagtggctctttcctctccatcatgtttttttcatctacaaaatttaaattcgagactttatgtaaagaaataaagtccagtattacccagactaaaatttgttggttgaaaaagtatatttttgagttcattaggcatgcattatgaaagtaaatttttttatacaaattgttaaccaattaaaattgattcatagtatgacttttaaatagtatattataaaaagacaaattaataaacttttatgaaaaccctttacattgttggtagatatattacttaattctatttttatttacttatagtctgattctgatacaatacaatagttgaagtttttaatttagctcgatattgcaatgatcaagcgcattagttttgaattcttcgcgtctattttccaggtctatgttgctgccattcgcaacagaaaccttccccttcctgctatccaactatatgagattcaacaggacaaagaagccgcagtggaaatagagtatcaaccgcagagatattttcaggttcaatccgaccgtgtctaatatgagtgaaatactatatgttaattgttgatagcttaagtattaaagagtaatgataaatgtatataccatggggattctccacagtgtctacctgtcacacatggctaaccatgtgtgcaaataaatatgattaattttatacaattatcgatttgaatttatagtgcttgtatttaattaactatgtctgcaagtggttaatagtatcacgaagttatgaggttattgaaatgtttaacgttggttaactttacctcacaagtcggaaatgattaataggaagggaacttgtatatataattatcattatgtactattgacacaaataattaaatatgtctcacaagtgattaattttcttttgcacaggttcttggacaaagcagctatcaaaagtagatctaatgagcaacctgagaaccaagagactccaatgttggattaaactttaataataataaattagaaatgtgaagattcatatctctaagagaagaagttactcatgtgaaaagtcatgtctttacatgagtcatgtctttaggagaagaagttactcatgtgaagagtcatgtctttaagtttcttataaatagcatctcatgtaaaaggtcaaaagtgtggcttggcagacaattatctaaatacatcagaagtattctaccaaagagattgttgtgtgtttgtgcgagtgcaccagtgtgtgtgaggacctgtgataccacaaattggtatcagagcattgagaaaatggagagtgggccaagtagtagtctgccattaccccgccttacaaaggctaattacgaaaattggagtatccaaatgaaagcccttttgggagcccatgatagttgggaggttgtccatggtggtttcgaggaaccaacatccacagcaggatatacggcagcgcagaacaagacattgaaggagacgaggttgaaagacaaaggggcgttgtacatgttattccgggctgttgatgattccgggtttgagaagattgttggtgcaacgacttcaaaggaggcgtgggacatacttgcaaatgtctacaagggtgccgatcgagtcagacaggttcgacttcaaactctccgtggagagttggaaggaatgaaaatgaaggaaggagaaggggtatccggtttcatcacccgggtccagaccgtggtaaatcaactaaacagaaatggagaggtgttgtccgattccagagtggtggagaaaattctgaggtctctcactgacgacttcgagaatgttgtatgtgcgattgaggagtcaaaggacctagcaacgctcaccgttgacgaacttgctggttccttggaggcgtatgaacaaagaaagaaaaagaagaaagaagagtcactagagcaagcactccagacaaaagcttcaatcaaggacgaaaaggtactctattctcaaaacttccgaggaagaggacgtggctatggaggtcaaggagatggtctaggtagtaaaggccgcggtcaagaaggaaggaataaggagtatgctgaatcaagtcggcagaattggcgaggccgaggtcgtggaagaggccgacattcaaatcaatcaaatgtagaatgttttaaatgcggaaagtatggacattactcgagagattgcaactcggacagatgttacaactgtggtcgagtcggacattttgcgaaggattgtcgagatgaaagaagaaatgaaacttcaaaccttgttacagaaggggaagtaagagatggaggaattctgatgatgactagaagtgaagtcaaccagggatccgagatggaatggtatctagacactggtgcaagcaatcatatgtgtgggcataaacatttgttcagtaatctgagacaaatagatgctggacatgtttcgtttggagatgcttcaaaggttgatgtcaaaggccgaggtacgatttgtttcttatagaaagatggacgaattgtgcgcatccgagatgtctattacgtgcccgatctaaaaagtaatattcttagggtggaagagaggattcaaaattctagaaaagggtggagaggattcttgtttgtgtctccagcattaggctgttgagagagcgtctccgagaggttgagagcaagttgagagcgtttccaccattgttgttggtgaggttgagtgtctccggctgaaggccgttgagagtgattgtaaccattattattgagaatagtggattgttctagactaggtcccgtgggttttccttttgaaggttttctcccacataaagctattgttggttgagtctggtgactccccagtgtttgtggttggttgaggtgttgctcccaacagagaaggagattgtgtgtttaatcccatcaaagtaagacagtccaaccgagatccgtgtagataataagtcagcaatcgagttagctaagaacctggtcaatcacgaaaggagcaagcatattgacgtcagattccacttcatccgagatcaagtaaaaggaaagaaggtggaattacttcatgtggcaagccgagatcaagtcggagatgttttcacgaagccattaccgacattactgctggaaaattgtaagaagatgttggggatgaaagacggaagaaatatttaaagtttatagggggattttgttggattaaactttaataatagtaaattagaaatgtgaagagtcatatccctaggagaagaagttactcatgtgaaaagtcatgtctgtaggagaagaagttactcatgtgaagagtcatgtctttaggagaagaagttactcatgtgaagagtcatgtctttaagtttcttataaatagcatctcatgtaaaatgccaaaagtgtggcttggcagacaattatctaaatttctttttctttatagccactgtctgcatctctgcacagaatcctttgcattgttcttgcataattaatgaagcatcattcaataactcctcctgaattctccttaggctttgtttgggagttaggaggggaagagaatgaaagaaattcaaggagaagggaggggaatgaaagggaggaaaatgagaaaagtttctttctccctgtttgggagttaaaaatatattaagagagagaaatagagagttcataagatacttttacaattttgtccttatttcaaaaattaatacactctatattttacaaataaaacttaattttaaattaaaaaaattatataatggtttgaataataattttattacttttccttctaaaaacctccaaatcggaagaacaacaattttaatggtttggaggaattcagagaagttttaaaaatccccaaattatttttctcaaaaattaaaactcccaaacaatgagatgttataacccaaacctttccctttgcaacaccccgtgtgcacccggtgtattaacattgtacaatatcagagtgacgcagcatgcatggaatcaaatagtaaaggaagcgtaattcattataatatattaaaactttgtacatacatggtgaattactgtcatatacataccatcttttccagaactatacataatgacctctcagggtaccaaaatacaatcaaaataatcaaaatgggagcctacaagctccggtgatctagacctaaatgtcttctaactatcccagtgcaggccttttgccttgggatccttcagggacttctgactctgttcctgcaacataagcccaacaggggtgagataactatctcagtaaactcagggtcctcagaggtcaccctcccctggtttacctcacaacacacatacacaaatataatctatacatgcataacaagaatgattaaacacaatcatatttcaatctcaacatatcatgagaacaagtcattcacaatgcttaacataaatcatacaactctatgcatccgcaatcaaaactcatgctatctgtgcctgactaggctcatccacctactcgtgggtacctctagtcaggacttaacgtccaatacctgaataggctcatccacctactcgtgggtacctctattcagggtttacatgaacgcctatggattaccctaaggaggatcatccacctgctcgtgggtacgtctccagaggggtccatagtttctcagtctactggccagtagataacaaacaatcagatcacaatcaaacaatacatcatcagcatcatactcaataatgcatacactatctcagtgtgatcaggaattcatactcaatatcatcataatcataaggcatctggcatatcattcaataccatatcaccacaaggcatataattatgtcaaacaaacatccagagggttgaagcaaacacaagcaagagaaacaaactctaaggacactgagcttacctggtcgtagctcagaaccagttcccctagtatctggatgagttctaccaacaagctgtgcctcacgccctacagtaggcatgaaccaaaacatcagaaacggcattccaccgttatcagggaaggaaataccttccactcataatcaataccaaaagtctgctatcctacagtttatctcaacccagcatctcactaggccacacattgcccttcattggcttgcctcagccttgccaatgcctcagagttctttcagaactctgtatagttcaattcaagcctatatcagaatcaaggatccaccttgattcaattcagcccaaatgcagatacaactacgttttcaccggttattaggcgtcatgagtaactttaataaagacacttgagctagttcagaccctaacatagctcaggtcctcacacttttctcattctagagtcaaactcaaacctcatcacaatttagatttcaacatgttatatgactcaacaccacctcctgattacgtctctctaaagaacttaagcctaattccagccctataaccaattgatcactattcattcaatttctcaattcacaatagaacggttaaacagaggttttcttacctcaaatcaacggaggaaggctggagaagtctttctccttgctctggtatcctggaaccagctcctattccttcctaaacccactctctgagaagattcaaggaggtgaggttttctctcaaaatctcactctcaaggctggattttggctcttacgtggctccaattagatttagaggtgtttagaaggtgttttatggctgaatgatgaagttatgaagctcaggaggtgctccaatggctgctgggacgagggaggaagatgaacagtgttttcttcctctcaatttcgcgttttgcctttatatagggtgtctgccagaggtctggcgcgactcgcgccacctccggcgccacccgcgccagaatggcggtggacatggcgccattggcgccgtcccggcgctgttagcgccaatttccagagactccggcgcctcaagcgccgcatcccacgccccaggcgtgagattccagagaaaattgaacttccacccatcttcccgcgccacccgcgccaaccctggcgctatccgcgcggactggaaatctgtggcgcctcttggcgtcaacttccacgctccaggcgtgaacttccagagtgtatggcgcccttggcgccaggctggcgccgtcagcgccaccttccagaggtctggcgctggtcgcgccaataacggcgctactcgcgccacagctcaaaagttgttttctctcaagaaacctggcgttgattgcatgaaaaccggcgctaattacgccaggtctcagggtattatacccttccctcccttccctttagaatccctctcccaaacaaaaccttaaaagaactttcatggtcattgttgttctcctccgatccttcacattggttgtttcctccaaccattattagtatatgtttcacctctatatataaaggaacttcagcaacatatgacatccattgtactcatcatattttgcaataacaataaagtgaactttgatatcatattataatttgaaaaaatgatacaaatgatattattttcacgtatccacttatcataaagattaaagccggggggagaaattttataaatatgaaaatgtgattaatataaaaaatatttgaatttcatatttatttgttcacattatctttctatttattatttttcattacaaaagtttgtcaaattaataacatgagagttcatataatatattatggatggtgctataatactaaagagtcctatttaacaaattcagaattgaactaaataaagttgcatgtaacagataacaagtatagtatagatttctgaaacaatttttttaatattacaagtaattccaaaatctaagttgttttttcccctctaaatattgataattcctgttggaatatgagcgtaatcaactagagtcaatttaatggtcgagagtttggagatatatatatatatcaatatagaaggatcggaatatttctccaacattatgtgataatacatatatatatatatatatattcctttctgatttcatttaaggagttttgagaaacattttcctactaaataaaagtagatgataactaatgactttcaatttcaatttttctgccccaatttcatcgtacatgtagccctcgaagtattatgacaagaaggtacgtagttgtaaaccaggttaccgctaacacctacttatcaattacaaaggataagcataccaagtgttaattccctagctaattaacacaatgtatcatttcactttcgaattcaacattccttcgatgtaggaatttcagcctaaattaaccaagctagcctccctcgtaaagcctcattcctgcaaaataaacgatgcctaggatggttaattaattcttaattggtttcatcgatatatcattcaatcattttgtttactccccagcaatataatcctgttaaagacatcacatgtacaaattcacttttattaattacaaattactgttatcctttggaggaatattgaaatatatattagagataaaagtaatctgttcccccatctcatcgaaaataacaaaaggtgaacactaaagtcatgcaaatcgatatatatatatatatatatatatatatgtatatatccatctcaagacgggtaatatgatcatttgcaattcattcatgactattaattaataatattattaaccatatggatgaaacaagctcaatgttgttaactgtaagccattaaccagaaattcatccatcaaactattttcaactaaaacagcatacagttctgatgtaattcaagtttcaaaataacgagtcccagaatgaatacataaataggactgtatgttaagagaaaacagtgggtgcttggttattcaagtattgccaagtcataaaaaaaaaactacgtactccattgttcgaaggttccacgttatgcgtaggtaagggagagggaaattgtacgcagccttatccttacatatgcaaagaggctgtttccagattcgaacccatgaccaacaagtcatcaagtcttcaagacacaattacgtgcctagtcataaataagaaaatctttaaatgctaacgatcaaaatgcgtgcgataaagataataattcatgctattaatttcatcaaactaatgattaatacttaccaaccaatttggatgctttgttgattactccccttgaaacgccagtcttgcaaatacatagacacttgctttgtgatcaaagtgtttcaccttctcaatatatgtttttcaatctccaaaagcaattagcatagaagcatcaaactctttaaagctcgatcgacatcacatgcatcatcaaatagcaaaaattgggcttacttctaaatcagtttctcacccggagtttgatccactcgtgagcaggttcttctcttttctcctagctctttgataacgtttactcttgagcacatagtacgtcatagtaccaagaacaccaagcattataactcccccaacaacagtaacaaacattgcagcccacttgtgatgcctaccaacaactatataagacgctgatgtgaatgcaatggtggtgcatatagacgccaaccacatcatcttattgatccccttcactaccctcatctcagactttgttctccctgtcacaagtgtgatttgaaccaccacaacagccagcgaagagaaaaacgcaacagcgttgaagatgaagaagatatctaagggtactgtgcctaccatcactgccaccccactatcatagtctccaccgggaatgctgaaaatggccgcaaacgcaagcgtggcaaagagaaccacaaccacctttacctgttggaatgaaattttagaagtgaagaaaatatttgagaatgagagattagaaatgttttggaggaagagggtacttgtggcttgttccattgtttctggtgagttgtatgatgattcacctagtgtattgtaattttaatgtgggatgactttttgttagatattggattataagatagcatctcaactgcaggtcattttacatatttcagttcccctaagggatattttagtgcatgtaatataaaaacaggctactaggttggttatgacaggacatctttccttagtttttcttgtataactctattagtatttgtaaaaaaattccaatttgaaaattcttagctcctcactaacaatgattagcatgggctgagtactttgagtttgagccaaacttaggtggaggtagtccaaccacagccactcttctatactggtttgtgttctcaacttatctgggactaattactgtttttatatttgtatgctcaagtgttcaataaaatgacccctttacctgcaacattagcaattgtatcaactcattatctagtctgatcattagcttgtgcgaactttcagagtcatttagatgtagcaaacacggagctttgtaaaatttgtaatgatttcttgggccctttattttcaacaattgtagatagtaaccttcaacttcacgatggtgctatattttacatggtaaactttattgtttaaacgagtttatatatgcataatgaaaaggaattgcagtaggacagctctcttattctccacaaccatcctttattcatatagatggataatgagcttgtttgtttaatttttccatttcactggtatgagaaataagcataattgtcctgcccttggtatatggaagaatttatgggatatatttaacatgaataatattcaaagggaacgaaatggagttgtgctatcttaaattgttggaactctagaatttttcttacacgctacaatttgttacattgtattattgtatgggacttggaaagtaaacatgcttccctatccattgggcaagtcaattatgaataatggcatggctaagctgagtttctttacctttattctgcattaacactaagcttcttaacatttgaaagttgtagttctaatttaaatattttggcaccgttttcttttatgagataattagatctcatgatttttttttcttttccagattctaaaccttgtacagaccaaaaaaatgtaaggcataagatgatcgttggagttggatttggagttacagttctattccttgtcattatcatagttggaatcttttggtggaagggctacttcgaaggaataattaggaaaataaaaagtaaatatatactatcatgttcttaccattctgaaattagtttacttcatttgcttcttaaagatttccaagttcaacttcccaaaaagtcaatcacttgacttagcgtataggaactgtgaagttagctaggtgctacaagacgtggttgatatgttgctagcatataatagttttaggctaaaataatcaacaatttaatcataatttatcaataaagattaggataagattaaatttcatcaattcttggtccattacttattttatgcatattttgtttaataggaatcaagaaaagaagaaaagaagcagaaccaagaaagatttgtcacaaaaataaaacagcaggagggtttattaccctaattaactatatggatgtggaattataaatagggacttaggaggccaaaagaaaaacacacagaaatacagacagaaacacagtggagagaagatcaaggccagaatttgaagacagattaatgcttctgctgtctttatatttcttgaggttagacatgaacatgtcagactaactttctttattgtggttagggccaagaaccaatgtgaactcctctgtaatttgattggtattaatatgagattattatgattactttgttttactctattcttcattgcatcattctttattaaatttgaccattctattaaagttctgagggttagagttcgcaatagagatgttgggactttaatttctgacatgagtaaaataacagtttttacattgcatacggatagggatgtatgattgcagaatttttatgatgtattcttttaaatgcttagcttgataggaattgctaaggaattaggatttctgattggattaaagggttaaattgctaaggaattagaatttaactaaatttggaaagatacatcctctgagtaatcagaagtaattgaatttaataaccaattcaagtgaaagaggtagggatcaaaggggattgtgttctaaccacaattatttctcttaactgcgtcacaatccatttaaagttgattttaatttcttaattttctgttatttatttaattcgcataattctacaacataacactactttttttaaacatattgttttcttccaatctctcagattgtgagttacgataaaattaggaatcaatccctgtggatacgatactctacttactcactctattacttgaaacgaacgatacacttgccgtttcacatcacaacagtagtcaggtaagattgaattaatatagtgcccattatgatagacctcattagggattaactatgaccaaagtgggtaagaaggttaagataataggtcaaaagcaaagaacttgccttaattttttactatggcctccaaggcatccaagaatgtgcatttagaaaagtattcattcttggatccaatagcctttgaggattggagataacgatttatctcttctgtgggtggtgttttatgcgtatgaattatttgcatccacttattgccttttatggtgacaagcatttctatgtatattgacacatatcaagcatttgacacataacaagcatttgtactttcctcaaatactcttaaacaatgcagatacgtttaacttactacgtaaaatgaaactggctgttcctctggaacacttattttacggctgacatattgaacaggtactgaaagacaagattgtttaacggggacatttacgttaaaacaaattagagatgccacagaggatttcaatcctgataacaagattggagaagatggttttggtcctgtctactaggtattagagtgaacggccttttttcttccaagcataaaaattgatgttcctccctagcatttaaaattctaaacaactgttggattgcagggtcaattatctgatggtacaggtagcagtcgagtaacactcatcaaagtcacggcagggaaaccatgaatttttgaatgagataggcaagatatcttgtttgcaacaccctaatcttgtgaaacttcatggattttgcatcgaaggggatcaattgatattggcgtatgagtacatggaaaataatatcctggccagtgctttattcagtgagtttctacccaggagtgcaaactattatgtttgtcttttgccttgtcatttattatatattttgtaagataaggtgccaagtgttaattatgataaatcacttggagatctgattaatctgaagaagtttgtttcccgcccttttccatttttctggatacaaaataaggaatgaatgagtgctatagctagttgtttttccttccccttttgtctagacaaattaataccctgtgcttagatttttatgctgttaaacttttcctttttcccatttctatcactttagcagctaggcaatagaattttgcaaccgtgattcatattaattcaaccataacttctttctgcatcttttataggctcaaaagatcaactgaaacttgattgggcaacaaggcttaggatctgtattagcatagcaaaagttcttgcatttctacacgaagaatcaagactcaagattgttcatcgagatatcgaagctactaaggtgttactggatgggaatttaaaccctaaaattaacagattagtagctttggatatcaaagctactaatctgttaattttgttttacagagggtatatggcaccagaatatgcattatggggttacttgtcttacaaggctgatgtttacagttgtggggttgaggtcttggaatttgttagtgggaagaactataagaattttataccaagtgataattgtgtttgccttttagacaaggtattctactatgcttcaatccctgatacatttttggcattatgaatcccttttgttttggtagttatccaatgcaaatatccatattttcaccattctaaagaaaggtaacaaaatttccattgcaggcatttcatctgcagcgtgcagaaaatttaatagagctggttgatgaaaggttgcgaacagaggtaaacccaactgaagcaatagctttgatgaaagtagctctcctatgcaccgctgtaacaccttcacataggcctacaatgtctgaggttgtgaacatgcttgaaggaagaatcagcattccaaatgctatccaacaaccaagtgattttagtgaagatttaaggtttaaagccatgagggacattcatcaacaaagggaaaatcacagtttgagtacaagccgaacaaacaatataacagaagtccttacacttagctctccctaaacatttggcaatgacctggtgttagttcatgatttcattgttgctgaccatattgcaacatgagatatccttagagcatagctgagatttaatcttttgggataaccaactgtaatgatcaccatttttaggatataacatttttcactccgtctttcagagaatatatttatttctagatccgtgtaaatttctaattgctcttgaagggtacttttttttaacctgggtatttcattttgagatattattgtatggttcggtgcagtcccagttaatcttcatatgacacaatcacaagttttcaatttatgaaaacaaaattggcgtgtcatgtggagattgcttgaactaaaatgatctcggaccatataataatttctcatttaagaggtgcatatgaactccttttcactggatatacacaatatttggaggaagaatgtacatacgcacccttgaacttgggtgttatagcaaatagcaacttggagaaagaatgtacatacgcgtcttattaatctttgcgcgactgaaaacctgtttgttatatcttgctcaacttaagaacggcacattgagtttctcctttttatcaggtgtgtggtgtgtgggttcactgggttggggagttagtgagaattacaagttcagtgttatgctccgtatgacaatttttagggtaaaaagtaataatgggtgaagtaatacacctacgtagtgaagaagtgtttctaaggaataagaaatcaagtttcaacgctgccagccatcacagttatgagaaaagaaaacttcgagcttgttcagattaatttgtaaactaagccaccttccccctctttgacaatgatttagttaagactgatgtgtctaaaaaataacttcagtaaattttaaatctctttattttgaatattctactttggaaaaaaaattattattataaatttttattctcaaattaattccatctttgattctaatccattataaaggtgctgcaaacatgagcataatcaggtattaaaggtttaggaagagatgcaacacaagcaaaaatgaaaataaccatcataagttgataaaaagaaaccaaacatacttcaagaaaatataactaaaaagacaaattaaactactaatgttgcattccctaatgatcagcttggggcgtaggacgggataatatagagaataggtaacattcatgaacactttcaataatcactgtgggttccaattcggtcaattatgttagcaacagtttccttgctctcccttaggactttgacactcctctgcagcttttcacgctttccagaaattgaaggtgactcctccaacaacctctcaatcccaccaccactaggggatagcagatcatgaacaatctccttttccaaatccttgttaacaagattgttaatactcagcataagatgtaaggcaattgtgtcaatcaatcttttttgcactatcttccagtacgaaatcatcctcaccttcaaatcaaatgcttgagtaagcacagatgggtattgcctcaagtgaccaacttcaattttgcccacaccttcaagattcacatgcgatggattatgcggattgttcaaaacttcattcagaaaagtatcttgctgagatattaacttgttgtattcctgcacaaactccggattacaagtgtaatcagtatacatctccatttcaatggcctctattacatgattggtggaacttctctttttcttagaaataagaacctggcttgctcgcctggtagacatcaaaagctgatagtagttttcagaatgacgcgtgataactgaaaccagcacatcttcgagatagttccacacattttcaacaaaacctataggcttgttggcaatccctttcaccttcccttgcaatatagaaagaaaagcagtgcgaggcatgaaatttggaagaccaatccactttgcctcctccagcacctttatctcttgcataagaaaattcttgcttgcatcactttcagcacaatggtaaagatcattcgagtaggaatcaagcatctccaccaaccgggcagtacaatgcatgtttttgtcctccaggtactcatcaaattctcctctaagcaaaatttttctgagagattccttagtcaatccaataatatgcataaaagctgtcatggcatcagctactgaagccaagtttgttggcaacttttccaactcagacaaattgttagctagcttctcattgattttttttactatttctggcaaagttttagatatgctcatagcctgaacctgaaccagtttctgtgctagaactggaacacccacgatagacttgtctattttggaaagaagtggatggaactcaaacagtttctgttcttccactctagcatcctcatatgactcatcaccaatgcggtttctcacacaaacataaccaagaccaatgttcacatcatcggcagtaactttttctaacaagccctcaggagacttgtctgcctttgtgaccacagccagtgtcctgaggccagtttggtcaacactctgagacattctaatagactcacaagtagtgaaatcaacactagcagaaagaacattcaggataatactttcttctggcttaatgtactccatgatcatgtctttaatctggtcataaatgttctcaggttgaccatgaactggaacccgagttataccaggaagatcaaccattgtgagatcaggaacaccattcttcttcaccagcaaagtcaaagggttgttggaaatccctttaccatggcctgcaagctcttctgtggcagcatttatggcatgagaaacatttgcttcatcagtggaaacgattttgccattgaactccaagataagctctggggttggaagagggtggttttggagcctcatgaccaagggcaccctagtgcaaatgccttggccacgtggcaagctgataccagcaagagattcaagaacacttgatttgccagatgattgatcaccaacaacaacaatggaaggaagctgaattccctcctttgtaatgttaaggcgcctgagattttccatagcatcaagaactggacgtatcctctcattgtaagaggacacaattggtgcaacaatagcaagaggctgaggctgttctgcagatgggtcagtttcacattgagaaacagatagtgcaacaatagccttagtgctaggtctccttcctccagccattttcaatcacaatcacaatggtaaaaaatatagagagagagtgagagagggatagtttggtatgcttattcttattatgagtgagtgagtaaaaagccagagcttaaatgcatatttatagattaaaaaaaaaaaaaaaaaaaacttagaggaaaatgaaaggaaaggacagtttggtttggtatcttgaaagttgaaaacaagcgtgaattgagcttttcatgggaaccgcagttacagagctgttggggtcttccatgtttaggtaattgaaaggtttctcgttaaatgcatgcatggtagtaattgaattgccgtaaatattagtaacgaaaatttcttacattaattaattcaactcaagtagttttagtaaaaccaaacctgaaggggaatatgtaccaaaaaagaaaaaaactgaagggaatgtagttaaggaaaagggacaattcattttataattcatctgaggaagctataaagttttatttatgagtagttattactattgataacatgcttcggcagtatgtcctctctagtctctcacatactatggcatatgtatggtcgtgacctgtgacctgtgacctgtgagaaaatctttgggtattgcttttgttgtcttaaaataaataaaaaattaatggtgctatttaattagtatggaaaatggtgaatatatactttgtttctttatgtatttttttgtgtgagggatttttgtttatttttggatgtatgacaggaaaaggaagggataaagagagaaaatactaatagatgataaaagatgcgatggaaaataaataagttttcatcattgataaaaaaaatactattacaatttaataataatataaagttctcttagtatttggaattttagacttaagatagaaaaaataatttgtttcattttttttatttttaaagaatttaaaatatttaatataaactctaacgaaataaattatagaggtttagagtaattctattctctataattatgaaattatgagccagctattttaggagaagaatttttatttttatgacttttagttttcgattaaatcctagtaaaactaaaagtttatagtcctgcattagttattcttctaaaatagtattttcgtttacaaacaaaagggtgaaaaaaataaaaatgaggaaaatacaattccatacaataaaatcatattttttttattttttttttatcattgggtgtttctgttacgtaaatggaagtaaaaaaataaaacacaattttattatgcaagtgtgcatgagaatcatatttttgttgtgctttttttttttatccgatttacataattgaaacacatttttgtttgttgtgtttccattcaagaggcaatttggaaatacagctaaaaggcccccacttcgctagtgccaataggcaatactctgtagaatatgcaaaggcccatgattttcattcttctactgggccaacacaaacagcctcgggaccatcaattttatatgttcgagttaaatccctttttatggcccatgattttaactttttcaaaaagatatttttaatttacatgtagtataatttaattttagtttaccagataattttttttatttctttcttctataaaattttatgaaaaagtttattcaaaaggaccttaattaaaataaattaactttaactcattttttaactttcaaaataatattcggtaaaacaaaactatcaaatagtaaaaaaaaaaaaggaaaaattgtatgagaaattcaaaacaccaattaataatgactcgtggcatttgaagaatcacaggattaataagtaagttgccataacaaaataaacctcgttttaaaataaaaattagtatttgcaaattacaaaaattatgaataaaatatttatgttttatttctcttaaaatttcaataaaaaattcaggatttaatcccacaaagatgataaatcttacattgataattaattataagcatatattttttaattactcccttcataaaagatatgtgtataataataaattaataatggagggagtataatatcaacaatttttttcataagagatactccctcaatcctaaaagaagagttatcttagattgtttacatatatcaataaaaattaataaataatgaaagacaataataattttacaaaagtaactttaatattaacatttattacatttaaaaactataataacatttagtggtaaaaaataattaatattatattaaaattaaaatacaacacttattttaaaatacttttttccaggaactttagaagatatattctctccaaggttgtattattctatatggatcaaacatagatcctccccacaaacacaacttatattgttaacggaattacatctattccattggattgttgaagttttatctattcctatgttacaacatttataagtttaaggtttcattcttaaataaaactataagactgattttaagagttattccattcttcatctaatcatgtatgtatggtttcttttctatagactattgagcatcttattttacttttttttatataattttttattcttttcaaatactattactcaattttagtttttattttatttcaattttaaattctaagttttttttatagatatagttaaattttagggttattataatcttaattaatgcaaataaatttattttgaattttagcattatattatatataccaataatgaggatttgtttaaaatgattatgatttatttccataatttcttctccaatttggaaagtcttatacctataatttattcctatttaatataacaaaatattttattaattaataaagtactgatattctccttaatttttttcattaataaatttatgaaaaatcatagagtgtaaaaaaattagaaatatttcatccataattgaacaaaatataaaaaaaaaattaaatatactgtcatttaattataaactactacatgtatgataaaattgttattgtttataataattatttttataaattataaataaaatcaagttgattaactttacattgataacataaatgaaaactatagtcaaaaataaaattacaggtatagtaagctagctaattatatccattgcctgtgtgagtaaacgaagatgacgaatcgatgatacaatattttaaagtgaactgaatcaactcatcttcgcagtcatactattatttagccggctatagcttgctaattgaatttgtatagattgaaacatcatccaatggctccaagtgtcaagtgggattctgttctgctaccctacctgaatcgaaaagataatcaataaagcaaattaatataattttcaccatcatccaaatttatatattgtatgatgtgatgtgaaccccatgatgtctataatatctgttggtactcttttaaattttatgtaaagtgtatgaacaaaattattttctttgtgacattcataacagactggagtttataagttaattaatttattgcccagtcagtattaattaattacgtactaaaccatttttctcagcaaattgtttagttttaataaacaattaatctccaaataagaagttttagtatgccatattttatttttagccgtgagtgattgccaacgattcaaagggtgccctggcgttgattaaatagaaacactcaagtgttgggaagctcttgtcttggatgatccccaagtctttttcttgctggagagttgctttggttacatgcataacctacaaagaagatttcaaatgcctaatattttatggaacttcttccatgactaaaaataaagtaattaatcttaatttttttataagaaaattaacggatattttttttaatatatatgtatgatttgttatatgtgtatacacacgaatatatataaactttatgttgattttttcattagcaatgaaaattagttattttattttctaaagtaatcctgtagtttaaattggactacattactgaaaacaagtacgtgatgaatctttttaataaaatatgttttttttatctttataaatatccttaaatttaatttattatgtcctttatttttatttttttaaaaataaaaataaaagacatgataaattatacaagattaaattgaacttatatgaaaaaaatagttaaacaatgagatatagattggtcttctctgaaaagatggtgatccaactcatataatccattttttagtcattttttcttttcatctctccctccttctttcatcattcttttcttttattttttttaatctcctcgtatttattattgggttcatcaactattaatcccaattaacttaagtaaaagatgctatagatgttaatgttaattgtcgtttatttttatttttatgaatttggttttgataagtttttttaaacaggtccctctcatcacttaatgacttaatgatgatgtgtcagtcagatttatatatatatatatatatatatatatatatttctaggacactaaattatatgatttagtaagaatttaatgttttctttttattcgtgtgagaatcaaattcagatatcatcaattttatattaaggcagaatgcacgtatgtagattagattatgttagttgtttctaattttagtgcttgagaattgagtttcactgtgttataatcataatttgagatcccccaatctattttggtaggatatagccattttgtactcgtcattatgcttcttgctgacgctgatggaaaactaccttcgaatcttcctgttctagagtcggcgaatttccatgtaactcaattttgctatcaaccaagaacactacattctccttctaattccgcagaactgatcataagccaataaatgatagtgaccttattaattaattatgaggcatttggtgtgtgcataattatcttttacacatgcattgcctaattggatggatgtatgtatatatagggaagagaatgctcttcccttgttgtattttactacttccatttcttttgaattggctattacaagaagttttaatttctacagagtcatggtatttcattatttttgcttcatttgtttatattattacatgcttgttccttactgttttcaagtttcttgcatgccacttactacttcatttgcacgcaggaaaatcgtgttgttgacgggaatgtggagaagatgcagcgggaggagagagcagatgatctggttgttcatggaaaagttgatcggaaaggaagaaaagctttgaaacacaaacatggggggatgaaagtttcattgctcgtacttggtaaactaggattgacatatataatatgagttcataaacagtaattaacatgaaaatgcatgtatatacatatactaattaaggtgtggattaattatactacctcgtagtactaattaaaccctgaagtgatggcaagtccttaatttaatgaccacttaccatgtgtatataaaacaatacaagtttggtgtggattaattatactacctcggagtactaattaaaccctaatgtgatggcaagtccttaatttaatgaccactaaccatgtgtatataaaacaatataagtttcattacatattgttgtgtctttaatgtttaaagcaattaattaattaagacaaatggataaccagttacacttactacattggtaaataaattaaaaaatatatttttatgaaatacataaaattatattatttataatttttttttacattcttttataatttttacactatataaatatattttttaaaattttttaaccaatattctaaggagaggtcgacacaagactcattaattaattgtgcacagtgcatatacacctcgttcattaattgatgcagtaagtgttaatttgggtttgcatgggtgcagcggcatttggtatagagaacttagcaactctgtctctagcagtgaacttggtgtcatacttcactggtattatgcattatgaactagcagatgcagctaacatggtcacctattacatgggtgttaattacatgctctccattgtggtggccgttcttgctgatacttggattggtagatacaaatccgttgttatttctggaatcgtcgagtctttggtaagatccaaacttaccttaattccttattgcataataacataagttactaatcgttattggtaaacccaagattatatatattgtttatgtgagtttgaccacatatagcaacgtaatctattttttaaacccacctttatacctattctctttttttttttcgattacctcatttattatttttattactttctttcttttatctctcaaagtatgtatataaggaataataaacctagattcaaaaaaaaaaaaaaaaaaaccgttgactctcaagtatatagtgggaagagatatacatataaagaaaagaggggggaaaataaatgtgaaagattatatgattggaaaacatcaataaaaacgtaaaataaatataaaaagtgaaaaatatatggtgctgatttttctctatcatgctcttgaccaatatatttacatgaatcataatcaagtattataatttatttcttataaaatgtgatatttttaaatatgtgttacatataaaaagtgattgggatgcatgaataggtggttgtctagaatcatctaataatttttctttagtaaatagatatgatttttcttgttcaccaatagttttcactaattatgaaataaaataaaagatatttattggacaaaatatgaaaatattgaagataaaaatgttttttaatagttttaattacttattttgatttttggaaaatatttttaaaactaaaaaggttaccctaaacataatataacagcccagtaacatcaagagctggaacatgaaagagaatttgataattaaacatataaatgaaaaacagtacagtaaacggagatgttaaactttattaaatgacacctttagtttttttttttactctaaatcaattaattttattattaaatttaaattaaattcttttaaagttatatatagttaaataattagtttatactttattattttattttaatgtatgatatattttatatatctgccaatatttaaattaatcatctaaaatttaacaaatatatataattactgaaataataccctatttctctgtcactcggataacagattctagctagggtgattattagacattatataattgcaggtactcatctaatgattaataatgatatcaattatttaatttaatcaaataaaacaaattagataagaagtatttttaagttattatttaacaacttatatttaagtaaaaagtttaatatctttaatagaaaatctcattttaagatcttagttattatttttacgaatcctacaatgttatattactttaagattttatttatattttattttaataatatatctcattttaagattttaaatcattttttgtatatcctacttacactaatagaatacaagtcaattttgtgaaaagagtaaaaattattatttttaaatggatactctaatagtcatatgcactaacattatacattgtccaataaataaatcaattatatatatatatataaaaccaataaacttatcacatataatatacaaatgttttacatattatcttttttctcttaaataaaaccaattgaaagtaagcccaatttatatatgcaactaatttactttaaataattttctaaagcttattcaatcacaagtgcatatatgcatgaatgtgttgtagggactggcattgcttacgatacaggcacgcgtgggtagcctgacaccacccatttgcagcctgtactatgtgagagatgcacattgtgaaaagcttagtgggaagcaagaagcatttctcttcattggcctctacttgttggcctttggtagtgcaggtttgaaggcttccctgccatcacatggtgctgatcaatttgatgaaagagaccccaaagaagcaatgcaaatgtcaagcttcttcaacggtctctttttagcactttgcgttggtggtgcagtcagcttaacatttaatgtgtatatacaagacaataatggatgggtctggggctttgggatctccaccgttgctattgttttgggcaccattatctttgcctctggattgccactataccgaattcatgctgcacatacaacaaacggaatattggagatcattcaggtatacactcttttgcaaaccttgttctgcatgtgctgtatatatttcaatttgaaaatcatatttttttttatactcacgatattagtgtgaaatatttattgattttattgataatcgattaatctccatcgaaaaacctagttgacctctttaagtggctctttcctctccatcatgtttttttcatctacaaaatttaaattcgagactttatgtaaagaaataaagtccagtattacccagactaaaatttgttggttgaaaaagtatatttttgagttcattaggcatgcattatgaaagtaaatttttttatacaaattgttaaccaattaaaattgattcatagtatgacttttaaatagtatattataaaaagacaaattaataaacttttatgaaaaccctttacattgttggtagatatattacttaattctatttttatttacttatagtctgattctgatacaatacaatagttgaagtttttaatttagctcgatattgcaatgatcaagcgcattagttttgaattcttcgcgtctattttccaggtctatgttgctgccattcgcaacagaaaccttccccttcctgctatccaactatatgagattcaacaggacaaagaagccgcagtggaaatagagtatcaaccgcagagatattttcaggttcaatccgaccgtgtctaatatgagtgaaatactatatgttaattgttgatagcttaagtattaaagagtaatgataaatgtatataccatggggattctccacagtgtctacctgtcacacatggctaaccatgtgtgcaaataaatatgattaattttatacaattatcgatttgaatttatcactactagaaaaataggttttaacatcgcctgtttaacatcggttattgggaaaaccgatgttaacgaaaacgcggtggcaaatttgtaaataaatggactttgttaacatcggttttcaagattttaacgtaaaaccgatgttaaccatgtactgttaacatcggttttcaagattcttaacaaaaccgatgttaagaatgtaatgttaacatcggttttgaagattttaatgtaaaaccgatgttaactatgtactgttaacatcggttttcaagattcttaacaaaaccgatgttaaccaagtaatgttaacatcggttttccatatttttaataaaaccgatgttaaactaagatagttaacatcggttttgttattgaaaccgatgttgttatttttataaaacccaccccgccactgattaaacccttcactctcgcgcctacctctgaaaagctctcaccttcactgtgacgacgctttcggtctaaaccctgcactgtcacccactgctcctaccttcgttgtcgtcgctgtcattgttggttccaggttccagtcaccattgtcgcttccagtcaccgctgtcattggcattgttggtgtctttttgaggtcacaactgtcggcacgcagctcccacaaggttagcattcctctgcttccatctattagttggtttgaaatggaactgaatcatatgaaatgctctgtggctcattggcaccagctgaacaacgatttcatgattttcatttgtttccataaattaatgtgttaatgtaccttatttgatatctttaggtgtatgttgaacaaaaggtttaagaaagcaaagatgaaatttgtaaagaagccgtagtgctttaggtttatgttgtgtgggttttttgttgattcgagttttctgttgttggttgtggtgaagggatcaatgatgggttgtaatatatagggcctttttatgtgtgaacatctcgagtatttaatggttaacatattctgctgttgaggtaaatctggaagaatgtaggactctagataaacaacaagagagttgttgggataaccattgtgctttgtttgtcactgttgaggattattagagggcccctgagaaaaccaataaaataaaggcaaaagcaggaccatactaaattgatgctatagatgttgtaagatcataaagcctataaggttactataacatacaaaatgaatatagcatagtacttaaggaacaacgcagtgagtagttgtcataacatacacaaaaagaataaatacatatatactaacaaaacaaggatatgagagccattcgaattagactttgaagttacaatgtacgttcactaagtgcgctataaaatgcctaaactgtgtatgatattcattgtggttctgacattgtgtccgtgtctgcaagttacaatgtatgttcacatgaacctcatgcattgctagatggtgagtgttgaagttcatttcgatatttgttggtgcttaattggttggtttttcatatatccttgtgaactcaatacttgtgtacagttgtctccgtgaggatagagcaatggatgtcaaattcttatttggtttgaattggtagctttagtagtttttgtttgtttggttccattgttccaatgttttagaaataagctatgtctccaagtttgttgacaacatagaagcaaaagaaaaaatacagaaagcacccaaggctaggacagaaagtacataatgatttcttctaaccaagtcattatattagatagtatttactgccatgagtaacttacccctgatgttgcatgattcgtctgatagactgcataatgggttcaatatcctttagaacatcctgctcctcagatgagtaaatgtccaatctctgtccaggtgctctaggcaggcgattcctatttttccagtcgccagcatttgaaccccgaccttgcgaaccttcaaatcgatttttcttaaacgagtctctaccttttccccactgaaaacctttctcattttctgaattagctgaagcaatatgtgattcccatccctgtgaacttgaattttgatttgactgattatattagttttgtttgcttttgattaatataatagatagggtcttaggtcttaaattgttatatgatgaatgaattgaaatgaattgagtaattaagttgatggatctatatgcgtttgttggattgatgataactaataatggtgaaccaattcagacttggtggctgctttgttttggtttatgaagctcgcttgagtgaagacttgaaccagtgctaggaggtgcttgctgaaccaattcagactgtaagtatatgcttctggctttatatgtttatttagtttaatctatttgtattttaagtgaaaaacaagatgtaatcttgctttaggtgatttagacatatatgaagaagaccaagtagatgtattttaagataatgataaggataggcataacattagaagtacatataacatcattgagaaggatatatagagtaagggtagtggattattagtgtgaaccttccaagctggagatagaagtaacacctaccaattgagctgcaagatttacaaataattcaagattgttatttgtttgaattgggaggagctgatgtgctgttaggggtggaatggttggcaggtttgagtgaagttgaggctaactttgagaagctaaccttagctgagggtacagaataggaagatcactttgagggctgaaccagaattgattaaagatgccattagaatgaagttgattaaaggaaccttgttggaagctgatcaagggtttgtagtggagctgaaggcagtagacagagaagagcaaatagaagaaattccagattcaatcgggcaggtattggcagaatttgagcaggtttttaaggaacctcaagggctgtgataggaactggatcagttttagtgaaaacagagaagatattattgaatttgggagcaattcccagctattacaatgtgattttcgaggaatcttaacctccatacaatgtcattggtcccctcctctctactgcttacagtgtatttatattctgtttccaactaataactgatagttagtttcagttatttcaactatccactaactaaaagctcctattccaactaacccactaactaaaagctcctattccaactaacccaccatcatttcacgattcagctctatgcgaagcaaccaaggtgaaattttttcacaagcaacttcttcatcatccatttcatagtaggacttcacaaaatgaacgtcctcttcaattattgtactcatcgggtctggatcataccatacctctgtagcttcagtcacactcctgagagtggtatattctaaagcacagacaaataaggcgttttaattctctttgccacattaatgatttcccttaacctacgaacaccaagagtaacattctttgcactgacactagcatagtggaaagtgttgagagtcatactgcttctgtgtttgttgtcattttaatatgaatactcccctaaatatgacgaacatagcattagtttattgaatagcgcaacccttgacaatgaacgctcctataatgatctgatttgatccttatgattatataaatatatatggtaagtattttgggataatgttgatgttgtcactacattgactaactttctacttctaatgcttgtattttgatttggctcagtcgcttgataggttcccattgtttgcttctcattcccagactttgatttggcgcatgtgtgtcaggtactatgattttaattgtctagtgcaatagtagtaatgaaaggtattattgtgtatgaaccattattatttatgcacaaatcaatgcaatagggtagatcactcttcaccatcatttgtatgtagttgtccgttgcctctgtgtaccatcgtcaccatatcaactgttggacattagcattcaccatcatctcaggtacttacaaatgccttgcatctttttttatcttatgtatgtaaattgttttatgccatttaattagtatgtctatatataaataatgttcattatgagtgaaccgtagtttcccgtttgagattcattacagtgattcttccggacagtttggattaatcattgtattgaatcttgaattgttcgtttggacagtttcggagggcttatatttttttagtatattcatgtttatacgttgtcattcttgtcttaaatatgataaaatttcggtccaatgcatttcactttgttctccgggtgcatacttgattgtggtggaactcatgccaccgctttcatttcgtgtacttggagaccaaagcgaaatgctgccgaaattttgtcatatttaggataaagactcaacgtatagatatgaatatactttaaaaatatgtcttcctgaatgggatagggccacaccttgaattaaaaaagtgaggttttcatgcatggatgaactttgtcaatggatctcagacttggttagcacatggatcgatcttggatgaatgcaagtcgcatcacggttgagtacgaacaaggagttgaaaatttcttacaatttgcctccgaaagaggtccacccgatggggatggaaaatatttctgcccctgtatcaattgtttgaatggtcgaaggcaaacactagaagacatacgggagcatcttctgtgcgatggaattaagaagacttatacgacatggatatggcatggtgagttgacagacacgcagagggtctcgcatactgaaagggttgatgttgacatcggcgatcgactagaggatatgatccgtgatctggggcatgagtcttttcagcaagcacatgcccctatgtatgacacgttggagagtgattcgaaaaagccgttgtatccggggtgcaaggagtcattgacactgttgtctgcggtgttaaatctagtgaatgtgaaggccaaatatgggtggagtgacaaaagcttcagctcactgcttgaggtacttaaggacatgcttccagaggaaaacaccctgcctagcagttactataaggcgaagaagatactttgtccgatgggtatggagtataagaaaattcatgcctgtcctaatgactgcattttgtaccgaaatgaatttgaacaaatgcataaatgccccacgtgtggggtatcacgatacaaagtgaaggatgttgacgaatgtggcagtgatgacagttcagcgaaaggccctcccgcgaaggtgttgtggtatcttccaatcattccaaggtttaagcgtctgtttgctaatgaagatgacgcaaaagaccttacatggcatgcggaggtaagaaactctgatgggatgctccgacatccggcagattcagttcagtggaaaaagtttgatcgtttgtatccggagttcggcaacgagccaagaaatctaaggcttgcacttgctagtgatggaatgaatccgtacggtagtttaagtactcagcacagttcgtggcctgttttgcttgtcatatacaacctgcctccttggttgtgcatgaagcgaaaatacataatgttgtctatgatgatatcaggcccaaaacagcctggaaatgacattgatgtttatctcagtcccttgattgaagacttgacaaacttgtgggatgagggggttgccgtgtttgatgggtatcgaaaggagacattcaagttgcgtgcaatgctattttgtaccattaatgattttcctgcctacggcaatttgagtggatacagtgttaagggccatcatgcatgtcctatctgtgagcaagacacgagttacttgcaactaaaacatggaagaaaaacagtttacactcgccatcgacgttttttgagatcttatcatccttatcggcgattgaaaaaggcatttgatggaagtcaagagcatgaacttgcaccgattccgttaaccggtgagcaggttcttgagcgggttaatgccatccatactgtatttggaaaaacgcaaaagaagcagaaaggtaatacatgcttatggaagaagaggtccatattgtttgagcttccatactggtctgatctagatgttagacattgcctcgatgttatgcatgtggagaaaaatgtgtgtgacagtgtcatcggcacgttgcttaacattcaagggaagacaaaggatggtttgaacactcgtcaagatcttgctgagatgggtatacgtcaacagttacatcctaggtccgatggtaaaaaaatttacttgcctccagcatgccacacattgtcaagaaaggagaagatcagtttttgtcagtgtctacggcgagttaaagtgccacaaggatactcttcaaatattaagagccttgtacagatgacggatttaaaactaacttctttgtaatgcaggctgagtttgatatacctgaagcctcagacgaaaggacaaagaggaagatacttcagacagtgggtgagcggtggaggcagttcaaatccgacttgacaaggaagtgggtcctcgcagaagggaacgcggacgttgccgacgctgtatgcgagaaatacggcatcagtcacgaacagtggacccaattctgtcagagtaggcgagcagcttcctgggaggttagtggttttaccccttttgagtggatatgtgttaaccaaacaattgtccataactatctctatataaccgtgtatttttcataaccctgttttttttcatttatgttgtcatacactcttttatttgctaactttacgtgtcaacttgttacaggatgtgagaaagaaggcccaggcaatccagaggcaaaacaccgcccctcacgtattgtcacgcgggggttacgagttgctcgagaagagattaatggaggaaaagcaacagaagcaagtcgagggagcaactcgtgatgacagcacggagactatcattcatcctccgtcccccgtgcgacgacacgtgaagtggaagctggctcgcacgaagaagagcggcgacatgacttcggaggcggcacgcgagattgctgcgaggattgtaagtaaaacaatacaaatgacatagacatttatttatgtttcgtatcacaactaacaaaacaaatgatctactttacgaattgcaggattccctggaagagcagtccacccagggttcttttgtcgccagtggtcgtcaggatgtcctggctgctgccattggacgaccggagcaccctggacgtgtccgtggtgctggagttggtgtgaccatcacccagtacttcggacccgctgcatcatcctctcggaagtcgaggtcttcatccatggcgcctgaggacttggatcgcctgaaagacaacatcagggccgagctggagcagtccatcactgatcgacttacacagtcgatcacagagagagttacccagcaggtgatgatgagcttcagccagctgcaatcccacatccagtctcaggcagccattcagcctccggaggtacagtcatgtccccttggtgctcgtgtcagcaccaagggaagctgcgtcgatccctcgggcaatgaccctgacacgggtgcatctgacaggcgtgggttgtatgtggatggcaatcctccccgccttgttgcccttggcagagttcatgagggatcgacgactgtgcacaacgtccctcttgccgctggtcaggtaaaggtgagtgttgaggaggttcgcgatgcagacgctcccgtccctgttcccactgacgaggttgtgttagtggggcaggcacttaacactttccttgcctggccgacacatcttgtacagacaattttgacccaggttttgttctttttcccttatgtcttttattttacgaatgatttgtcacatatgaacttaacatgatcgctcacccttggttgttaactgtgtaggataaacaagaagccaagggaccggcgaaacctgtagataaggaggaccatgcttctgatcccttgtaccttctagccctgaccatccctgatcttttcctcagacccttccaggtgccatgggaccctcagatgtttggggtatttaatgaaaacttccccttgtacatgaggcatgaggatatttcggagatcatccatggtggtcagtgtctcagcatctccgttttacagttgtggatgttgtaagtctcttgtaattgacaaattatttggtgaattgttttatattgtagcataacttactttattttcattgcataataggcatatgaatcatttaagtctgcaatccgataaccccgatgtctatggattcctcgagccacagtcgatacagagaactggccaatctcagtttttgatcgaggactatatgaagaaatggatgcagacttcacagaaaaaagtctaccttgcaccctatttgaatgggtaagcataaatgagaatcacaatttattaatgcagcatactaaacttgttcttgacaatgcagttcacattggcaactgatagttatatgtccgaaggccaatgtagtggtgtggttctgttcgttgcataacagacctgataactaccttaaaggaattgttaacaggtaggttctaatttctaacacatttacgttattttttatacttcaaacgtaagttgaacactatgcatacttgtttgtcttaagcagtgctttgaagggactgcatgactctccagcaaataaatcaaaggctacaactaaatggattgcgcttaaagtaagtcttttcattaatcatggtttaagtatcgaattattttttattcatgttcacggtatttgccatttaactttgactttgttttcaatttagtgtaataagcaaataggaagcactgagtgtggctattatgtcatgcattggatgcagacaatagtccaaggagccttcacagatagctgggacatggtaaatacttgtctaatttaaaacaaattgttttgctttacttgtttttgttttgtacttataacatgttttgttatctcatgcagtttttcaatgatcaaagaccattggaaccggacaccatgaaggcaatcagactccaatgggcgaaatattttcttaaatttagacaagatgtattagtagattagggggttcatttctagttttcaaaacaattgtatatatattaatgtttagcatattctttatgtacattaacactttacattggatttgttattggaattattaaattgtgcattgctggtgctgctactggatatttaaattgtgcactgctggttctggatatttaaatttgcaggttgaagaactgctaaaattgaaaaaatagataaaatatttaaaaaaaaaaataaaaaacaacatcggttccaaacaaaaccgatgttaacatatacaacaacatcggttttgaaggaaaaccgatgttgtatgaataaacaacatcggtttttgtaagtgaaccgatgttgtttcttcaaaacaacatcggtttttgttagtgaaccgatgttgtttcttgaaaaaaacatcggttttggagagaaaaccgatgttgatatcattaaaacaacatcggttttctcttagaaaccgatgttgttttcaagaaacaacatcggttcactaacaataaccgatgttgtttattcatacaacatcggttttcctttaaaaccgatgttgttgtattccttgaaactcttttcagcgctttcatgtatgacgactccacatcggttattggtgacaaaccgatgtgctttacatttggtaacatcggttttcaaaaccgatgttaaattctccactttcaacgtcgcctgattcaacatcgctcgagaaccgatgttaaaagtctaaaataaccgatgttgaaagctgcttttctagtagtgtatagtgcttgtatttaattaactatgtctgcaagtggttaatagtatcacgaagttatgaggttattgaaatgtttaacgttggttaactttacctcacaagtcggaaatgattaataggaagggaacttgtatatataattatcattatgtactattgacacaaataattaaatatgtctcacaagtgattaattttcttttgcacaggttcttggacaaagcagctatcataagtagatctaatgagcaacctgagaaccaagagactccaatgttggattaaactttaatgataataaattagaaatgtgaagagtcatatctctaagagaagaaattactcatgtgaaaaatcatgtctttacatgagtcatgtctttaggagaagaagttattcatgtgaagagtcatgtctttaagtttcttataaatagcatctcatgtaaaaggtcaaaagtgtggcttggcagacaattatcggcaaaaaaatttaaataatgctttttaaataacaaattaccaaaatatggcaattcaaaacctatttacaaatctactgttgtcatttgcgttttggtaaaacgtgttaaaacacgtccagcttagacgtgttaaaacacgtcctgggaggacgtacatggtgctcaaacacgtcctgtgtagacgtgaccttgcctcaaacacgtcctgcatggacgtgattaaacacgtcatgcagggacgtgattcaaccccccaacagcctataaatcagccccctcagcccacgtacaatttgccaagttgtggatgttgaattgttgattatagcaattgtaaagctctgaaccaagtaagtgatactatgctcaaatgtttattggttaattacgtggattatgaggtaaatttttgttaattagttaggtaatgtatgacctaggtttaagtgacatagttggtgacatagataattgatattgtagaaatagttattgtgttattgtcatagataattgatattgatgtacaaaattgttattgacttaggttagaaataattacttattataacaaaagttcgatgacctaggttttgattaattgtttatcatgatatggttatacatttttatgtgttacaggcgtgaccgtggtgttgtgttcatcatcattgtgatcttgtagtcgttggtcatatattaaaaatgtctggagatggtgattttgttcgtatcgttttatattataatggtagcaaaactgagagtcgacatggtattgtatttgaaggagagaaaaggggaacacgtatcaaccgcaactcaactattgaagaattgcatgaaaaaatcagaaaaaaattattgtgtacagaagccaatgtatctatcagtatggtcactgcaagaatatggtgtgatgataaatatatcagcatgaaagtaattgacgacgaagacttagaatttgtaataggagaattcttcaaccagtcaagaaaaaatttcttagagttgtacgtggattttggtggactagaggatgtggctttaccaacgaggtcagttgatttcaattattctcgtggagcatcagcatctgctgctccaattgcaaatatgtctatggaagacgaaaatgatcccacttgggttatggacaatgatattgacaatgatgatgatgaaaatatcgcaatggaagatcgtcttcttgctgagaatgctagtgcttcggacaatgatgaggatgatggtcgaagtgcaagacaaatacaagtacattacccagtcgtgagagagcattcaacccaagaacaagaggatgcaggggagtcgcatttaccacaacaatgtcaaggtgtgttaccgaacaagactcgcttacacatatgtttgtttattgtgtatgtattttattgtcatgaatttgagaatttgcatatgtaggtgagggtaatactactttttgggatggaatcccacattacacctacattgattgggattatccgagtgaacaagattctggcagtggttgtggttcaggttcagttgagggtccatgggtattagggaataagttgtttgtgaaacaggaatttgcatcaaaagaagacgtgcaaatggcaatcaagctgaacctcatgaaggagcatcaggaagctatcgtggttgaaagtacgccgagaaagttaatcatgagatgtcgtgcgcatgaccagaattgtccatgaagggttagggtaatcaaaccaacgtacggtgaaagatgggtggttaccaaatgggacggcgatcacaattgcttaaatgatcacatttctcaggaccacagacaacttgatgttaatgttattgtttcactcgtactaggtaagttattggatgagctgataatgataataagtaatgatattattcttattattagtgataacgtgattatttttttattattagggatgataaagcatgatccatcatgttcaattggactagtccaggaaaggataactcattcctatggatacaaagtttcatatagaaaggcatggtatgcaaagcagaaaacaatggcaattatctacgatgattgggaggaatcatatgcatttttgtcgaggtggtgtgaatacatgcttcacttttcaccaggttcgatttatcaaattcagacaaaaaattattatgtggctcatagaatcgttcgtggaaaacgcgtgttccagcgcattttttggaccttcagacaatgttgcgaggctttcaatttttgtaagccggttattcaaattgatggcactcatttatatggcaagtacaaaggaaaattgttgattgccacagctcaggatggaaacaatgagtgtttgccaattgcatttgccattgttgaaggtgagacgttggaagcttgggaattctttctggataacattcgctcgcatgttacaaagaagacaaatctttgtctgatttctgataggcatcaaagcatattgtctgcagttgagatgcaccccgggtggcaaccaccgcatgcttatcacgtcttttgcctccgtcatattgcgagcaattttaatcaaaagttcagagatgaaaaattgaagaaagcggtcatgactttaggtatggttaaaaactcatgtattgatttttcatgtataactaaattttaatgttatttaatttctgtgcagggtatacgccttctattgttgattttgacatagcctttgcaaattttcgtgatgtgagtcctgaggttgccaactggattgatagcatcccgaaggaaaagtggacacgtgcatatgatgtcgagggacgcaggtatggacatatgacaacaaatttggcggagtcagtaaacaggattttgaaaggtgcaagaaacatgccaataaccgcgttggttaagcacacttacagcagattggtggaatattttgtttgcagaggccgatcggctcttaatgaattgcaaggtccttatccacattgcaaaaatgtggttgctatgttgaaggccaatgagaccagtgctactggtcattatgttcgtgcatataacgttgaacgatctgtatttgaggttgacgatggttatgacaaatcgtactcggtaaacctccctgagcggttctgtcagtgtgggaaatttaaggcgttcaagtatccttgtagtcatgctgcagcagccgcgttacatgttcgtcagtcaccggcacaatatgtggatgacgtcttccttatatcaaacttggtacaagcttattcattttcgtggcagccaattggtaatgagcaggcaattccacctagtgatgatccagtggtcataccagacagagaatatttgcgtgcaaagggtcgtccaaagtcaactagaatacgcaatgagatggacgaagttgaagctagtcaaagtcgtattaagtgtggtatatgcagattacctggtcataaccgtcgaaattgtcctagtcgtccatcatgaattggttatgttcttgtcaatgttttgctttatgttgttgtattttgtaatgaacatttgaaccgtaaaccaaacgtccattgaaatcactcatgtgaaattcatatatgctacgatgagtttcagacatcaaaacgcaattgacattaatggtaacatagtgatggaaacctaatacaataacagaccgtacaaacaattggaactagagagataaacccaaaaaagttgaacatcgaaaaagcaaaacaacgaaccctactaagaacaacaattcaaacatgaaaatgacgaaactaatcataatttggatggtcttgtgcagcggacatgtcatcttccagcagttcgattaccggtttattaaaggtagctaagatttctattggagagaaacgcttccagtaattagattctaccaacaccttcagtacatcttcatcatttttcagttttattatttcatattcgaccatgttttctgaatattttgcgtgacctggttgtctgaagaacaattgtctgacaacctgtgattcgtgaattccataagggggaactcctaccggcgcaacttgcttgattatatgcttcagtgtttccatattgcatcctgaaggaatttgaaatcttactggattttttccagtaaacgagtaacccaaaaaattgtctgttcgtggtatgttccacttgccgttgtaatacaacagtgcatcatgagtaggagtcatggtggctcgaagtaggttgaggacaccatcaggtgttctggttatcatacataacaattcgataggaccaacagatgggagtttttcatggcacaccaacatagtgcaaacatcatcatcatttttcaattgcagtgaatggaaaaaaagattgttacctgtattaatggatgtttgtcgatagtaaatttcatccacagactggtcatttgttagcagaagggtgttgtgcattctactcttgagtgactgaaaggaacactcatcgggaattcgcattggtatcggagtatgacatacgaaagaaacaccagtttcattctgtaagattgatccattcggaaaaataaacgctaatttggaattaccaatattttgagagcaggtttcacctaagaaggccatcgtattgaggttgagtttcggttgtggaggtatgttgtgtggatgattaaacaccactgtgatgtatatataaccgtgttaagccctgactgtgtggggggtcaccacttgcgcctggatggggcgtgagtaaacagctgtcgtggttgtgttgtcaatgtcacatgacagaccagtgaaatttaatgtctacagtaaaaaggaccacaacgtgttgtcaatcgtccccggtgttgtcaatgtcattttacaaatcagacgtacttattggctacagtatagaggaccacaaagtgttgtcctgcattgatcaaagcggtagggctctttcacgtgggccaaaggaccacaaagtgttgtcctgcattgatcaaagcggtacgtgttttagacgtacttattaggcgataaataaatgtccataatgaaaacatgtttaacaattacatagtcaaatacaaaaaaaaaggaaactaaagtaaataacaaaatataatgtctacgaaggaggaggccactgataatgacgggcctgacgatctgacaatctgcgtctaccacgtccatgcgaatgctgaccagcaacataatatggcggtggagtgtcctcgactggcatatctggacgataatatgtctggcctgcatcaaaattaatttcaccatacaggtcatccgaagctctaccaccccagtcatgataccctgaagcactcgtccctgcctcatccccgaatgccgtactcgtccctgcctgatccccgaatgccaccgacactggactcactgcgtacgcaggctggctctctgtgaacatcggtgcgggctccggccgatagcatgtatcagcctctgcctgggtagggtcgtaatatgtctgatgaaccccgtactgatgaccgatgttgggaggcctgatccatccaggcatgcatggcgtgggggcatgaataggctcgggaacaggtgtaataggacgtcgacggcgtcctaaccctcgaccctctctcgcacgacgccaaacgtcgagcgataactggggctcatccggaagctgggactgcggtgcctctagacctggctcagtcacccgagctgactcactgaaaacatcaatcagacgacctacttcgtcatgcacatactccagaccgtagtttccaaattgttcaggcgtcgtcacaaaatacaaactctccagaccatcagcctgtaagccacaacatagttactaaaacaactatatcaaataatgaaataataaatattgtgttctagtaacttaccgagcgtcctaatctggccccctgcttcgtcacatatcgcttcccagaaagtctataccaaaccatgtactcatggttcggtgacatcagaccatatattggaggaggcacgtcaacgtgttcacccctcctatcccatctctgtataaactttctgagcttacgagcccaattttcttgggctttaccccgaagggtataatcatgaacccccttcagtttcccagccctacgaggaattggttgatcccgtccgaattgcctcatgcatcgatcgggctgtgaatactcagcaatgtgaaaacaaattataggtgtcctagccatccacagacgtcgtgtctcagcagatgcacccataaaatcgtaatcaccgtaaggttgccaaaccacctacataattaaaacatctgtatcaggcagttgcatattcacatccatttaaaactgaacattatttatttaaaaagacatacctcatgtctacgtaggctgtctagcctctcccgaaaaaatgtcaatgagttcgggctgaagcgacgtaagaaattaaatctaatacacagattaaacattcaagcgttaattgtagcacgcataaatacacagccattctagtaatacacaataaacatacctgtgtccgaagtggcggtctggctcgaacacagctggcaatgggggagcaatcggtggaaatctgagccatgcccaaatctgaagcaaaacagtacacccaccgatgtcttttctatcggggtctgtgcattcgcacaactgtctaaacaagtttgccagaaccgcaaacccccaactatatgaaccaatgtcagcaaagtcaccagcaagtaaggatatgtaccgacatcctacaaagctcccccctgatttgtcgcataggagccaggctcctaacatccgagcaatgtgagccttcgtgaagtatatctcattctgagggttcccggcaacaaattgccatgcacgatacactctgtcgaagtatgataatctcaaactgccggtgcataactcgacgtccggatcagggccgttaccaaaaacctggttacacaattcggaacaatctgtgtaggtccgtccagtaacggctcgcccatcagtaggcaatcctagaatacctgcaacatcttccagggtgatcgtcatctcaccctggggcatatggaaagtgtgtgtctctggcctccaacgctcaaccagagcactgataagagcaggatcaatctgcaaaatcgaagtaacttatcgatttatgcgtttcaaatacattatgtttgaaaccatcgatttcacaattacaatttcatcagattaagttaacaacattcgttaatcgatacctgcataaacctcatacgagccacatgtatgaagtcagcctcagtcaaatactgggctactgtgtccgggatatcgtcgtgttggggtccaccaatgagtctacctgcgcgacgtatcttcagctctctctgtgtgtcctcattccacactgcctgtgaaatatgagtgcgttgcctccgccttcgaagtacatcccatctatatggaccgggaagaacatgcgttgtgggatcggtaggctcatgctcccggtcagagccagaacgaggtgactcagatgacgacgactcagccataataatatgctacacattttataattatattataatattttacctaatttcaaatacaaattatttaattcgctaactacaaattatttttacacttcaatacatgtatctaggtcactatctgataatctacttcgtaatctaggtcactatctaataatctaactcaccaacgataaaaaggtctatttttgttctggtcacaagtgtttcaatatgctatataccttaatgtcatcacaattagtcatctcatcaatattaactgtgtatgtcaacaattttcattaaaaaaatatataaaatacaagctcattttaacaaaagaattgtatttaatttcttttctaaaatttaattgaattaataataattaacctaggtcctaatctaagtcactatctaataatactctaagtcactaaataacaatttaagtaacaaactaacaactaacaactaacaattaacctaggtcactaactaactaactaactatttaacaatctaagtcactaattaaaccctaacaactaactaacctagtaacaatttaagtcactaactaataatcaacctaggtcctaaacacattttggcttttgatatctcatcttgtaatatttattatgttttacaaatacattttggtattcaatatgataaatatatcattattaatggaatttaaaatttaagaatgccaaataaacctaaacctaggtcctaaccctaaacctatgtcatcaaccctaaacccactatttgtttcttaaaccctaaatatatgttataacctacgtaccctaaactaagtaactaactaacctactaatataatatatatcatgcaatttcaaaaattaactaaccttacctcacctcacccacctacttcatagtctaagacactaactaataatctaataacactaacaatttaagtcactaactagtaacattgtaacatcaataaaataaagaatatttcaacatgacttacttgatttatacagcttctttgcaccttcttccttgcaccaacccaaagcctttccttgcaccaagccttttgcagagagaatgcagagaaaaaaaatttttgagggagagagagtagcaagtgcagtgtgggatggctgggggggtatttgtacaggtagctgaatcacgtccctgtgtggcgtgaatggtgcttggtcacgtccacacaggacgtgaatggtcctctaacacgtctctgcacgacgtgaataaagccaggacgcgtccctgcaggacgtgaatggagccaagacacgccgctcctagacgtgatgcaggctctgttacgtctgccatggacgtgaatcaacacgccttccacacccgtgaccatgttccagtcgcgcccatgtgtgacgtgaataaacacgttccctcacagcgcaaatgacagcattagatccgtatatacttttcaaattgccatattttggtaatttgttatttaaataacattattttaattttttgccgacaattatctaaatacatcagaagtattctaccaaagagattgttgtgtgtttgtgcgagtgcaccagtgtgtgtgaggacctgtgataccacaaattggtatcagagcattgagaaactggagagtgggccaagtagtagtctgccattaccccgccttacaaaggctaattacgaaaattggagtatccaaatgaaagcccttttgggagcccatgatagttgggaggttgtccatggtggtttcgaggaaccaacatccacagcaggatatacggcagcgcagaacaagacattgaaggagacgaggttgaaagacaaaggggcattgtacatgttattccgggctgttgatgattccgggtttgagaagattgctggtgcaacgacttcaaaggaggtgtgggacatacttgcaaatgtctacaagggtgccgatcgagtcagacaggttcgacttcaaactctccgtggagagttggaaggaatgaaaatgaaggaaggagaaggggtatccggtttcatcacccgggtccagaccgtggtaaatcaactaaacagaaatggagaggtgttgtccgattccagagtggtggagaaaattctgaggtctctcactgacgacttcgagaatgttgtatgtgcgattgaggagtcaaaggacctagcaacgctcaccgttgacgaacttgctggttccttggaggcgtatgaacaaagaaagaaaaagaagaaagaagagtcactagagcaagcactccagacaaaagcttcaatcaaggacgaaaaggtactctattctcaaaacttccgaggaagaggacgtggctatggaggtcgaggagatggtctaggtagtaaaggccgcggtcaagaaggaaggaataaggagtatgctgaatcaagtcggcagaattggcgaggccgaggtcgtggaagaggccgacattcaaatcaatcaaatgtagaatgttttaaatgcggaaagtatggacattactcgagagattgcaactcggacagatgttacaattgtggtcgagtcggacattttgcgaaggattgtcgagatgaaagaagaaatgaaacttcaaaccttgttacagaaggagaagtaagagatggaggaattctgatgatgactagaagtgaagtcaaccagggatccgagatggaatggtatctagacactggtgcaagcaatcatatgtgtgggcataaacatttgttcagtaatctgagacaaatagatgctggacatgtttcgtttggagatgcttcaaaggttgatgcaaaggccgaggtacgatttgtttcttatagaaagatggacgaattgtgcgcatccgagatgtctattacgtgcccgatctaaaaagtaatattcttagggtggaagagaggattcaaaattctagaaaagggtggagaggattcttgtttgtgtctccagcattaggctgttgagagagcgtctccgagaggttgagagcaagttgagagcgtttccaccattgttgttggtgaggttgagtgtctccggctgaaggccgttgagagtgattgtaaccattattattgagaatagtggattgttctagactaggtcccgtgggttttccttttgaaggttttctcccacataaagctattgttggttgagtctggtgactccccagtgtttgtggttggttgaggtgttgctcccaacagagaaggagattgtgtgtttaatcccatcaaagtaagacagtccaaccgagatccgtgtagataataagtcagcaatcgagttagctaagaacctggtcaatcacgaaaggagcaagcatattgacgtcagatttcacttcatccgagatcaagtaaaaggaaagaaggtggaattacttcatgtggcaagccgagatcaagtcggagatgttttcacgaagccattaccgacattactgctggaaaattgtaagatgttggggatgaaagacggaagaaatatttaaagtttatagggggattttgttggattaaactttaataatagtaaattagaaatgtgaagagtcatatccctaggagaagaagttactcatgtgaaaagtcatgtctgtaggagaagaaattactcatgtgaagagtcatgtctttaggagaagaagttactcatgtgaagagtcatgtctttaagtttcttataaatagcatctcatgtaaaatgccaaaagtgtggcttggcagacaattatctaaatacatcagaagtattctaccaaagagattgttgtgtgtttgtgcgagtgcaccagtgtgtgtgtgaggacctgtgataccacatccaaacccgtggaaactatgcagagttacccaagtagaaaatgccaaaatcattctaagcatgctcccaatattatgctgctcaatcataatgaccctttgcttagcacaactccaaaccttctctattcaacaaggctcaaccatgaacaccaggatcgccaagcattttaacatcccacctgcatctataccaatcatcccagttgccttcttaattgttttcgtccctttctatgatcgcgtttgtgttccttttctacgtaaattcaccggtactcccaccggcattacacacttgcaacgcataggagtaggcctaatactctcttccatctccatggaagttgcagcaatcatagaggtcaaaagaaaaggagttgctagagacaacaacatgcttgattccttgccagtattacagccattgccaattagtatatcctggatttcttttcagtattttgtatttggcatagctgacatgtttacctacgtggggcttcttgagtttttctattcagaggcaccaaaaagccttaaatccacagcaacatgctttctctggtgtgctatggcccttggctattttctaagttccataatggtgacaattgtgaatagtgcaaccaagaatattactgcaagtggaggttggttagaagggaacaatatcaacagaaaccatctgaacttgttctacttactcctttccatattgagcttgatcaacttctttgtctatttgttcgtttcaaagaggtacaactacaggcctcaacaccctacagttactggtggcaattcagatcgaggaagtgaatattgggagataaaggtttagcttaatatgattaatatggaacagtgaagatttagtgggtacgttgtacttttcttcgtttgtcaaaaatgtatgtgagtaaatagatagaggactgcacctttaattattttccttgtaatgtcttgagttaattagagctatagtttccaagaaatccatgtgaagtttttattttacctctgcctttggttacatttgatttctattttcacttttgctagaaatttttaaaattcattaaaagttgtattttaaaaccaataataattgtacaattaaatataaaatagttattttgaaaatcaatacattagaatttaataagattaacttatcctaaatagaaaaggactcatatatctaattaatgtcttaaagatttttttggattaatatgtagtgtaaagttcatttgtataggttatgtgtgatttattaatgaagatctccctaatgttttatccattgttttcctaaaatcttttttttttttttgacaaaacctaacatctatttgatcataattttgatccatgattaattgattaaagcttattaacctatttttaaggtttaaatatagttattaattcctcaattttttttgaaaagttactttttattcaattgattcacggtttcataatttataatgatttttaatcaccaaaatttatttttaaaattttttaaaaataattttgacaattttaaaccgacaaaatatttaactctatgatttgatggtcattgtttacacattgtgttagttttgaagaaaaagatagatataaaattgtcataatttttaacaaattaagagtgttttaaactatcataaatcattttaaaaaattatgacagtgacaaattgtgaggtattcaaatagaacttcagttttgcaatattagagtattataattatgacagcgacaagttccggagggagaacggaaagagactttttggaatgaccgaagcaaaaacagaagcggctatatatgcagaatcccttcatcgtgcaagcaaaagatattgcttcgtctgagccaagtaaaccagtactgttacacaagaaatgatagttgaaacttgaaagtactgaaaaacctaaatgtgtatcaataatatgatgccaaaataaaaacatcatctaaataccaaggatcagacaaaagggcaaataacatgttgcaccccaatggtcagctttgttcataataataaataaataaataacaacttttcaagtcagtaagtagaacatctaatttaaaagctaaaacacgtaaaaaaattctataggcgttagggttcacaactgtacagaaaatcatacaaagtgtcgtgagagcagcaaaggaaccaaaagcttagaagattttatttccgtgttttttgaccgaattgaccttagaagtagagacgggatattttcagtcgctgatgaacaaatatttgtcaattgcaatttgagtagttctttcattaaatagttctaacagattttattttatttaaaattttgtttgattgtgaggtattaaaatagaacttcagttttgcaatattatagtattgtaattctgcatatgaataagttttggccataacatatttatttttcattattgtatcccctgtatcattcttacttgcaattagcacatttaagggttcaactcttattataactcaccaattttgaatgttcaacataatttgtccgactaattaaaaaagatataatttatccgtacattacacggaaaatcgtattaatttatcttaaatttatattttttttccaaattatcatgataattaatgttcctttttcttttttaattgcttgacaacacattctctcttattttaattagcaatattctattataaaaataattaatataagaaatattataaattaaatcttataaaaataaacattattttaaatttagatcttctaaataaaaatataagtatttaaaaatattgtgtataaataaagtatacaagttgttatttgattatctttaattgatggtcaagaggattctcttggttaaaaaagacacatatttgatggtaaattttaaattgggatcttagaccactttttgatggatcagtgagaagctttttgttcgagttgactgtgtgattgtggttttatttatgacaacaggaaattttttcctattagatcactttttgatggaccccatagcgccacttagtattgaaaatcttttaagataatgagatcttaaataattttaatgagtctcacatggactccactttaaatatttaaaaatttattaaattaattaaataattaattttaattaataaaatatgaaaaaaaatataaatattaataaaatatgtaattaattttaacttttaattttattttatttatttttttcttcttttggtcctatcatataaaaaaatcatttttttttaatttcatgcatatcttcaatgtttttgtgaagatctggatctatggatctatacgtgaagatcttattttcttctttagggtaatctcccaaagttgctcttattgtaaactctctcccattatcgtcagttctgatgaattaaaaaatctttaattgatcatggtatattgacgtcttaagtgaggagtgggagagaatagagtatatacccggaatatgccttatgccacatcacatggttcgatccaagcataactaaccaacacagtcgattccaaatcctaatcctaatcctaatcaatctggttccagtttgagttgcgattatggcaagccaggcggtgtattcggtgtgggcgattccaccggaagacgtgggcgccagatgcgccaacctcatgaccgccctccgatccgagttcggtgggccccacttccacccccatatcaccgtcgtcggagccatcaaactcaccccggaagacgccgtgaccaagctccgatcggcgtgccaagccctgaggcccttccacgtcaccgtggaccgcgtggccgccggcagcttcttctaccagtgcgtgtatctcctactccgccccgagcctcacctcctcgaaaccagcgcacattgctgcacccacttcggttacaccaattccactcgttagtgactttctctttctttaattaattattcttcgttttcgaaagaaactttagttcgcgaatgttgatgattgattcctttgcagcttacatgccacacttgagtcttctatacggagatttgagcgatgaagagaagcggaaggcgcaagagagggctaatgctatcgatgacacgctcgctggcttgacctttcagattacgcgccttgccttatacaaaacggacactgaggacaaaacgctcaaatcttgggagaaaattgctgaatgcactctcactccaaattagtagcttcttaacttcaatattagcaaaatccacaactctgataaagtttttggttttctacactctctagctgtcttcttagtctttctgagtgctactgctatgtgcttactgcttaccaatttccaaactcatatacataatgatgtcaaataataaggcactagtacttcttgttgtttctactttttttaggcccataattatgaaggcattattaatctgcataagttttgctgtgggtaaaagattgttagacacccttggaatgtagacatcaacatagcgattggaagagagaagagatgagtaattgttatgattagtgatgtgatttgataagaagtattaaagggtagtgccaatcagtggcgaatccagaaaaaattatttatgtcggcacgcacacttagtggcaagagtttgaggtgtctctgaaattttttttttaaataaaatttaattaggtccagaatgggtagtaaatgatccgcattatggtaaaacacaaaacgaaaagaacaaatgcaatgctagctattgtttccaggatccatgaattttgcaatttcattaacaaggttacggaaaagattcaaaggaatgtggtcacggcctcagaggaccaaggtcatggttcatgcattttggaatttaaaaaagtacccaatatgtataaaaatctcataatagaatttgcaaattgagtatttgcaaattttcagcgtccaaatgactattttgttgtaacaacactattgacaattagaattatggcagttacatacatacagtaagttttgttgtggcaagagaaatgcttgcaacaaaatctcttgtactctagtttcaacctagtattttctaatggctcaaattcatgtaagtctcattaaatatatacatctcatttctcatttggtaggtctcatcctcaagctaatcacactaagttataacaatatacgtgcatactgcagctctgtacagttgtgtaatcaaatattgttatactagtttgattatatatatgccaagagccttaatacaagtagcaacactaggtctctttaggtattgcttcatgcaccaaagccgcttttgcttcactagagctttctttatccttaaaataccccaaggagggcagggctaatagaagagtaaaaggtttccatgagatatatttgtttgaaaaaaaaataaacaaaactattagacctgtattataccagaagtctccgttgtggaaggtggtagtatggattagataaagatgttgtcacagcggaacaacagagcagttgcaatgatgttggatggggcaaagctccatgtggttcaatcaggtttatggttcctaaaataacctcaccagtccattaaaaccaggatgccatgaataagaactgtacactgtttcttatgcacgagccgaagcaaaaaagaaaaaagaaaaaaaaaaactgttaatctcaaagaacagaatatatattctttttaagtacttaatcaacacttaccatgttttttcatctcttttctcttatcacatcatataacctataatacttatatatattttttttctcttttttttttctctctctccctaggtgtcatataacatattgaatgtttatagattattttccaatctcagaatatcccatttggcatatggcgacaattcttgtttctgttttgtttatatatctgtcgagttctaaatataaccaatcttctataaagtttaaactaatttgacataaaacattttttagatatttcttccttttttttctttgaccaattaatttaaatatcaacagaatcttcaaaattcaattcgtcaatcacgtggggtgtagcagtgtggcacgttacttgaactgtcattattgtgatgattaacacaatcgataatttcgttatccccacatctttcatatacaaaaaaaatgacaacatgatgattaataactgcggctaccgtaatttaaactctttattagttaactgctaaaccaagcccaaatgcccaatcactgaaatcaacattgatgacttatgtagacctaaaacagcatagttagcaaacggacagtaagaagggaataaatggttaaacagatcaaacttatattagtagtacaattttccatatcaccaaaagaaaaagtagtaaaattttccaattaaaatcaatattacatctggtttcacgcttccatttttggttactagatgaaattagcaattactaagatgacataataattttgattggagaaccactataataatacttaatgggtactattactacatttaaaatttgtactaattaatcaattctaccgtatgaactataattgcggagtgttggggtgttggtggtgctttctcggcttttttacacaaatgagtaaatttaaaataaaaaaaacactgtagattttgaaaatattacgggtatgagcaagtcgtgttttaaaacactatttcatctagagaaagacgtattttaaaataagactttaaaaactcactttttttaaaataaaaaaataatgaaatcacgttaacaactttagtattttttttcttttttaaatattgaagttgtttattaaatcacaaatttaatctttttttttcttttttctttcttttaaaaaatattgaagtcgattgttaaatcatgactttagttttttttttctttttttttttttaatttgaaatatgtaagtggtgtttattttttatgccataggtattggtgttgtgtatggaatatattatgcgtataattgtatattatttttattatttataagtgtgataattatttaatgagtatatttaatttgttgaaatattaattattttttaaaatagtagtaatataaaaatagaaaattagtcatagaaatgtaataaaaattaacatgaaatatattataaatacatggaaaataaaataattattgggaggatgtcccatatgttagtcttttcatcaattgttgttgacttaatatttcaaatataaaaaaaataaaaagaaagactaaagtcatgataacaaataatttcaatattataaacttttttttactaaagtcatgatttaacaaacgactttaatattttttttaaaaaaaaagactaaattcatgattataatcacgacttttatattttttaaaaataaaataatacttgaaatcatcttttaaaatacgattttagtatttttttaattcaattttctaagattgtattttaaaacatgactttctttatataaaatcatattttaaaatacgacttataatattttcaaaatttatcattcctgtaattttttaaaaataaattaccgatttatgtaaaaaaaagcctgctttctcggtgtccatggaccatggctaatatataaggggtggaacttaatacaccagcaaaaaggctaatacacccagactttttttaaaatggcaattctacccttcgttggttataacaaaagctgaggaccttctcttgctgccattaacgagttgaagcttccgttgagtgcattgtgagtgggaggtgttggttgtggtcgtttaagctggtggtggttgcctttgacgctgttgggttggtcggagtgacagacggtggtggagcaactgtcggtgaaggtaagttgcgtttttttgcatttacggattagctaatccgtataagatctacggattagtaaatccgcacatattgtaggctttgtgtgatccgtatggaccatacggattgtatgatccgtatggaccatacggattgattaatccgtacgattaatacggattgatcaatccgtatggtccatacggatcatacaatccgtatggtatgtacggattgatcaatccgtattattaatacggattgatcaatccgtatatgccatacggattgtatgatccgtatgttgaaaaaaatggaaattaattattaaaatgtgattttaattattaaaaattgtgttcttaatctacgatatctgttcgtgttgtgatttatgtcagtttgttgtcatttgtgaagatgaacgacgatgagtggatgtatgatgctataatgtccgaagaaattgacatgaatgaagatatcggagataaaccgagtgcatttgaaaaagctgattgttcagtcgattgctctgcagcattcaatacttgtgaggtatgtctattatttataaatttgttactgtttattaacaagtgatttatggaacttaatcgtcattattattgatttgtgtaggtgtttacttctcgtgatgaactattaaaatgggctagaagggttgcgtatgagaatggttttgtagccgtgataatgaggtcggacatacatactggaaagaagggaagaacttcatttgttttgattggttgtgagagaagtggaaagtatagagcgttcaataaaaacatggtgcccacagtgactagcacgagaaaatgcaattgtccgtttagattgaaagcgaaaccagtaccggaaggtgaagggtggatggtgaaattattatgtggcactcataatcatggtttggcaaactcattatgtggacatccgtatgctggtcgactgacagaggaagagaaggttgtagtgcatgatatgacacgatcgatggtgaagcctaagaatattctccttactttgaaagagcataatccgaataattgtacatccttgaagcaagtaatgaatgcacgatatacatatcgtacccgtatcagagaaggtaatagtgaattgcaacacttgatgaagcttctaggacgagatatgtacattcattggcatagagtgaaggatgaaaatgtcattcgtgacctgttttggacccatccagatgcagtgaagttgacaaatgcatataatgttgttttcctggtagacagcacatacaaaacaaacaggtacagacttccgttattggacattgttggtgtcatcctactggcatcacgttctcagctgcgtttgctttattagaagctgaacgtgtagacaatgttgtttgggccctagaacgttttagaggcatgtttattaaaactgaatttttcccaaaagtcattgtcactgatagagatttagcattgatgagtgcaattacaactgtgttccctatgtctaccaatttactttgtcggttccacattggaaaaaatgtgaaggcaaaatgtaaaacttttatccgacagagtaacgcatgggactatgtgatggaagcctgggaaagtcttgtggactgtggtaatgagaatgaatttggtgattgtatggcaaagtttgacattgcgtgttctccatggcctgcgtttgttgattacgtgaaaaccacatggctcaatccacacaaagaaaaatttgttacagcgtggaccaaacaatttatgcatttgggtaacacaacaactaacaggttagcaaatctttaagttttgtaaagttattgcttttatattgtggttgtaggggatagtttgtgactgttaccattggattgcagggtcgagtcagcacattcgacattaaagaggctattgcagaatagcctaggcgacctctgtagtgtatgggatgcaatgcacaacatgctgaccttgcaacatactgagattagggcatcattggagagaagcacacatgtggtgggtcatgtgtttaaagtaacactgtataaacgactgattggaatggtgtccaggtatgctttaaaccaattagctgctgagtatgagcgagtaccttacgcaggcaaaagcaaaaaacgttgtggatgtgttatgagaactacgcatggactgccttgtgcatgtgagctagctaagtatgttcttgggtccatacctattgatgctgttgatttgttttggcggaggttaagttttgaagatcaaggtgtggatgagggccaggtggacataagtggagagatggaagccatatctatgcgttttaataaccttgatttttgtgggaaggtcactttaaagtcaaaacttagagaaattgcatatcctgacaaaaactcaatgcgtcctccgcctgaaaaagtgaaaacaaaaggtgcgcaaaagagacaagtttcgcaacacgcgaggtcaaccaagcgggatccatcttactgggagcatgtggacgaattacattctgttcagaatagttgttcgacaccaaaacatcctgcaacatcttcggctgatgacagccatacaaagacgaggcctccgatgctggatcagtttcatacattcatgcatgatttcattgtggacattattgatgttaaagctgatggtaactgtggatttcgtgttattgcggctttactaggttacggtgaagagtcatggtctctggttcgcaatcatttgcttaaagaactttcacaatggtctggtgaatacatagcattgtttggtggctttgacagatttgagcaattgaaacggtccctacttgttgatgggttgtcaaaggtaactactatgttactatgtttgtacgtatacgttaacctaacttattatatttacagttaagtggttttcatgtcaggttacaattgataagtggatggatatcaccgatctggggtacgtcattgcatcacggtataaccttgttcttgtttctctgtctctcaaacaaagcatgacgttctttcctttaagaagccaaccacctgcagatgtcaatgttcatcgggtaatttgtattggacatgtgtttggaaatcattttgttcaggtataagttgttgaacgtagtttatcgccaaaagactcttaacaaatataataataaataagtttatgatggttattgtttcaggttgcattgaaagctggatgtcctattccgccacctgcgttgttatggtcaaggaattgttacaatgttgcaaatcaatggatagttccttaccaatatagaatagaagcttatagacaacttcagcatatccgtacggattatgttgacttacgactttagttaatattgtaatattgaagttgatattgttgacaaattatgaatcttgtttaatgatgtacttggatggtattgttgacaaattataagcgtgttttcatgacaagcgataactcaaaagaaacataatattataatgttaagtgaacaacaatgtcgaagtacatgaagtacaatgtccaactaaaataaagttcacatatggtgaagtacaataacaagtacgataaatataataataaataaaatgcatccaaaagcatctctactgctgcctctgcctggtccgtctctgtcgctgatagacacatcgttcatcggtcacggaacgagatatacgtagtaggcgctcagtagcggcataggcatcagtcccacgtgtaaccatgcgtaggtctatcatctcctgtaagccgcgcgctatcctatcgaatgtagcctgaacaaatgtcaaaataataacggttaccattctaacagtacatatatttcaaaacaaacatttcaacaatgctgcacataccaatgcatggcgaggtacgtcggatataggtggatctgcctctgggtcatcagtagcagcatgcggagggtcctcaacaatgtgtgactctggtgccgggtgcctaacaggatcaccaacctcaacgggtctcatatatggatgcgatacgcggaaaaaccagtccatgtaacccaccactgtctgactagcatgacaggcaacctcagtggtggatgctaagtgatccccaaactgtatccatgcctcgtcaatctcatctgtggatggcacgtctactaagtgcatgtctggaatatcctgaacatacccgtactgcctcaggaccctgcccggaagatgtctgacaatgaccggtccgcagcgaatatgaccagagaagagggaaatgatgtcgaagtctctatgtggacgatgatcgacataaggagtccaacaaacatcctccatgaccaacctatctagtcgtctacgataggtggtcataggtaatgcctgggcaggcttccaccgacaggctcgtggttgggactcctgataatcctgaacagcagtgacatttcccacagtggggaaatgttcatagatccaacactagaagccaacataccaacattagtttgttatcagcagaagcagaaaacataactacatatattaaacacaatgacaacagtcaaaccattacctgaagtaaggtgatataaccagcaagatgcttgccgtggtgctgacatgcataactgaggttagcatacatgtgaacaagtgctgccacaccccaagcatatcctcctgcgtcctctaaatcacgaaaggcctccaagaacaccacactgatatgtgtagcgctcttgttggcaaacagcgtgcacccaacaagatgaagtaagtaggctctggctgctacaatccagctcctctcctcgcacttcactgcatagatgtctcgcagccaagacaaacgcacatatgccccatggcattgctgcatctcagctccagcatcttcaggggtgacgttcaacaagtcaacaagcaagtgaacgccctgtccaacgtcgatcgtgtcgtacgacaacaaatgtccctcaatggggatatgcaacagcgacgccacgtcatccaaggtgatactcagctcccccacaggtagatgaaagctgctcgtctcagggtgccacctctccacaaaagccgacagcaaacccctgtcacctgtctcgactgagcatgcaatcaacggggctaagccggtaccagccaccagtccttctatctcgagtgcaggccgcccaaatttatgaacctttcttccgtgggatgccaatttcaactcaggacgttcctacaatcattttacatcactgtcagtcttgtacttcaaaaatcaaaccaaatacaataataaaataagtacctgtccttcccacactcgcagagcgacgtgatcagcatactgtgtcaaaactgacgtgtcctgtggaccacctggataaccttcgaattcatcacctcccccctctgtggaagggatatcaggctccacatgttggtcctcaagaccaccaccgtcatccaaaccagcccccaaatgcaagtctcgagccggagggtcaacaacagctgccggagggtcaacaacagctgcccctggcctttgtcttctgacagatgccgtgggcctacgacgctgaggggctgcatcttcattcccactgttctctctaccagatcctctgtctacaccacgacctaaggcccgatgtcctcctcgtgttctagccataatctggtatacaacaataacaatatggaattcagctctcagtcaaatacaaagatatcaaatataatgggtgataacaatatcatcaccattaagctgtaaaaacacaatcaacaaaacaacgacaaagccaaccatcatcacaaccacttcattgatgaaatcatctatataattaccaaagccaaccatataaggcacagctaataacaatattatcacacataggttggtcaaacgataatgaacacacaaaccaatcacagacctaaccatcatcaccactaccaaaggcaacacaaccatcatgaccattaaccaaaatacgatcattcatgcaccatttactctcctatctaactcccttcccatgatatacttgtgatcatcactaccaaaggcaactaaagtgatatactagcataacaccaataaggcacaactaataattcatgcaaccatgttgaccactaccaaaacatattgcctttatatatgctacacatacaataagaatgtgccttttgtgcagtccatgttttcatattgaatataatgtatgggccacaattcaaatttctatcaatcccacaatgactattaacatcaatactacaacgtgtaatcatctaatctaagtcaaataagtttcctagcaactcaaatatgtacaataaccaataaaagacacttcacttaatcataaaatcacagataatacaattctaacactgcacggatcagttaatccgtatcaggaatacggattagccaatccgtgaaattcatacggatcagttaatccgtaaacacttcacggattggctaatccgtatgcctgatacggattaactaatccgtacagtgtttacggattagacaatccgtgaagttcatacggattaactgatccttatgaacttcacggattgcctaatccgtaaacactgtacggattagttaatccgtatcaggcaaacggattagccaatccgtgcgatacccaacagtccccgatagttgctacatacctcgcgcggcggccggaacagataaccacctccctcagtcgacgaacaaccaccaatgtaggcttacacgcgtcggaactgatgaaaccaatgacgagcacagccaacctcaacgaaatcgcaacagagcagggtgtatgcgcagaatccgtaaagccttcaatggtaacagtggtaatgaagggtttaacactagggacatttaaggaaattcactgtgcattttaaaaaaagtctgggtgtattagcctttttgctggtgtattaagttccacccatatataagtaacatgtgcttgatatgtaacggcctttcaatgctatgtttaacatgttttgtgccacaatgagtgatgaggtacaatccatgaatagaccaaactgtacccactaggcaatttcacttgctatgtccaatcaagtgaaatatgtgggagctgcatgcctagttggggcgtggatggatggtaaactcaggttgggataagctaccttctgtaacaatgcacaaaaaaggaattaaatcaaatagccaagatcaaatcaactattgttagaaatgactccatttgtcgtatcactcgattttagcacacaaaattattcttccattgaataaaattaggatgaaacaatccatcctaatcaacgttcaggaattaacgctgtgttcgatttgcaagacagaaataagagacaaacaacggtaatggggactgagtttggttggcatgattttggagagagagtaaagttataatttgtggggtttatagcttaaaatttccgtctttggaataggggtagcactaagtgggagtttaaaattttcggtaaaaagataatagtaacctttaaaaatcaattgtttatgcaaaaaaaaataaatagattttcttttttggctatcatacccatatgtgataaaatgggatatccgacccaattccggtctaatgtgagatatgggctataatgggtcgaacaaaaaaaatttgaatttaatttaagcttaaataacgaaacttaagttttgtgaaaggctgatttttgtggactcagcctgcattaaactatgattgatttgatataaaatttacatttaatttgaactaaaaaaattaaactcaaattctagattttagaagatggatttggacggctagcccaatccatttttgtcacctttactcatccctactcatataaacacaataatatttttgtctctatttaattctttctttcccatatatatcaaactcctttacaatattatttttactctatttctcacatatttttcttaaaccagactaccaaacatatatcttcatttctctttttttttttttaaattatctattttctattttcatcaattatatttctctcttctaaatcaaatacaacctaagagatgaaattgtattgtaaaccattacagtactgtttcgcacatagataatcaaattgaaattatctactaacatttatgtctagcataaaaaacattcatatttgtttatatgagacgaatatacattcttgaaaataaggtttgatttattttagattttaacaacaaacgatgttgttgctcataaagaagaagaaaattgttaattttacgagactttttaaaaattctttgagattttaaatatggatagtaattgtcattctgcataagcttatcaaggtatgttaaaatacaaaactaaaattggagcatgcatataaaataaagtatgaaacaaaaaaatgaaaatgaaaattttaattttaattaaataaattgaaagtgtaatatctaatcataaattatgctataattaagaattattaattttataataactactataaaagtcttatttaaaaatgagtttttattagttaacggtgtattataactaaattatttaaaattttaaatatgtataataattgtcgttgtgtaaaaacttgtcaaaatatgtttattttatacaataacaagaatatgaggattaaatcctcagctatttatcctaaccctcgtcactaacccagtggattactttacttatcaaagtatgttaaggataaaaaaaaaatgattttacttagatcatgcaaataatatcagtataatgaataagggtgacctacattacttgtcagcaaacaagaagcagcagaagaaggaggtgagtagatgaattaaatcaggttgtcacattcacatggcagttgcattgccttcaacttttgggtcaccgcatagaggtacaatgtgctgtcaatgacaatgaggacgaaagatgtccaacagtataactaatacaaattccaagattaaacatacatatttaaagagaggtttaatatggtagtcattgtaaatattagtagaagatagaaccttcaaaaaggactaaaagaatgaaaccgcgttgttcatgattgtcagtttgttagaaaagttaatacgatacttggaattaagaatgagaattgtttgaagcccttgtatgtagaatacccaaaatggaaaatttggaacatgatgcattaaatatgtgtagaagttaaaggaaatttatacttggaagaacacgcctattttcattttctatctttttttcccactctaatttgtaattataaaaaacgccttatttttcttttgttccctatttttaaaaccttatataattgtttctcataatttattttaaaaacaaaaaattaatatttttgtaactaattacattaatggtataaatcgcaactatgtatccagaattcaaactctagagttttgattatgttgaataatttcaggttaattaataattgttcaaaaggtttatttcacaattgtaaataatgttaaataaaacaaaagtaaaaaaaaaaatttagagaataataattgtgtatatttttttcaataggaatagtttatttataggtataaaatataattaagaaaattacaaaagataaatatatataaataaattaaagaaaaattataaaataatgaaatatatggacaatcacaaataaattattcataacactaatcaatataaatataacaataaatatcataaataattatctttgtttcctattttaaaattattaattaatatgtatataattatttagattgcatatactcaaaaatcatttgtaatattctaataatatttaacaaatggaattacctgaacatatattaacaaataaaatattaacaataacatattacattatcttaccagaattagatacacatataaaaataatataggcaagaataatcatgttaggatatcacataaaaattgagataaactaatatacacaaattgagattttaataaatagtaaaatgtcgcattcttcaagaatgaaaatttccttttttttcttgcactatttttccatttctagtgagaaagaatcaatcttttctattctcattcttcaagaattaattttttttccttttttattttttgtattgtttttccacttctagtggagagaaaaaaatcttcaatttttattttattttataaggtcttcaagactttttacaaaaatatttttagaatttctttatttaatagtgctttcaagacacattatgtctgaataaatttcatatttatgtaaataatataactatacacattatagttataaataatatgagttgggagatgagaatagtgttaccttgaaatgtgaattaaaaagaatatgacattctctaggataagatcaaattataataaaattcataggcctcaaccattgcaacattatttttctcacatggagtgagatcattattttttattttcacttttacattattttctcatttcggatgagaataatatcctaaaaaattccttcttgatagtatctttaagactctcaaatgatcaaattcacaattgcttaaatagaacccaaatattataccaaactcatagtatgaataacaaaattagagagagaaaaaatctagccttgaaatatgagtctaaaagaacaattttctccaatttttacatgattttttcttataagttacaataccaattgtcaataacccatggaagaaagacaatcatgtaaataaggtgttaaataaaatataattcaaataagagaaaaataaagaagaagcgaacacaagagtttaaagataatgatatatatatatatatatattctttctaataggagtaacatatttataagtacaaaaataattgaaaaattacataagataaatataaataaggaaagattataaaagacaatgaaagatatgaagaatcacaaatagattattcataacaaataatttattaaactttttttataaaaaaattcatttgacattgtgaaaaaaaacttttatacttacgtagtaaattaagacactagatatcaattaacaacatactatattattctttactttagatttttttttttaaaattaaactgaattttaagaggaaaaacaatgtttacacaacatactcattagttatggacaaggttaaattttttaaaaaactgtctgcaacaacaattacaatggccacatcaaaaattgagtcatatttgttcacaattttcacaatatcaagaaataatggccacaaaaccaccaccacaatttaaaacctcacacaagatacacgagagaaaagaggttccactgactgaatcatttcatggaatatctcttgttctaagtttccaacttcgctccacgtgtctttcaccccattaataattgtttccagatctctctctcatgccctacttccctcactagctagtgcatgaatttcttaaaagtaaaaaaaaaaaaatgttaacaaaattaaattaatttgattcacctcaagtgattcaataaataaaaacaaaagaaacaaagaaaagtgaataaaatatacacagatgcagatgagtgtgtgtatacatacacaatttgtttcatatatgcataaaccattatggaagaaagactgtttttcactttataaatacccatttttggtcactttgcttgcattttctgatatcttctgcctgatctgctaagtggacaaaagtgagaaaaatatatgcacactattcttctaagggctggaacttgctctcctgtcctgaatataacttctccattttgtttgctcaacaggttggtggagcaaaatactgaagcatcatctaaaatgccttctgaatggttcacctctttttggggtaaatttttcccttgaatccaagattttgcaacacatgaactagattgcaatttgcaaactagccattacaagcaaatgaaactttttgaagctaaatatatataaatagctaatgatttaaatgttggactaagttcttgaggggtgaagaggttgttccaagctttcattttcttctacatttcttttcagattcttccccaacctgacaaaaatagctgaaagatcaaaatttacttatgtgttttgtcaagaaatactttttgtgtgtgtgtgtgtgtgtgtgtgtgtgtgtgtgtttatacgaggacaataaaatgataagatcttctacttgattcagcttgattaagtccttgagggatattccaagcttccatttcctcttctttccttttcagattcttcacctgacaaaaatagctgaaagatcaaaatttacttatgtgttttgtcaagatatactttgtgtgtgtgtttatatgaggacaataaaatgatgtgatctttttacttgattcagcttaaaaacatggctcttccaaaccaatccatgtcatcagagtctccccagagaaagatgggaaggggtaagattgagatcaagaggattgagaacaccaccagtcgacaagttaccttctgcaagcgcagaaatggcttgctcaagaaggcatatgagttatctgtgctttgtgatgcagaggttgctctaattgtcttttcaaaccgtggccgcctctatgaatatgctaataacaggtacctgcttttcttcaatctcttcataaatattttgggaacattgaatttatataattttgctcatgcaaaaaaatcttctgaaggagttaagcacaaagagcctaattacttttgtgatgcagttagaatatggagttaatttttcctctttgttttctgtaatcacggttcccttgtctttttttttttttttttttttttgtctttaacactcatcaagaattgtttcttctattttggcctttttccttctatgagcttttaagctcattctcctcttttttcttcttctgtttatgaaaattattttcttagttcttgatttggtgggcacatagatctggtgtaccatatagacatagaagcactatggttgttaactagtagcaagaggaaaggatttggggatgttatgaaggtctgtgagatcagccaatccctagaactcataaactttctgtttcctttttcctctttcccttctctctctttctttactcatctaaaagctaaagctgtcatctttccattagcccaatttccttagtaacaaagccagttgattagacaaaaaagaaaaagaatgacagtacactttcaacaaattgtcaatgactgaatgagttaaactggaataaagaaacgagtaaaaaaaaataaaaatggatttttgtaacccatcacaacaagatcttctcagaaacattgacatttaaaaaaatcaaagtacactttcaacaaattgtcaatgactcaatgtgttaaactggcataaagaaacgagttaaaaaaaaataaaaatggctttttgtaacctatcacaataaattcttctcagaaacattgacatttgacacccacttgcaagatctcgcactgggttaaaaataaccttagaaattagggttttattagggactaatacatgagctgagcatagctaattagcaaagggagaagaaaaaagaaagaaaccgttttctcttctcagcatgaccagaaaatagtcaaagttaatctcttaatatttattgctcgttgattttccccattttaggaaatggagtttggcaactatggttagggctttaaggaaaataaagggtggctctagactaggattttcttttttgtcttggttggaagaatctttgaacacgtcacacgtgatttttcagttcttgacttttgaaaaaagagtttaaccaagtcatactcggaagatggaattggtatctctttaactcttgcatctgaaccctaaagttggatcttctacaacacccctcctatgggaaactctctcttcagcatagagtaaaaaaattcttttacatagtttggaaaacagcaaaagacaatgaaagagagtcatgaaacaatgagggtccaaaacgctgcatcatcataatttcactggtagcttttggagcctctgcatttgctcaagatcttgaactttacatatttgtgaaagttgtagtctgagaaagaaaaataagggttttttaagctgaatgagagagagagagagagagaggtaaatggggggcagggagccaatgagagagttctgagcattttggcttcttccatgcaaaggaaagtgtacaactactgcttttgcttgctgaaaatttgcagtagctgaaatgaacggctgtgatgtacacatactttaacacagaaaagactatttttttaaacaatatatggtatcagattcagtaaatgtgacttaaaaatcttgcacgaaatttagatggttagaaatcgaggtgagcaatgaggtgtggttgagagcattatccactgtgagatgcgtttccttgaagtggcagagaaaaaaataggtctagaaatggttgaaccaatcatattgtgggaacctgtgccaccgtggcagcagcagccaatcagtggctcgaggatattaaggtatcagttcattgcaatactgaaaaggttttcttcttttcttttcctttttcatccctaattttctattattattattatggaaactaaatcattttgttattttaagattttatttttatcacatctaatcagactttgactccagtcgaggtttctgaataatgagatcatgtgatgtttattacttttgtgaatttagttgcgtttgaggttcggttaactgaaccagttggatgatttgacattaatttcaaccttggacaagctctatggttaacctcaaattaatatggaacacagttgttcctttttaatttcttttatttttgtttctttttatttacgcacaaagtaagaaaccgagttaacttgaaagattcggatgaagacgttctagagactgaaatcaaatgtatcccttagagttagtgataaaatgataatactgattttaaaattagttgtttgcatttatagaatttaaagttattaatcagttgtgaatttctagaatttactaactacatttttattactagttatttacactttattattctattgcactataaactgtagaagatatgaatcctattaataaagctgacagcttcacgaaagagataaaataaacgaataaaggaatataaattcaaaagatgtgatatatataataattcattaataaagtttagcttatattataactttcattaataatgttatcctagtaatttatacactcaaaccaagagataaatgtagtttatgtgacaatattcctctttctcttcaaccgtgcaaggaaaattttcagatttccaattactaattaccctcaacagggttaaggatacaagattaaaaaaaaaaaaactggattgggtttatgcactttagaaggtaaagtgcacaaatcctaatcattcatattagtaaatgatttagataaacacaccttaattaaaattgccacatcaaatttttctttaacgaaataaaacttattaaattaaaatagaaaataaaaaaattattttggcttgcttcacctaatcatcttcattggttacacagaagaaaagcctccgatacaattgttacaaattgttcttcttaatctgcagctttatcttaaaatttcttactactcttaattggaattttttcttccaaccacttatccagcaatgtagaagccaataacggaagaaggaaaaaataaatcatttgcctaagagccaagtagcaaccagaaattagtagctatcaagaaaagaattagtacgagcctaaatagtggcccctctgtccagaagatgtccagcatgacctcattggtcgatgcaactagttttttttttttttttttttttcattttgtgataagcacatatggaatcaattgagagagagagaaatcacgttgaagacatggaggaaaaaaaattcagataaagcaagatttagaataacaatgccgcaacaattgtttttagggtttttgttcttttgtatatcatgaagatgatcaagtgaagcacacgagaatattttctatttttgtttaatgataaaaaatctatacggcaattttaagcaattttaattgaggtgtatcaatctaaatcatttattaatatgaatggttaggatttgtgcattttatcctctaaagtgcaacatgcactttagaggagtccaaccggggctagtcataactaaagctagtgcactgtttgatttagctaagattctcaaaaaatccttttataatcaattaagttgcaggggttaataataatcacaaggaacctaaagcctttaacataactatcctagttaggatgattacaaattttgtaagactaaggcagcctacaagttattaagattaaatatttgtttatcattcagaacttttttattttccaaaaaaatttgttactggagaaggagattgaatgctataccggaaatttggtcgtcaatcatgttctttgacttttgggttatgcttatataatcttgtaacaggacaacttgtgaatctatataaggtttttttataataagggtcatactcttgcagattattagataaaaaaataagtaattttctgtgcttatataatgttctttcacaataatcagaaaaagtcctttatcacttagatgatgccactgtcatatcacttagcacaatgaatataatttgtaaataatcttactgttattatagcgtcaaagcttcaattgagaggtacaagaaagcaagttcagattcatctactggtggacgatcagcttctgaggctaatgctcaggtattaattcattattccttctctacattttttcaagagaaactttatttgaaactaattaaacaatgatagatacattaagttaatatcatgcagaaaaggaatttgaatgtaattgcaatgaattataaactaacatttttaaccatgatttcaaatctcagttttacgagcaagaagctgccaaactgcgtgtgcaaataagcaatctgcagaatcacaataggcaagttgcattagtaaaaatttcactacaatatcgaagggaaaaaaaaaacatatgaagagatctcaagtattatttcaatatttagtaaaaatgttttgaatcgcagtcaaatgatgggtgagggtttgagcaacatgaatggcaaggatctcaaaaacctagagactaaattagaaaaaggaatcagcaaaattcgttccaagaaggtatttgtatttctagtaacaagaagtttctttctatgattttgaaagaataaagtatgcagatttactatgttgatctaattttatcctttcttcctttgtttgcatgtgctacttcccaaacacctacatcagaatgagctgctatttgcagaaattgagcacatgaagaagagggtaaatgttttccttgtattcttattttaatttctaaggtcatttttttttttttgcatttattatctaagtggcttccattacaatttaatcaagtttcttaagtttagcccaatggtctctagttaagatttcacaaatatctgtattagggctctacaattgtttttcatattctgtttaagtttcctcttggtcaaatttggagatttccaaagatggtagtgaggatatatagatcattccattgcatgagtactattcatgatagcttgagtagctcctagagcctaaagatgaatcatcttaaaaagatgccactcaataaggtctaaggcccccactcaataagatctagaaagaaaaatgaaaatttgtaaggattcaatcttgtgtataaaatataaatgtgaattgtagctgcaaatgttgtcacaaataaataaaacagaattagatcatataattattaatttgagtttggaattttttatttatacactttataatattatagactatagatatatttagtttaatttattttatactatttctacgcaaacatttttcaatattttcaagtagtttttcgagagaaaaaataaatttaatctgaatgttattaaacccctttaaataaataaaaacacaattgcgcaataaaatatcaattttaaagcaaatatgtgagacactgataactaaccatatcacaatattgtagacggtgcatgtaaagtttgacattttgtatatgatgaaactttggcttagactatatgttcatccttatccctaaataaatctatatataggtgcctataattttaatctgtgttttttttttggggagacggggtatacaaaatttcttctacagtgactttcaaagtatacatagtaactaatatgtacatttcacaggagatacacttgcacaatgacaaccagcttcttagagcaaaggtttgtcattctatcatcaatctacactctttataaatatatgacgtttgtattgtagtttcattatcaattttcttttttttgagtgtgtagatagcaggtgagaggagtcaccataatgttaacgggttgtctggaagcataagctatgaatcgatgcaatctcagtttgactctcgcggcttcttccaagtgactggattacaacctaataatcactatgtcggacaagacaacatgtcccttcaatatgtgtaagtttctcccttgctaggtttcacattcattctataacttgatatgtatttgtttttaattccttaatgttcaaatcactagttactacctattaacaaatctcataagagtcatcatagctttatatggtcatatcatagttccattgggaaagcagatatagaataaatgaagcaaatagttttatggatagatattaacttgtcctatgcataatatggtggaaaaaagggtaaaaaatgtgaagcacaagcccaaccaaggggtttagttgagtagtgttcgtctgagttcaatttctataaataaataaaaacacaaaaaaaaaaaattataacaaatgaatctttcaagatacaaagggacatgcttgtggacatagttgttcttcacacaaaagagtcaactacaattatgatttcagaaaatcccaatagtcatagcatgtcaattaaaaaaggtaataataggagaattgaacctctagtaaagatgattcgagaaagaaattgggatttgtataaatgaaggaaaaaaaacatatggctaaagaattgctttagttggctataaataaatgttttctcaacataaattgaaatttagtttcaataatagcttgagttagcacatatatacccgtaccatgacttgatttcgtaaaacaaagagaagagataatggggagtgaatgagtaaacaagtcctaatataaaatacaaaatatatacagaaccgaactaatttgcattgcaaaagttatgttttaatattcaagttattttgtccgttgacaggcatatttgtgtgtcccatggagacttgacttattgtatatttttaattaatgaacaaacataaatctaatgcttgttcttttatcttgtactctatcttgtgcagttgaagagtttaagcttaagaaggagaaagacttagatttcctattgtttgtatttgacgtctagtatgatatatagaaatgctaaagcctaggaagtatgcagaactcaatggagggaattcatttaagtattcccctcagtactatgttatgggctatttagtatgtatacatgtactctgagtacagagatttgcaccatgtcatattttgtcaacgtttgtatacttttcatatttctcctgtaataggcttctatatatgtctatttcatatttcacttactatgaattcaagatcttactcatacatgcacctgttcttgagtatgatttttttaggaagatcattgttatctgtgcaaagtatccaccacattttgaatatgattaatttaagatttaaatacattttagtctttgtcatttatcatttttttatttttttccttacaatttttttacttgttttgttttttagataattaacgcattaaacagtaaaaaaaatattatctaaaatgttataaaaacaaaaaataaaacaaacatttttgtagagactaaaaaaaattataagaacaaaatgcaaaaaaaataaattataagaactaaaaatatatttaagtacccaggctaatttccagcattgttaagcatatgcaagtgcatatcggcatccactgtaaattgcaatcttcgttgcttcaacatctacatactcagctctatgagaaagcttgaaaggaatgttgtgatcgacaaccataatgtttctttcctgttagtaaaaattgttccaagggcaaaagcattaacaaagtgagaaaataaaactggaaaaaaaaataaaagcactcaagtatctgcaatatcagtataatatgtattatgtgtatttgaatgctaattaatcaagtttgttagattaaaagttgatatatatatatatatatatatatatatatatatatatatgcgcaagggtaagtggttatggattcgagtccggaaacagtctttttgcatatggaagggtaaggttgcgtataatatccctcccccttatttgcgcataacatggatcctccggacaatagagtagtaatttttttatatatgcaaggataagactactacttataatatttctcctttttatctacgcgtaacgtggaacatacggataatgaagtatgtaatttatatatatatatatatatatattgtgggagagagagacgatctttgaactttttaaaatatataaaaacaatgacacgagctgatcaaaagggtcgtactgatatgcaagatggaaaggtggaatgttagacaagataaaagctcaaaatagacaagcagggtaagaagaatgattaaactcagtgagaagtgtcacatgaaaataagcgaattgagaaaggctactgtgagtgtgaccatcctacttagcttcactgcctgacaaagtcactttcctgatacagtagtaagcacttctctaacagcttgtttgagtattagagcctcacagaagtgttctaagcttcatgtggttatattcaaagcttataaataggattacaatcaattaaaacactgttgggcaagttgagaagccatagaacagttataaactgttttctgccactctgctcaaacaaactgagtagcatgaaacttttttcttgtgtagtgtatccctgctctgcagtaacttttgaccctttcctagagtgttttccagtgtagatatgatacacattcaacaacttatacaacaattcatgcaacattatttttttgcgtctatctctctccatcatcctatcatttatcatttattatatttcaaattcaatttttcctctctttttctctattggttgtacattttgttgtacaagtatcatttctcattgttttaattcagtctgtttgttgagctctatctttttttcactcttccattatttatttatacctttgacattgtgaccgttagggcaattgaatttcttaaaactcgttttcagactcagcttgatgattaaccaaatcatcactttagttaaattttttagaaggatactattttgcaggtgtttatttcaggtataattaggtttcaagtattgggttgctgtagcgaatacatctcattcttataggtctacaacctttatttatatcttaatcttggtgataaccggttataaccataaatccaaaaaactaacaattaacatttaccaaaaaaaaaacaataaatccaaaataaattaaacataattaatgcctatgcatgaataccactatatacaacaacagcacaaaaactaagaaagatactggatagttttcactttccttgagggtaagtggcccttggcaactctgatttctgtagattcttttttttttaaacttcaatttctgtgattagttagaaaagatctggaacaaattaactactattcaaactatcataaagaagttcttgatctgcaggaacaaaagtacaccaatacataatgacatgaaatagctatatataacaccacaatattgcaaatgaaattccaataattgattgcaattaatctccttcggctacaatatgattattataagttctagcaaaaatcaggtacatccttaaataaatatggttgtaagagtttccatcttcattttaacttaacaagatgacagatatccattgggtgcgccatggttggaatgggagcattataagcacttcttgcactgagttggttggccatctcagtaggatgaaatgcatcaaaaaatacgtgtaggtttctgttcttgcatggctcctcattagggatacactgcccattcggccccactttgcagcacataacagtttctgaaatccctacatggggccaccaacgaaagttaatatatttaataaacaacatatctatttgcttcaattttttaaaacgatatgatcataattgcattaacataatagtaaaaattgaagacatgcatgtgcatccttttggtcatagtttcaattatacaaattcaatttagccaatcttttgtggaaagtacaaagatacattatatatgcattttacaagctttctgctacgaggaaataacaaatacgttaaaaccattttagatgaataagtgtttgaatatatacaggcacagtaaattatacaaaatccatacttgctggtatatcatatacatcaattgaatcttagtactactataattttggctatgaaaagaagaagaaaaaaaaaattgttaccttgtaactttgaggcgtgtaatgagaccacagcactattaatgaagataaatttggcatcaggtaattctttattgaaacgatcaactactggtttaagcttatcattaaaaatgagtgctgctgtattttcctcgtcaacacatattgacccatttttcccatgaatagagatttcatgcggaatgcagcctataagccccaggcctatcaaaacaaacttccttgccccaagtgcgtgcaaatcctgcacatagaaacaacaaaagtagataacaaaccattaatttggtgcatcatgtatattataaatgttacttatattacgtctgatcctttttttaagaaacaagttttagtgtattttatactaaaacttgtttctgataatacctttttctagaatttgaagtaaaataatacctttaaattccttgcatattcttggacaagggccacagcatactgttcaggagaatacgttcgacttgatgggtaatgctccggtaagaagtagttgtttaagtagtcattgctgcctatattcacataatataagcacttatttaggtggtggtgtgcttggtcagggcctccaagtttctgagtgatttgggaaactatgactttatgattttgcaactgcaatcccaagctaatatcctcacccttcaattacaaattaagtaaagtaaggtttttgctccattagcatgaggataaattaaactccgcctatgtgtgtatgcatgcatggcctgtcccaagccaggataaaggaggagggttggcgtcaggagttgcgaaccggccataaaaaattagctattcttatgtgatgaacctttatgatatttcgttggggcgttcccttcatagcgacgcgttacatcggaccccggatgtatcgaaaaaagagctagggtcctcgccacaaggcaaggcgctacatcgaccccgggatgtagtgaaaaagatgctagggtccatgccgaaaggcaaggcgccaggtcttcacccggatttggtgacaagaaggcaagggtcccaacacgcagatgggcgagcgtggcgggcaaacacagcccaggggtttagaatgaaattgggaagctggaacataggaacattaacgggtaaactgagggagttagcagatgtttttgccagaaggaaagtgaatattgcttgcttgcaagaaactaagtgggttggagaaaaggccaaggaagtggagggcacaggttttaagttgtggtacacaggtaatatcaagagccgcaatggagttggaattatgatcgatagaagttacagagataaagtcgttgatgtaaaaaggaaaggcgataggattatgatggttaagcttgtagtcggggatcttatcgtaaatatcatcagtgtgtatgcacctcaagtgggattattatcagatgaaaagacccatttttgggaagacttggaagaggttctaagagggataccacgagaagagaagattttcctaggaggcgatctaaatgggcatgttggtaaaaacaatggaggttttgatagaattcatggtgggtttgggtatgggactagaaatgagactggagaagatgtcttgaacattgcactagcctatgatttgatgctagcgaacactttttttcggaaaagggagtctcatcttatcacgtatcatagtggccaaaatcgcagtcaaattgatttctttatggctagacgggaagatagatattcatgtattgactgtaaggtctatcctggagaatgtgtggcgacacaacataagttggttgttctagatgttaggttcaacaaagttcttaatttgaggaagaaggatcaaaatccaaggataagatggtggaagctaaaggaggagaaacaattagaatttatggaaaatatgttgcgtgaaggaccgtgggagtgtatcggagaaactaatgaaatttggaataagatggctgtatgtgttcataatgtgggaaggagggtgttaggtgaaagcaagggaaacagagtttttacaaaggaaacatggtggtggaatggagaggtgcaaaaggctattaaacagaagaaggaatgctttagatctttgcataaatgtcctaatgaggagaatttgcaaaaatttagagtagcgagaaaagatgcaaagaaagcagtgcgagaagctagaggaaaagtttttgatgatttgtataaaaatcttgggagcaaagatggggaaaaaggtatttataaacttgcaaagatgagagataagaagagtaaagatctcacccaagttagatgtatcaaggatgaaaatcaaaaacttttggtaagggatgaagatgtaagtgaaagatggttacactactttaacaatctttttaatggaaatggtgacaagagtgaggtggaattggaggacgtttctgatgatctgaatagaagatttgtgcgcagaattaatacatatgaggttaaagaggctttaaagaggatgaagaataataaagcgttaggacctgatgatgtccctattgaggtgtggaggggattgggagatgtggcaataaaatggttaaccaatctttttaataggattcttcaaacaaacaagatgcctgatgcttggaggaaaagtatgcttgtgcctatttacaaaaacaagggagatattcaaaattgttcaaactatagaggcatcaaacttatgagccatactatgaagttgtgggagagagttattgaacatcgtctaaggagggagaccaagatttcagtaaatcaatttggatttatgccaggaagatgtaccatggaagctattttcctgatgagacaattgatggaaaggtatagagaaaggaaaaaagacttacatatggtgttcatagatctcgagaaagcatatgatagagtcccacggaaagtcttatggtggactcttgagaagaaaaaggtagcattaaagtatattaatgcaatcaaagatatgtatgatggggctaccacatgtgtgaaagcttgtaatggaacatcaaggtatttccctatcacggtcggtgtccaccaaggttcagctcttagtccttatctctttgccttagtgatggatgaactaacgaaagatattcaagaagaagtgccgtggtgcatgctctttgcagatgatgtagtacttattgatgagaccaaagatggcgttaatagaaaattggaattgtggagaagcactttggagtctaaaggattcaaggtaagtaggagcaagacggagtatatgaagtgtgagttttcgaggattaaagacggtgagcaagacacagtgcatctgcttgggcaagaggtacccaagaaagacgtttttagatatttgggatcaatgttgcaaaaaggtggggagatcgatgaggatgtaagtcatagaattaaagcagggtggatgaaatggcggagtgcatcggggtttttgtgtgaccgcaagattcctattaagctaaaaggaaaattctatagaacagctgttagaccggcaatgctttatggagcggaatgctggccagcacataggcaacatgagcataaaatagaggtagcagaaatgaggatgttaaggtggatgtgcggatacacgaagatggataagataagaaatgaggatattcgacgaaaggtatcagtggtaccagtatgtgaaaagatgagagagcatagattgagatggtttgggcatgttatgagacgaccattagatgctcctgttagaacaagagtatgttaccaagagctagatacaaagagaggtagaggtcgaccaaaacttacctggggaaaggtagttaaacaagacctaatggagtgggatttagattggcggacggtatgtcttaggacggagtggagaaaagctataagtctgatggagggttaaaccctttagtagttctatgttccagttgtttcctgttttaattcttttcttcctcttttctcttctcctctcaccattcttttatatttaactctgtttctctcttttgctttattttcgatttatcattgggttcatctaccaccgaccccaattaatttgggttaaaggtgctgttgatgttgatgttaatgttgagcatgaggataaattaagtaatacatccatgatatattgtgtatatgaacctaatatcaatagctgattttctaataaaaaattgaaattactttacctttaaagtgagttttagcttgtgagttgttcaatttaaagaaatcagatccaattaagtaagtgaacatgtgatttgatttaatgcatgaaacaaatgacacatcacacaaatcatgacaaaatcacaaaggcatatatctcaaaaccaaattataggtaagatgtatatatataaattagatatatatagtaaaagagtttgaaatataccaaatgtaacccggtctcgttgcgaatccccgctgaaccggatgcataattcacgcctttgagtatgtctgaaccaccggtatttgcaaagggtgggataagattttccaatcccaaaagctcagctgcaataacataattttatattgaataaaatgaaattttaattaactgaaaactcatatatacatcaaaataacatgaaaacaaatcatattaatctatggaatttattctattcaagttatcaaacttaacgggacaaaatcattgtttgtcttattagaattgagtttggattcgttaacaaggattcaaattctagtgtttttatggaaaaaagaagagatctcttactaaaaataatttctgaagagatcaattatggataaaaccggtaaaacatcttttgcacctataatccaaaaaacttgatgtgacaaaattaaagatcacatgtctactttcattaaccgtgtctcaactctcaagctcttcaaatataactccagacaaaatagtcttgtccatgcccaattgcaaccatgtgaaagaaagatatacatgttgagaattgaattattactgattatatcaactgaagtacggccgttggtaaatcttccagtggggccaagtggaaaatcaatcccataaggcaagttattaactttggcatctgtatttagattgttgttgtttccactatcagataaagagtctccaaaaatgaaaagacaaggcacttggggcttcccaacaacacaataatgttgcatgtatgttgcactgaagaaaaaaatcaccactaaccataacttggtttcataatccatatcaaagaaaaatattaagagggcgaagttcagatccaaaatattaggggtccaaacacaagggtgactagataacatatatatatatatatatatatatatatataaatggagagagacgtgagagaaaggaaggtatgacccagtttaatttgtggagaaattcgttgaaataatttatctatgtgacacattgtaaggccatatgttgattttagtaagtgaatttcatgcacacactattagaaaatgactggagcctacatacggcagaaactagaatttcgccaagccatgagattgtaactatctcaagttttcaatttggacaaaatttaaatgaagttccttatgagtgatttttatttattttttttacttgtttaagaaatttggaggtaaaaggaggggaaaatgagggagggttaaaatcactaccttttaatttctatctccctctcaatgttggtagagtaggaaaatgatttataattttaagactgtgacttaaattattttaatattttattgtatccctttttttctctattatcatttattagatataactgcatatattatcggcttaaaaaaattgcatatattctctagattttttcttttcctatacgaactaaagaaagtgatctttcatgatcactaaatcaaattaaaaatgacctcttttttttcctcctcttttctctgttaaaatttctctcctccacctttactcccttgaactaaatacactatacatctttgtattaaattatgcagtttaataattcacacaaatatttatataaaattccatgatacatatatttattatttataaaaacatctacatgtcatcatttaaataataaaaaatacagtaataaagaatttaatttaaatcctggtttgtttgaaagaagtcaaatgaaagcaactataaataaacataaaacaaatttattcataaaaattaaaaataaatattagaagatttacgacactaacttttcttactcaaataaggaaatttgatcacttattagaataatatttcctacagttataattttttacaaaattttcacaaactgctcgaggtaaagtttgaatttaatagataccaaaaattgaatttaattacatgagttgtttcattaattaatttagattcaaccacttggcaaaacaagatacaaccactttttgaagttttagatttttgcccatttgttttgaagcatttgcttttctctgatacttctgctgctacttttgttatagattgcagctagttttctgttttgcttttattttttactagctcaattgattaaataagatatatgaattattataaatctttcattaattcttacgaataaaaaaatatacaacacttaactgtttgtattttctaatacaaaattacatataccgccggcagctcaatggtaattgtgtaaggcagtaatgctcaaagccacatagcatgccacgttaattctaggtcaataccatcgagctactacacctcttacaaaatttgagctactgtgttactcataaatataaatattgtaaatcttcacaggatcctaacacttggcattggaaaatggttttgggagcttccacaacagtcgacgttattgtgttaaaggcaattcggcgtcaattaatcgagccaccaatgaacatcctcatctccaacggctagtattttcaaagaaagaccaaatcagacttcataacgtccagcaaaatccaagctaaagagtatatttggtatgagaaaataaataatataaatgaaaataaaaagtggcaataagtgagaaataaaatgataataatttgagttgtttagttaaagaaaaatagaaaaaaaaaaattagtataaataaataaaaaataattcaaatgaatcgcaccattttaaaacttatcagtaagccgaatccaaactctgattgtatatctctagcaaaaataacgaaactctttgtatatataatttgtccattctccataaaaaaaatagttacttaaaaatagtaaaatacgtacgaactctgtttttttagtgatttactttgcatttttatttttaaagttcttattttaaattttaataaaagttgggtcaaatataggcacacgttttttataacgtgacatgtcgtttatattttaatttctttttaatttaaatttatttttcttaaattaaatataaatactctttataattttagttttcttatttgtatttttaaaattttatatacaatataaaacacacacacacacgtattacaatttatatgtttaaaaactatttttcttttcttgatgccgtgaattccatttttttaattaaagtaaaccttttaattttctactaagttaatttatactggaaatatatatatatatatataattataaattttacatgcattaacgatagccgtaaaatatataaaacccttgccaatttgacttctaagtttattttatcatcaattatttgtattaattttttaccagaaatgttaaagcaaagagtctgttgtgaaagttatcttaatcattttggaagaaacattcacaaggagaatcgatcagccaacaacatgctattattcactataattaaataagcaatcttccaaaactttaaaacaaattacacctgtacttgtgaacccatgaacatttagcatatatgaatatgtaagagaaagagagaaaacttaagactcttatgccttaaaaggagtaacacattcgaagaacattaaatatggtcgtggcacagcttaatagccactaccctctggaccatgttcattgttcagagatcatatctgagctaagctttggatatcaacagggtaagcatctgatgcagattgaacactgtaagctctctgagccacaacaacattgccagcttcagtaggatgaaaagcatcccaaaacaagtactctctcctgttttggcatggtgtttgcattggaagacatgtaatttgaccattgttccttcctaccccacagcacccagcatttgtaacactgaaacctgaagattgattcatgtcaacagaactttgtgagttcatattatttgatgctaaaaaaaagtgacaaaaatcatgactacaaaataaaatgcattggtttgaaaataattaccataggctgaggggttgcttataatatcttgaaagatgccataagagttaatgtagatgactcttgcatcaggcagctggttgttgaattggtcagtgagacctttcagtttgttgttgaatatttgatttgcagaattgatcttttccacacatgttttaccatctgggctgttttgggccaattcatttgggctgcaacctatttggcctattccaaacaacaccattttccttgctccataattgtacaaagactgaatgacaaacacaaacagtcaatatttcaatttgtggagctagctagcttttcaattttcaatttcattcctgactttattgtaattgaaaattaaatggctattttgaacactgcatgtttctactatattataatagaaaaattgaagatggtgaatatcaaatggtaaaagacagagagctaaagactaacttttagttgttcagtatatgcttgaataagaacatcagcatactcatctggtgagtactgcctgctgctggaatagaattgaggcatgaaatagttgttgaggtaatcattgctgcccaacccaattgagtatatgcacttgctcaagtaatttgcagctgagtcctcacttcccagtaaatttaccacttgagacaccgtgttttggtaattttgcacctgcccactaaaactaatacgccctccctacaaaacatatgaacaacttaagaacataaataccttaacaaatgaagattaaaaacagtgatgttgcatgaagcaaaaggaaactataaatgggtaccagttgctgcccagtttcctctctaattccagcagcagcagatgcataattgactcctttgagtatagcatcgccactagcatcagcatatggaggtatgtaatcatcgaatcccaaaagttcagctgttaaatttcaacagaaagttaaaacactagtgaaacatttctatgggtatatacttacaagaatcaattttatgttccagatctacttttctcttgttcttgtttgtttttaccaaatcagttcttctggtaagtaaccatctggcagtaattttttcctgtttctttctttatctgtaattctacaattctacctctttgtcaatgaaataaactacacaacactctagtcttaaattgcatattgaatgcggcaaacagatccatgtgaatggaatttaaggatcagtcacaagcctttatgaggggtatctaactcagagtagtgccaactctagtgtcaaaagtcttgctttttttcgatgacatctgcatgttactccttttttaattttttttatttcaccggtaaaaatattaatgcatcttaattataccctttccttctaggtggtgaacatttattgtctgattatagcataatacagcttgtcatccgatagaaaattatgcatgcatatattaagatgcttttagttgcagttaattgataggttcaaaaatagggaagaagaagaacggatcttagaaccattttgatgccattgactcactataactatgacttttacaatgatgaattgatgattattataagtgcatgcatgtgaatctagttttaagaccatgcaaagatgcaaacgagtatatatttcaactaaaatgccgacatgcaaagtttataagccaattaagcatgtgcaagctcaccaattgcatcaacagtggttttcccattggaaaaccttccagaaggtccatcagggaagtcaatcccataaggcaagtaatcagccctagccaaagattggagctggttgttgttcccattatcaaccaaagaatcaccaaaaatgaagtagcatggcacttgtggtgcaccttgaacaccactccacaaaccaagagaaacaacaacaatgagtgccaacatgcttattgtgagattcaaagctgccattggagcaagaaacggtgttgcttgtgaggaattgaagtgaataatctaggtagctaaggaagataggggcatgtgtgagtgattgaatgtggaaggtttgacacgagtataagtatatatagtagtagagagataaggctctatactagtagtagtctatagtgtagcttttacggttgggagtgttagttaggtgcattaaatggacgcggatataacgtgagattgaatgaaatggcttcattaccaattccactgtaccacccccaccatcaccggccgatctatgttggggtgagggtgggccactgcaccccctcatttcaataaaatcgttaatatctgtccaaaaatattatattttgcacttcttaattttatattttgtattctctaattttatttatttgaattttcttaccaattcacatgtaagattaagtaaatatattatcttattttaataaagtgcatatatttatcttaaaattttatattttgtaccttttatcttcgtgtttgaactcaacaatctcatatgataattattaattttttatttttttaaataaattgtcctcactgattcagagtcctagtttcgcccgtcctagtttcgccagtgagcccacctcattgattaaatctgatcactgatgttatccaactttaatgtagagttgcatcttgctgggatggaaatttggacattacaacgactggttaaaacacttaggtatgatacgacactttttatacttttgttttgagtttttccggaatgttaaagtttcgtttagtatgggaatttcaaaaattattttcaggaatttaacaagtctggaaattggttttcaactaagtttcttactggtttcaaaaattaagtttcttactgaaatttttctatgagaaagggtggaatcgaaattcaagacttatgcaaaacagaaaaggttttttttttccataattatgtctttcatttctgaaaatattttagacatactaaatatatacttataaattataacagtcttttagaattttcttactaaatattataattttcaagaaacatgattttttttagtttattacgtagtacataatattttagaaatactacatacatatataatattttggacatctatatacttgattttgccgtgttcaacagaacgagctccaccgcacgacgacctctatagatctagatgccacatcgtctccctatatgtatccatagcaaactcgccacaactgtccaaccatttgaagttcatgcccaagaaagaagagaaatataatagtattaacaagttaaaatatatatatatatatatatatatgtatgtataatcactactataaaactgtattttacgagtcaaatcatttcaaaaacctcttaaaataaaatgcagtgaaaattttgtaaataggagcgcacaaacgatgacggttttacgaaaaccgtcgtgatatgcgcgctcaatttactccttcgtcttcaacctaacacgcattcactcactcgccctcatcgtggttgccctcactcagctcgtgctcgtgctcatgccttccctcattgttgccgccgtcgaaggtgtcgccattgtccccaaagcgcttcctctatcttatcccttccttctctctctccctctccccaaatacctcctctctctatctccacgcgccgccgcaccttcgccatctgcgccgtatcccaaaacggcgccgaaaccgtccccgtacactacgacttcgacctcttcaccatcggcgccggcagtgacgacgtcctagccgctagcttcgctgccaactacggcgcttccatctacgagcttcctttctccattatctcctctaaaataaccgaaggcgtcggcgaaacgtgagtttctgattttcaatgtttttcaatttcgctttttattgaactagggtttataattgtgaaggctagtgaagcagagtttcgtgtttctgaagattggttaggtagggttcaggctaaccaagctttttcaacaagctcatttgtttgatatattctaacggatagcattctatcattggttttgcttattcttaatagttttcaatttaatagttccccacttcccctacatctcttttgctatgctaatagtcaattgttcaggaacctcattgaattgtaaatttatatatccatattaaagtaaagagctattatggtgaaagcacgttgttcccaacttctattttatttattttaacatgtcctgcatatcagaattggtttctgatataacgtaataacattattttatccatttagtttatctattgggaagggcttttggggtggtagtttgtatattatgtatatccctctaatcccatatatattttccaacttttctgcacttgataactcttgaaacaatgcttcgggtgtatgaaacacatgcccgactggcactggaatttggggacctgtttgagtataatcaggtttgttctgtatattttttgaagaaaagagacttttatgttttagttcattttagtctttgattacttttttgtacttgtttttgcttgttatgcttctgtttcttctttttttttcctgagatcaaggattaatatacttcattaaaggcagtcaatgctatgaagtagtgaattataattttaatcaacgagtaaactttggtcccatctttgcttgttttggaaataggaatcatagaagttgaggatgttattaaccttgtaattggactttagatattgaagctatttgtgtgaatgtagtgtcaatctcagttacaaactgtttatgccgaaggcattgaggggtccggtatggattttgctgcttacaacttgctttgtgtcataatgcattcaaataataataaagatcttgtagcaaggttagccttacatgcttgcttgattctttttttcaaaaaaactgttagaactgaattatgtcatgtgattcatctatctgaatttcgtgattattattgttaaaatcttcattgttgaaagttactagattgagtcattttggagttatattcccagaaacatgctttgataattatattatgtttcacctatcagaatattgtgctaatattattataatctgcactgttggaattttctagtttgggtcctttgggagttctgttccctgaaaaatacgttgataatttggaacatgttaataagaatttagaaaatggtttgtgagggaaaggctcaaattgttggctgtttgggacctttgggtccttgggtggaaatcagtgattctcaggtcctgataaacaaaacacagaattggatcaatatatatcaagtctttcaatggctatacgtaaatatatttccttgaattattgtaataatagtttaatgatgtagtctcaaatattttgtcatgttatcatagaatgtcacgaatttgaatgtttagtgtttgtcaataccaggttatctcacgaagcaaagaaggatgaagctgtaaaacatgcccttgccattcgtgctgctgtaacttcagcaaattttattgcattctttagactgtacaaaacagctcctaacttaaacacctgccttatgggtgagtatttttaattaactggtttttgtagcttgttggtaacacgtaacatatatgttaagggggataaaatgaaatgaattttttaatatccacagatctctatgttgaaaagatgcgttataaggctgtgaactgcatgtgccggtcatatcacccagctctacatgtttcatacatttctcaggttcttgggttttcaactggcctggccacaaatggagcaagtgatgagagagatacagatgcattggaagagtgttcagaatggttgaaagcacatgggaccaacataattactgataacaatggagatatgttgctagatacaaaagtatgtttgatctctatcctttgtattcattgtcctgtaggtgctaatctagtcaagaatttttgttctcaagcattgagcattttgatttgttgaatcatcactcattttgaggagcatttacgattgtgctgcctcaaatcactgtatttccttctgccatattttgagagttggtttggttttctctatgaattagttaaccgttagttaacccatacaaatctagaattccctagttactagtcaactttaacaagtgttttcttaacctggttaatggttgtggattggtgatttaatgagaaatgtttaattttgcaggtttcatcatctactctgtttgtgccagagccagaggatgttggtggtgttgctacctgtcagaatatatcacttataaaacatgtatgcaaccatggatgatacagatattgaattgttacagcttaataaaccttcttcacattcgaattgtgaactatgtctgcagattagagattttgtttcagaacaaatgtctgtaagaggtattgaattccataccgaggagtctccccaagctatcacaaagtcagctgatggcaaattctctttaaagaaaccagcgggtgcctcaaggtaaggatggagttttgtttcttaaaagagttaggcacatactgcatttaattttttaatagtgactaaggacttcgtttgagaagaaatgctgttttcatctctagttcgccacttgttattatgatctcatagtcgttgttaatggcagtgcattgtgtatagtaaacttggaaaccacttttgttttgagaactccatggtattcaaatcttcccacattaattgtcttctatatatttatatatctataacatgtatattgaagtccaagtaatgtaaaagatgtaaagaaaagtgaaagtgcgtgatatatactcgtaaaatatacgaagtatatcattatactaattcttcagtatcttaaatatttttagactctttggtaaaaataaaaaattaggtattaagattgtctgcataatatagaagattataaatttatactaacaatataatatattatattgataatataattaatgataacatatattaatatatgtttatctgatatatatgttattattattattattatttgtaatatttacactaggactatatataatttctgttacataaaaaatatagcaataaaaaacttaatgcgaaatcgttaatatatgatttcacaacaacaaaaaatcattaaatacatgatacttttataaaatcgtgatattaatttttcaatacaaaataatgtaatatacattttacataaatgcacttctaccacaaaaaaaaaaaaaaaaagctctttcatctaaaattttaaaaagttaacataaaatatattaaatattaaaaaaaagattaattcattttagctgatacaattaattaaatggactcataattattagtttactttaacaagtttcaattattattttactttgattttttaataattttatatgcatgttattaatttgtatttttatattttatagtggtttggtgatagaacaccattaggcatgaagaacataaaaaataaaaaaaaaattgaaagaaattggcaacctaccttttagaagttaaaaacaaattatttagatgatataagaggaatttatatattggataaatgtttattgtaaatattataatcacttaataatttattgacaattatttgagcataaatatatttatttattacaatttgtttagatctagttttttgaatttgcaagttagatttgttgtaaaataaaataaacattaaaaaaaataaacaacaaaaaatcatcttaaaatgtctattttctaataagatttttgaaaaatcatctttaaatcttcatgttttttaacattttttaaaaaataacacaaactattctaaaaaaaattaatgtaaaaatcaagattttaaaatgatttaaaaatttttatgaaaagtgttaattttttatgtggatccattattaaataaccgtttttgaaagactttttttttataataatgaataagggtgaaccagtattttaagtaataatatttttctttatttttattttttaaaaccttatcattttattatccctctatttctgtcatatttttcttcaatcaaatgatctctttaatttctcttcttttctcttctgatcttttttttttttttgtttcattctctccttttaatttcatcctcacaaccaaatgaccccttaatgaacacttaggagatcagcaactgaattatacgctggagcaaacaatgaattaatgaagtgagatgttggtatttgattttgacagaatagatgtattttattttagtgactgaaaatagatgtacgtgttaataatgtctacttggatgccttgcatatcatcgtagtcatctcgtattaattaaataattggtcatgcgaatggcaagtgagttacaaatgaaaattactgtcaagttaacgagagagtaattaaaacgtagaaaaatgctagaaatacttgtttttctgacagcattcaatatttgatctgagtttatgcaaagatatggatatgaatacgttgtaaaatgattagatcatctcaaaaccacagatataaactttttaacttataaattataatcgaaaattcataaaaaaaaaaaaaaaaaacttatatcccatatatcaatcaatagatggaagtgcatccttcatgcagttattttatggaatcctgaggatacgtttccggcattacgttggagatatctacatgaaagtaaatgtcaattaattattgtgaataaaagaaagatcgactgcctattattacctcaaacatgcactagaggatattgaaggacgtatttaaccccagatttaactagcaataactaaaattaaataaataaataaattttaggccaaaatataagaactgcttttaagaaatatttttttataacataatttatttctatattataaatttgattttttaatttcaaagaaaagtgttactgttttgtacagcttagcacatagatcaataaatatataattatttcaatttatccaattattttaaatttaagttttgaatacataacttaaatatttataaaatcagagttatctaaagaattataagattgatgagtggttgaggaaaaagaggagaaagaaattatgaacgtgaatttttcactaacaaaaattaacagaattaatatttatgtattaataatatataaaattattttatattgtcgttcccataccttttttttctcaaattaacagactaacaaacatccacagataaaaagaatcagaatcacccaccagattaattgacatgaactatggcatgcatgcatgcatgcagcagctagggtaggaacagcatctacaaattaactactatcaatccgatctttccaatcaatgaactggttactagtgattatggcctagcggcacatgctcagaataagcatgtctttttctccggacctaccccttttgggtttcatgcctgagatggtaatttggaaagctggaatgatcaaattataaatatgcccccttttatttgtctccttgattgtccctctacacataactttatgacacggaacgaaaaagacaacgatttgatatataagcatgtcttaataaattataaaatcacttaatttttttttatttaagactcacaatattaaaagattctatatattatgactcaactaatttaaacagcattaaggttaatcatatttttaaatagaataaaacctttttttggtgaattaaatataataaaacatatgacgactactgatcaaattaattgtgactaccttttcagtgctaatgtgatcgtctaataaaaagacaagcaaaatattagcgacaacttgttattaattagcattcgataacacttatttaaagttttttttattctaacagtttgatccatcatatcctatgaaatcatatcacccgtgaaggttgttaattaagattcttctatctagcaacaccttaattaatatggcataaccttgaaagtttgttaaggattagattcgaaggggaaaatggtttatgatgaataccttgacaatcaaagacaggaaacagaataataactgacatttttttattagccaaaagagatttatttataaggtaccggcaaacgcccaaaaaatgatgatgatttacaaggacctaccccctgcacatacattcactagcttagcaattcaactcgaccaattgtttgtattcccaagcccataaatatccaacccgagacatcaacatatcgcatattacatgttgatattcatccaacaccagtttagacccgatttaagccatctgatctcattttcctccccattacgataattcccatccatcataaatattgtatacaagacaaaggatttgaataccactcaaaataagagaaatgaaaagctttaagtttagcctccaaccatgaccaagacttatattttattacctccatgacagaaatccaagtcaagtaattgatagcggaagatgatgttgtttctatggcaccatagtaacggacataatgcaagggggaattgaaaataagctttaaaacttctttaaaaaaccagaattttttgagatcaataatcgaattcgttcatgaaattgtaagacgtggacaaatttgtttctaaaagataaaaaattcaaatttagtctctgaatatgcaaaaagtgtaacaaataaattagtccctaaattttataatttaatgtcaaattgattctaaaaaaatataatttattgttaaattgatctttaaatattataatttaatgataaaatagtttcacaaatttaacgtcatgattaataatttgacgcattttttacatatttagggattaaatttgtatttttcatttttcagatatcaatttattatctcattccatttttaaagacaaatttgatttttttttttttataatggtgaaagtgaattttaaactatagtacactagcttattaaatggacactttcaccccctaactttaggacgacaagtgctctcaagagtcaagatataaatttggtcttcggaagccatgcaataccgtgtagctaactattcctatatacagcatcataaatgctttgatattaaattaaagaatgtaatgagtttgtctaagtcatacttagtaacgtgctttgttttgagtacttcattattatgcatttatagcaaaaagtccacactccactctcttcaattcatgatgtttatccaacattgcaagttgtcgttgacgtttgcctagggctagaagttagctttttggatggcttttggcattcaaaccaaatctgcaacccgtgatcctttgtaatgatcaataatcgctcctacagttttaacaactagtactagtactagtagtaatatttttttttaagccaaacctcttactattataagaaagaaaaaaagtaactaactaactcaaaatgaaattatttttaagaactaatttatagtataaggatttgtttcgacatgaactctttttaaacatttggatatataattgttaatgtcttataaaaaaaatggatctaatatgtacatatagatgttcgtttcctggaaattctcaagcgcatcttagttttgaggtaaaatttgctatgataaaaaattatttaaaagttagtaattttcttctaatctaactttttcatattttttcttctccttttttagtttccatttccccttcgttttgctagatctaaagcagtgtaattatagggattgttgacttatttaattaatggtcggtaccaaaattttcaaatttaaatgtttaaaataaaataaaataaaataaattttatttaaaagaagttgtacaccatacaattagttaacagtaaattataaagtactagctagtaatataattttatatgaatatggatcgttgacttatttagttaacaatcggtaccaaaacttttcaaatttaaaaataaattaaattagaatttatttaagataagtttgtagcaaacaaagtttaagttaagagtaagagaatggttatacactaagttttagatagtcatctaatcacaattcaacatgtatattaattttgttgacttttaaaataattatgttaaagtaatttaaaggattatttatgattagatgataatataaaaattttataggacattgacattaaattctaagagtaaatcataaagtataaactaatataattttatttgaatagtttatctaattaatacttttaaaagatgtgaaactgctttggctagcgaactaacaatatatagtactatttcttaccgaatatctaatattcggcacggggataggagaattagtgttagatattttcctgtatttattgactgtatcatccccccaaaaaatactacaatagtactattatattgcaagaaaacgtatggtgcagtaagatgcttggaggttgtcactgaattgaaagcatcatgcatgttgaattacgtttgttatttcatgaatatgcacggaaaaacccacatggcggtgacaattaagcagaaattttctttatatagtacgggatacttttatcagaattaaaaattcccccctctttgagaattgttctacattaatttgatcacattcacttaaaagttttttaatattttttctgaaagaagtgtcccagctgtgaatcttgatgttgatcgaacatgagccatgacaacgaatagcactcattagcatgtgattacaggctgactcggttgtttcataaataatccatctgcctttatgtgtgtttcccttttttgcaaatcactaagactattcgaataagacatgcatggtctccccattttttgagatgtaaaccagacatgttcaaatatggaacactcaagtaaaaaaatgatagtttcttttttaacaagtgggaatggaagacattgtcataagatttgtaaacatcatgatcaatcaattgaattatattcttaactaaaaaaataattttttatttatcagaatcaaccacagtattatagaaaatttataataattcacaaatttttattcaatcagttaagttagatcttctttcaaaaaaaaaattaatgactaaggagacatgtattacctattttataagtttacattcaaaatttgagttaatatttacgttatacattactttactgatatttaaacacataacacagtttgacttataaaccccataggattagtattagagtggagtaagacaaaatcttcttgtaaatgaatatgataattaagaagtttcttgctaatagctatgtagtatatgaatgtttttttttgcatatatttcatgggtatgaaccaccacatgggcgtgataatgagccattgcccaggggaaatgtgctgtaacgttttcttcagcaatgctaggctgttatacgcgcgtggtccaacacaaactgttagagcctaaattaaatcctaatcgtctctagtctttaatgttcggtataatgtctcttgacttttgtttcccttggaagatttgaactacgcgttcaatcacggaatgtcgcatcctggtggcaatagacttattttattcatagccttttactattctttatgaatagtaatggcaaaagttacaataatactatcataactttaacctagatttcttctataaaaaaacactgacctagaattccgccgtaatattgggccaatgaggttctttgtttttacagagccgatgagtttcaagatcaataaattaggttattagttgactttagaaaaagtaaaaaattgatttcacagttattaagaaaattaattaattaattaatttcattaaattatattatttttaattaaaaaacaaatatttttttaaactactcccattgaaacttgatatatctcattaaactaaggaaaagtagtaaaagagaacaaaaaaaattgtgtttttgtttataaaagagaatggaagagacatataagagcatctttaatgctagatcttcagtaaggatcttgaatttaatatctgattttcactaaatcttctaataaaggagttgaagaaatctctaatatggatgaattattgtagaaaatctcttaaaatctgcatattattcaaaaaagaataaattttctttctttttctctcttactaaaatctcaaaataagaataccattaaagaaaaaaatggaagagatgttgaaatttttttaatcgtatgtgacattatgggatctatcaaaaatagtcaaagatcctaattggagatctactaataaaaatactctaatacttcttataaataaaatttcacctaaattatacaaatgtatattaaatttcagtttaaatcaaatttatatttctttaggttaaaaaacgggtacatgactccctctaactactttcagtactttgcggtgtctaaccacaattcttttttgtgggactctgatccctcttcttgctcccattaattactatgaccgcaatttcaatgggcttcttgaatacagattttgctgaccttccatgagtttcggcctgttccttctatgttctgttactgttctttctcttttttctataaatttgggttgggttttgatagagtatctttagactaaagggtatcaacatagtgaaatctgcttcctacaccattctttttctattacaccatttttgtaatggtggaatatccaaaatatttttcgcgttatgcttcatacatatccgcataataagtttttttttatgaaataatttaaaataatggcatagacatgtctcgaacatgcaaccttcgcattattaacacgatgctccaatcaaccgagttaataggccaattatgttgatacatataatactaaattttttaatgtatatttaatacacatataattttatataataaatttttaacaattaattttaatctaataattaatttatagtttaacttatctataaattttgttttgtaacatatattgttacgaaataatttatagtttaatcgcatgtttgataaattaattattagataaattaaactataaattaattattagattaaaattaattgttacaaagtctattatgtaaaattatatgtgtattaaatatacattaaaaaatttagtgttatatgtatcaacattaattattttttaatataattgacttattagctcagttggttggagtatcgtgttaataacactcgtaggttcgggacctgttttcgtaaaatatattttaacataaaaaaaaacttatggacttatggattcgccaatccgtatgaattatgcggatccgtatgaagcataacgcgaaaaatatcttaaacaacaacacaagtaatccaacaaaaaataaaagagagaacgtgtgtgtttgttttaagactcttgaaatcttcccctttttattttcaaaacttgttttcaacatatttttatattaaaaaaatatgtatagattttaaaaacaaaacaaaagaaaattttatttgttaatttcttttttagaaaacagattttaaaaagaattgtataaaataacaatatatgtcaattacatattcattattacatatgtgacatttaacaacattttttgtctaatatttattaaaaatgttactaaatttttttggcaacattcaaaaaatatcgtcaaattatcaatatatgttactaatatgtttttgcaacattttatcaaatgttgtatagctcatattgctaaaacctaaaaatttcacaaaaagactttagcaatatggactatacgcaacatctaataaaatgtcacaaaaacatattaataatattttttttcataatttgacaacattttttgaatgttgtcaaaggtttttaacaaaatttttattaagtgttagacaaaaaaatgttgctaaagatcacatatgtagtagtgattatacaagatcgaaagggttctttatttattacagtaaagcatcaaacttaaaactaaaactacaaaattaaattataactctaattggcatgcatgcaattgatctttttctaagagttcaagttcttttaaggccttatgttcaaagtagagaatgaactctttgtttaagtgagtaatgactccagtgtgtcttaatgctcaaacaatggcataaaactcattgtcatgcataaaatacttaaatttgtcatcattatataattaagtttctcataaaaaaagaaaaatataagattggtctagtagttgaaaaagaggtgaaagaagaaagaaagaagcaaagatcacgagtttgaatctcccaactaatatttctaaaactataaactaacatttgtcgataaaaaaaaaaaaagtttctcatgaaaaatatgccatgacataaaactcattgccatactaaaaaagaaaaatacttatagcttcatttccctcttatcttggtcaactttaccaagtagcaatggtgctaacttgattttcaactcatcttttataaagaagcaattgtttgcatagttgttatacaatgctcgatagtcttattgctcaagtctccgaagaagatgacatgcatcgaaggaaataacatcatatcctatatgattctatgatatttccaagcagatgaaaaatatacaatataacatttagaaacttttaccttactttctttgttatgtcattgaaacttgtatggaagtggatgtttttgtgttgataacttattcaccatgtagttttatactacattttcacaccctttgtttattataatactagtacggtaccaaattcaatctatagtagaatatttgcaaaaagataaaatttgaatttcaaattgcacccacaaatgatataaatactaccgttgcaatagctttacttacatcaattgcatatttctacatgaatctttcaaaaaaaggactagcttattttaataaatacatccaaccaaccccaatccttttaccgactaacatctcagaaaatgtcacaaaactcttatctcttagtttttgacattttggaaatatattagctgatgaattagtaattgttgttcttgtttctttagtacctttagtggttcctatacatgtcatgctccttggattattcacaagcggtattcaagctctaatttttactactttagttgcagcttatatagataaatccatggaagtagaaggcgctctggtgggatcctcacgtatagaaaaagattgcagtcaatttgataaggatcgagtgacattgtttctttgatccaaaccaaggaatcccttaaatattattcaaaataaatcttattctatcgttgatcaaaggtttctctatgaaaaatacgaatcggagtttgaagggaggagtcctcaacccacaacaaatagaggaggatttttcaatcacattgtttgggctcctagaatatggtgcccttaagacttcctatttgattgtattaaaaaggcccaatgaattgagatttttctattgggccaagtcattttgggagaagtggatcatttatgacaaagaggatgagttttaagaaaatgatttagagttcttgcaaggtagaaccatgtaataccagacacgagatagatctttcagagattaggattttttttcaaataagccaattcatttgggacccatagatccactctttttccaattaaaagataagccttttgtttatgtgtaaagttagtgaatataataatggtgtagtcttttggtaccaaagatgagtagtagcaggtctactgtataaagttgatgtgaagcaaaaacacttcaaaaccaaacatatcttgttgatcaagctagtacttgcctggacggtaaagaaattgcaagataaattgttttgtatataataatataatgttatataataaattgatctaataaaaacatgtgaattgatcaaaatatttttcttttaaaatttaaaaaataaaattaaaatataaacttaatgatatattttaattttattcaaatatataattatttaaaataaaaaatgtataagttattattatgaataagcatgacaaatgggtgggagaacaggtatatttcaagttagtttgctaagaagttagttagaaatgtttatcaaatcaatgatcattcaatcaatttatacaatgttcttatatgatagtcctctactatatttcaaactttatgggtatgatgacattatgtttgtgctagttgtattttttttcaaaccatttcatctcaaatttctaatactaatcaatattggttaacgcttcaaaaccaccactacactccggaggagtattttgtaagctacatcaccagtaatataccaaaaaagtgtgttcgtacccggaaaaaaaactaaaagtattaacggttcattgtttacaacaattcaattttttttaatatcattttttagatattttagtttacaaaagaagtagggatatgtcacttccccaaaaatatattcaagaaacccgaccccgtgcagatcgtctttttagccattttctgaagtagaggtgttgatatatcacaaaaaaaggtgttgataaaatttaaattagatgatcaaatgcattaatttaattttggagatgaacatcacaagggggaaagaagtcagttaaggacgcacgtcttaaaaactttaaaagaaaaaaaaatccatattccatacaagataatattggtgtacccaaaaaaaaagatgatattattaaaaaaaatcttattataattataattttaattaactagaagttataagagaatataaaccaaattaattaaaatattcaatgaattcctaattataataaatacatagtaatttttgtatttatgagaaaaaaattagtcaataatcaaccatttatttatgacaaataatatcgtattaaatatttttatgttgacaattgttatcttccgtgatagaaaattttaaattgaaattataattcttaattcaaaatagggtttgggttaagaattgattgcaaagatctgtgtcataaatacaatattgatttaaatggtcaaataatcattaattatattttcaatcaaatcattatgttcaaatttaagatagtagtatcggttttacgaaataatcattgctttagaaattgtcatgtgtggagttttcttcttctttttttaaacattttacttttttatagaacattttactttttttaatgcaataaaacattttactttgtatatagtaacattttctttaacagtgtatataataacatagatagaattcacaaaaaaaaagtaacatagatagatttgttatctttgacacgtatctttttttttagggattttacacgtatcttaaaacacacccccttcccaaaaaaaacctaaatcataatggacaataattataaaaataaaatacaaatcataagggacaattttttaatatcctacgttgatgttcactaattaaatcattctccaatttcaattcattgtattcgcatgcatggctagtctttgattggacgagaatgaatagattaatctaacgcattacactctttaagattaatctaacgcattatactctttaatgtatgctctttcaaatacatgatctcctttttccccttcaagccaattacctcgtctatgccttttatctcttcattgtatgggtaatcttccttgttctattatggccaccacccttttgatcacttgtacaaaaccacggtgtgaaaacaatgtggagttgtggtcagtaatgtgaagcgaaatcatctcacgaaatattctacattcttaaaattatcaggttacaccctacctgtaatgggcatattttggctttcaaaattttcaacaaaacaatgtctcaagtaggtatattttgttgtctgcgttataacttgcttgtgttgcctggtgtcattttatccattattgtaaatgatttatttatttaacacatgaaattttgcaaaatttgctataggcatgttaagggtattgttaaagatatgattagatttgctgattatagggatttatttccctctttcccttattatttttatcccttcagaacacacaattccagcaataatacttttttttttttttttgtgctgaccggcaatacttgtttaggtattttattccttgaaacagtattttgttttggtagtcattcaattgttatgaattttaagtacatttcaatattttgttcacgattcaatttcaggaattttctgatccttgtcttgttatttgtctaatgtgatgagaagcattgcgattatttttatgcctgatggttactttacgcatatatcatcagtatgatttttacttcattgacaatagagaagttgttttagcctattgagacatacaacattgactaatgacaatacaatacgtggatcaaagcatgcatgtgttagttctctagagtgcattttcccatttggtaagtaatagaaatgtgaatgaaactggaaaaaatatgtaacaaatgattggagtgtgcaactatttccgtgtttatttgagaatgtgattgagcattatccattgttgaatatttgaaggtaggaaaaataattttaccttttgagtaagaatgctgtctttgtaggaatcaaataagtgaaaagacttaacatgaaaatttcaggccaagcgtatgccagggaacaattataactgcgtccctttaacaccaaggtctagattggaaaggcttctgagggaaagagagctaaggaaatccttcaagcttattcaaccaaccgaggaagcaagagatggcagcaaagagggagaacaattttatggtgattcatgcataagtgagaatgaaatttcgggtattcataaagaggaggagatcacggaaacgaattttacagatagaagccaaaggcaagatgagaggccaagcaaacaacgtttgttggtggtagctaacaggttgcctgtgtctgctgttagggagggtgtggagtcatatcgccttgagatcagtgtaggcgggctagtcagtgcacttctaggcaagaaaattttgtcaccttgcattaattgtttctttggtgtgttttgttaatttatttattgtgaagtttgtaattgtaactcaaccttgctaattagttacctttcttgatgatctcatagaggtcacaacaatgatagttatcttcacaacattctaataataatctattacttataggaatagattgaatttttctatttttaaagtgaaggttgtatgaagcttgttgtttttgttgaaggtgttaaggaatttgataccagatggattgggtgggctggtgtgaatgtgccggatgatgttgggcagagagcattgacaaaagctttagctgaaatggtattgactcaaatttataattcacaagcatgtggccactgatcaatgtagtgaataatgataatctagcaactcttctctttgcaataccaaagacacacaaaccatcagtaattatgcgttgttaactgcagcgatgcataccagtatttcttgatgaggagatagttaatcagtactataatggctactgcaacaacatcttatggcctctatttcattaccttgggcttccacaagaagatcgacttgctacaactcgtactttccaatcccaatttgacgcatataagaaggcaaaccaaatgtttgctgatgtagtaaataagcattatgagaaaggagatgttgtttggtgtcatgattaccacctaatgttccttccaaaatgtttaaaagaatacaatgaaaaaatgaaagttggttggtttctccatacaccctttccttcctcagaaatacataggactctaccgtctagatcagagctgttgagatctgtacttgcagctgacctggtggggtaagttattctcatgcatctccaacttgatgttgattatagtagtacattcacaagctaaattcctttggtatataggcatcaagggcatgcatttagaacaagctagtcaatctttagtcaaaaaattatcttccaccttgagatttactgttcttgcttgttgattgcactatttagtcaatagtatcaagtggtatgttgctgcttgctaggatatttgagaactctagacattttgtttaatgttgtgattttaatattttcattggtctgcgtcccagattccatacctatgattatgcaaggcattttgttagtgcttgtactcgtattcttgggcttgagggcacacctgaaggagtagaagatcatgggaaactgacccgtgtggctgcggtatatctgcatatattattttccctttctaattctatacatctaactgtgaaactggaatttcatcttgtgttgtatgtttatcagcattgaatagctttacgaatcagtatgcagtatctgatttcattctcatgatgacaatgttttattttttgggagtgtgaaacttcagtttcctattgggattgactctgatagattcattcaagcccttgaactccctgaagtccaagaacacatgaaagaactgaaagaaagatttgcaggccggaaggtaggagccatatacgccaaagtttcttgttcaagaatttgagaagttgagattttcctcagtttcttgtttctgttctacatctgcctttctctgaaaatgtgaatcattagaatcactttatgtttcttatcaaatggacaggtaatgttgggtgtcgatcgtcttgatatgataaaaggaattccccaaaaaatcttggcatttgaaaagttccttgaggagaattcacactggcgtgataaagttgtcttgctgcaaattgctgtacctactaggaaagatgttccagaatgtatgttatttctctagaaaagttaattatcacttgaagcattcattttgttagttctctatagttattggcatttttcatgactgacactattgacttaatgctttggcagatcaaaagcttacaagccaagtgcatgagattgtaggacgcatcaatggaagatttggaacacttacagctgttccaatacatcatctggttggtgttttaaacatctacagcatatatgtcttgtttggtatttgacgatgcaaggatcatgagtgtggatgctatctattatttgggatctcattgaaaatattaaatttctcatgtcactactatatatgagttgatccccgttactacgagatttgaactattgatcatctatatattgtctgtgttctatgcattgcccatttgatcattatgttgccacccaaaagctgtaaattcaatgtctaggttgatctacttaattcaaatttgttattctcaatttgtgttgttagctacattctctgctagctgttctacaaaacatatcattatcacaaacatattcacgacgtctcatttcttcatctctcttatttgatcaagtgatataagacaaaagtgcaaaaggaataaaaaagggaataaccattctagcagatgaacaagaaacctactagacagattctcctgaaaattaccaggaaatgaggaaagtcctctgaatcataagtgataaataggagttgcatttaatcacatcttattttttacattgcaaccttttgataacaagacttgattgacaagtaaagaaaacatacctatacaaagtactctgatgggattttaattctatcaaaatttccgtaaagttacctccaataacccgataaaattataaaaattctttcaataaatcttcaatagttgatcttcttttgtcctgcatcaccaagtaactttcaacctattctttctagattaccttgatattgttcagaatgtggagcttttctattacacaatcacttatttgtgtaatgttgtcaaacgaaaaaattatttcccttccatcaaaaattaaagttatatttattttttacaaatattcaagtaactaccttgactgttctttgcacacactgaccatgcattttgtctcgttgattacacatccttctcttgaattgctaaaattttttgggcaaagtaaatacattgctaatcttcccagaagagtgacaaatgaagcgaagtcatatgtttatttatcatacagaaaatattgttattgttattctgttgaccttgtaatgatttctggaacatctctttctatgattacaggatcgatcacttgactttcatgaattatgtgcactctatgctgtaactggtactcattttctgctataacatacaagatttagtccatgttgtccttatttattcaaagtaataatattttttatataaaagtagtatcatatttcaccattggattggtgaaatactcaagctgtaggacattctttcttgttattggaaaagaaatttcattatctttgctgactctttctcttttctttaatatatgttccaagtgatttaagtcctctgcttgtaacatgtacctggctgtaagaataaattgaactgattgatatttatttaccaggaaatgaggaaagtcctcaagaatcatatttcttgatttttaattcattgagaaaagaataattgaagtacaatgacttacagttgtttcttatattcacatttgtaatatacttctgttttatgcttaagatttgacaactattcctgggaatcagaaaatggcaacaggctgcagcatatctttataatatattataaaatccatcttaagtagttttattgaactaagtattcagcacccatgatatgtatcataccagtctgactcacatcgtatttagatgtagcacttgttacatctttaagggatggaatgaatcttgtcagctatgaatttgttgcgtgtcaagcatccaagaaaggggttctcattttaagtgaggtaattcagttttttaatgttctcatcatttattttggctgcatctcttggatactctgaatgtatttgagcttcatatttgagaaagtgatttatgttttactaagatcaccaacatttcaaatgattctgccattaagcatagtaatgttgaggtatatgtatttagctattttcataaaacagcaaaacataaaacaaatttactgtcatttaatgaataagactttcctaaccttaactaggtcaagctagcaagtcctaagaattataaacaagtttgtttttcctttatcaccatatattaatctttagcaccgcacatagtctttttttattttatttattttgaagtgtttacacatcaatggtgttaaagtttttctagtctcaagctcacagtttggcttgttggaaaaagaaaaaaaaactagcctagctaagctgagaagctcagctttctttttattttgtaacctgaattgtgtatagtttgttaggctcaactatagagaaaaatcatcagtatgttgtatctgtttcatcaatcatccgcgtcattgttgagctctgtaatgacaaggtctacttttgatggtaacctggttatgctataatgtgttcataagtatacttattgtttcttgaatatcaagagccagaatttgtttttgtcaaaggttaacatttgttgaaagacatatgtcaagagaataagctagggtaacatgaaatgattgcttttgatgcatggaattgtggttgctgatagactgaaatttaaataattataatcatcttcccctatcattatcattctataatccacgatgcaatattgatgtatatttatttttcttttaaattaactatgatgtccgtgttcttcatcttatcaccatcattgtgaatgttaaatatacgaaatgatcaatctattcaaaccaatatattttctgttcttagttgttttctatgtacaacccatgagtgctttacaaaaactggaatatttgtgataaagtgacagatagaaaaggatagggttgatactaggcttctagttcaagacttcagtaggaatgtaagatcatattgtagatcatattctttataaagttattgtttgtctggaaatatcatcttgtttaaataaaaacaaattcttatatgtccaattattttattatcacataattaactcctaaaatcactaggctttcagtataattcaaataatttagaattctttatttggtatcagtttgcaggtgcagcacagtctcttggtgctggtgctatcttggtaaacccatggaacatcacagaggttgctgcttctattggttatgcgttggaaatgtcagctgatgaaagagaaaaacgacatcagtttaatttcaaacatgttgagactcacacatcacaggaatgggcagcaacttttgtgaggttttaatcctataacactgcttgcattttgtttttcttggatcaattttgttccatattttatttttcttgtaatatggaacagtcagtcttacacaagcatattagatcgaccactaaagctagtttgaaatagtgtcaatgggaaaatggagaaaaatggaaattctgtctttgaaatagctatattggtcggtctattgctctagattttgtcctgaccttctatggtggtctctgccacttatgcttttcatgattatttattctaaaaacaaggttttatttttacagtgaactgaatgataccattgttgaagctcagcttaggacaagacaagttcctccattacttcccaacaaagtggcagttgattgttactcaaaatccaataaccgactaattatactggtaagctgtttgttagatcatcaaacactgaataaagggctgtcgcaaattattcaccctattttgtgcaataagtattaggcttacatttataaatggaaaccaacatgaccttacttatacaagtgcaccgcacgtgtttaagagaaacgcacatgaggacttatttgtttccacttgttttttgtgaataagtgagaagggccttctcaccaacatatgtagctccttttcactaaaacaataccattttgcctcaactgcactgcagggtttcaatgccactttgaatgaaccagtggatgcccttggaagggctggtcaaattagagaattggaacttaaattacacccaaatatgaaggaacctttaaagaagttatccgatgatccaaagacaacaatagttgttctgagtgggagcgatcgagcagccctggacaaagtactatcaagaaaacttcatatgtttttggattttcagcaacatttgcttttggactaacaactactttatgcagaacttcagtgaatttaacatgtggttagcagcagaaaatgggatgtttttgcgacgtacttcaagtgagtggatgacaaccatgcctgaaaatttaaacatggattgggttgatagtgtgaaggtaaattagctgcatgcatacaagtgtttctcttattaagttcctttagtttcaagtgtgattttttttttttcatatttttttataaaatttcagcatgtttttgagtattttactgaaagaactccaaggtctcattttgagcttcgggagacgtcagtagtatggaattacaagtatgcaggcatgtgaaaattttctgttaccatcttcccttttaattttcaacctacttatttttttctaggactaacatatgtttttatccttaataaatatttaaattttgtttattttttgataaattttttctttatattaagtctttaataaaacaataattttattttttatcattgtcactttttttttgtctatgataaattagtaaattttggatttgtttcttgataaaagaaattattttttattagtcttttttcaaaggaactaatatcaaatgagaaaaaattatcagagaacaaaaacaaaatttactaatttgtcaatattaaaaaaatgtcaatgaccaaaaatcaaaattttattttatcatggaacaaaaataaagaaaaactttattaaaaacaaatataaaatttggatatttattgaaagatcacaaacatattttaacatttcttctgataagacaattgtgctgatgcacatcatctctttactcccttcccagcaaagtgggagccttctatggttaattactaacttattgtgactgcaattaacactagatgttgagtttggaaggattcaagcaagagatctgcttcaacatctgtggacagggccaatatcaaatgcatctcttgatgttgtccaaggtggtcgatctgttgaggttcgcacagttggcgtgtcaaaggtataagcaatttcagctggctagtagagtctctcacctatccttttctgttcagaagctttatttcctctacatgctagcacctgacactttttttggtatagggagcagctattgatcgtatccttggagagatagttcataacaaaggcatgaagacgccaattgactatgtcttgtgcattgggcactttctagccaaggttagtgcactttatttgattttctattcttagttcacttgagactttgttattgttagagtggcatagcactaagaatgactagatcgttgccttttggcagtttggtagcaatgatagaacatcaattgataaggtaataaaatataatattgaacactgaaatcacacacaatacagcagtacacttactttcccaaagacaaaagtctcctgcagagagtacccaaactgcaaataactacaccctccttatttacacaacttactaccaaatatatactcctaatagataactgtcagtagttagttattttatatgcatgcagattctaatatggaactacctccaattcattaagggtcctttcctaaccaacttggatctcagttcccatcacctaaggactcaactgtaaatattagaatgaaatttctaaaggagcattgattttagattgatctacatcagaaaaagttacatgtctaagccttctataatgattaaggcaaataatggttggaaatgaactgtttcaggatgaagatgtgtatacattttttgagccagagctcccttctgaatcacctccattaccaagagctatgctatccaaatctaattcttacaggccatcatctctgccaaaattaccagccaccaaaaccgggtcgaaggcagctcaatacaagaaacaacgttcgttgtcaaacatagaaaagagagaaattgatcaatggagaccaatgtatagtgataaaatagcattgcatgagggttcctcagtgcttgatctaaaaggtgataattacttctcttgtgttgttggacggaaaagatcaagtgcacgttaccttcttaaaacctcagatgatgttgtcaacctcttaagtgacttggcagaacattcttcatcaccaaattaactgattgtctttttgttagattgtttttttcttggtaaagtgtctattcatatcatttgattatgcaatgccctacatgtctcttgtgatttgaatgaatctcaaactggcaacgtgcttccagcatgtttggaactctcagcatgtttggaactctcgaaactgtttgaaattctaacttaattttgctatataaaaaaattagttgtttgggtgtttcttttcgaattgcttttacttttactcatagcacgtttaacagaaagcaacaaaaaaaatgtagcttttgccttagattgagattttacactaaagtccactgttaacttgcgtaaaatcaaaatatttttaagttggcaaatttttaccaaaacattacaggaattgaatgaaggagtcccactcaatcattttcaaagattggttttaattttaaaaccagatatgatccaaatttaaagtagtttaaattaaatcagtttttatttgttttaccccttacgtatttgttttaatgtgagaaatgaacaaattttaaatatatatatatatatatatatattaaaataataaagaataagatggcaaaaacaaatactataattttataacataatacggcgatatgctaattccataccaataaacacttctattcttcaattgatattaataaatgagaatacaaaacatgggggcatacacttattcagtgacatacaaaatttagaaaatggccgcataaccaaagctttcactgtttaacaatgctcttgaacttttgaactaagttttacactatatgtgtattaaatgaagaaaagatgactaatccctaaatgaatgggtggatacatcaagaatacaatttacagctaccaaagaaaaattaactcaatgcaggtcctggttggggcagaatggtgttcaaaatatgacacaaacctcaatcaagtttagttccccttaaacaactcgaattaattcccatgagctattcttctagtcttggtttgttttggcacatatgcatattggccaaagtccacagtttttattggcctgagttaagacaagcaggacacaaatcatggtgttgatacaaatgtataagagataatgaattccagtttggcagaaatacattacctattatcagaagtgttttgaacatctttcagaggagcacggagaccactgacacgagtgccagaagtgcatctaaaggatgatatcacggagacaaatctttccatagacttctcagctatttctgaatactggcccagatgggaaatgtttgtcccaaatttttcttcttcagcattattctctgtaaatggtccgtcaacattgtgatcacagcaacctataatcaagaaacatcagaattcagagaaacttcagcctcagcgagatatttcctttcatgattatttaaaaaacatgcatatattcagtaaagttcatggcagatatctctgctgagcctgaataaaacaaatggaatccgaaactgagaatttactcctttttatcctcattgaagagtactatgttattcatatactcaaagcacgattttccataaactgagcttttgctaaacatgattttacttttacttttgctaaagtttatggatgtttgaacctctctttgtgatttcctacttttccataagggttaatagttaatacttaatactgataaattgtctatcttacctctccaactcagacaactccacaagtctgtactctttaccttataatactataccaaaagtagtcaatattaaattattaattatgtttaaagataagttacaatttagaatcaataggagcttttcattatccacaaaagtcaaattgcactgaccaaaaatacaaaagtcaaatcgccatgaaaatgaaaccgaaaatgaaatttctaaatgaagaagtagtcaatcagtatgcatagaagcttctgtgggagttgtaaagccacattcttaaaagatgataatgcaataacaacatcagtggtagccaccactttggacagcaagcaaaagacaacaaaagcaaagaacataattagtggaatagtaagacaattttagcaaacaaataaaattcataccattattatgaggaggtgaagaacagtgcatttgcctgggctgcaaattttcctggagaaagtcatttccatcagtgcatgagtaaaaggagaaagtgttaaagaaaacataaggtccgaagtttaaaaaatcctacattttgaatattgtcattaggggagatcttccttttcaggtctttattcttcaaatggttgttacataaatcactgtcagatatggcctttcttctcttgtcaatgacaatgccagaggacaggtgatcttgtttctcatcacaaacattattttctacttgcttgtgctgaaaataagcactccttacaattacctttcttgttgcctccctgctctttccttcaactgagtcaaggactatctggtctttattcttcacatcgttgttacataaatcactgtcagataaggcattttttctctcatcaatggcaatgccagatgacaggcaatcttgtttctcgtcacaaacattcttttccacttgcttgtgctgaaaataagcactccttacaattacctttcttgttgcctcctcctggtttttccttcaactgtgtcttggacatttgtgtgcccatgcaaccccagacatggtttatgaattggctgcctgggctgtcgcagtactgtatgttcagggcttttcttctcttcacccaccatagacaattcatgcaaacaatgaaatgagtaattaacacatgtaaaggcataagggattttcccatccaaagcaaaccagcagatttatatcttaccatgacatggagactctgtaaattcagaaatgtttgtggcagaactatatcgaatctaaagaaagaaaggaagaatatgtttaaaaaaatatgtaagtctcactaccaacaatgagtagagttttcactgttatagttcaatattcaggcaacttacatggctattaggaggaggggcactgccccaattctcagagtcaataaccgatgcagtagagttctttgtttcattagcagcagtaggtgacacccgaggagctctgaatttccttttcgcttcaagagaagtaaaacctttcatggctaaggaaaagttactctaaagaagaatagaaaaaaaagctgctagctacaagtggtatgttgtaaagaaacattgagcttaaatgccactgaaattcattgcctcaacttgattgttttaaatgttatatatcttgaatctaaatttttagaaaactggtaactaaagcatcaatagcatcaggcagtatcccagtgaagcatagaattctgccctgcattcatcccctttaaacatgctaaacatattaaaatcaattcaagaagaatgctttgtaggatacaaaagtacttagttaagagattcttctgcacgggcaaatcaatctttttctttgcactttcagaatgagttttgaattgactagttcccgcaattgcaaatctggctgtaagattctctccctgccatttaaaataaatagatttttaaccaacagtaccctttaaacaagggtttaattgaaggaccatacacccatgtatacttcttaaatgcttttaacatttattaaaaagaaaggggtgacaatctattcatatttgctcagaacatgtttgtgaaggtgatactaactcccaagaaaaccttgtaccagtactataacataaggcaaacaaaatctactttatatgtagaatttacacaaactcatgcacatccatgcaaaccaaaggcaacggttatagaacactagcaacagtcttttcagttgttgtcaatcctattcctatcattttcaaaattcatttttttttcacaatcatgcaaattgtccttattccaaaaatgaacaaatgaaataagtcaatttattttgaccaacacatgcaagaaaaacagaggtatttcagtttactataaatttattctttcactttaactaacacacactttggtatggatgaagataaagaagaaattgatgatgtacctcaaatggcattttggtaattggatcaagatccccttttgctattctttgtgctatatcttttggcatgggtgtatcccaggttaaggtataacttcaagtaagatcttagatgattgaacaaaatggagcagagtgatattaatttaaaatggcaagagaacattaaaaatgaaggatatgggcctaaaaagtctaactcatcaccaatatcatcagatatattagacaaatgaacaatattttcattaattggatcataaacccgttgatattggaaagtaagtatagcttcttgaatgactcttcataaaagggaggcacagaaactccactatatctcaagtgcttaagaacctgatacattgcaatttgcattagaaatacaaaaattcatatagaaagattacatacaagatttataagatatatattgttataaaaaacacttttaagcatttctgttatgtgtatagatgtagacctggctgcttaagtgagtttaaacagggaaaatgaacattgattgtaaataaacatgcttgttagtttttatggttctgaacatcatgcttgctaagtgtatcagctgcactcaccttgtcataacttctaaattttttaatgcttgcatgggcccttttgagacccatacctggcaaggactgcagataatcacagccactcaaaatacacatttcaagaagcatttgtctgttgaacccttcaaaactaagctccttattcttttgtagcatggaatactgaaactgaacaccttgaccaaacttgtccattttaaagataatctaaattttcaaggaagaagcaggccagtcaaaaaccagtgagtactcaaagtaggaataaatatacactagtatagaaagataacaaaaaacatctatagctaagccagtggtaaacttactcttgggcaaccaaacggtataagatcagagtcttcagttataactgcatcaacttgtccacttattgccaagaatgtcatctgggcatctgcctcgtaaggagcaacaatatactgcaagttctcctgcttcaatacctttcaagaaaaaacaaggttaaatatttagttggggatttaatgtaattattgtattgaatatattcaaacgaaatacatatgtgatacacacacacacacacacacacttcacaacaaccagaccaacgctgatatattgaactcctttatacctgaattagttcaagtgcaatttgaggtgaaatatcaactgctttctggtagcactcataagcagcagctgaatttccatctgactcatgttcaactgcacgtgcaagattatcctttctagccctgcacttgtagcatagaaatatttgattcatttgcaaaagcgcaaatacaatcaatgagattttaaggttcttaaactgcccagaaatcaaagcactcctctttggtgatcttgtaataaagctcataacctctttatcccttaatatcctttagtacttaattcttttggtaaaaagagagaaaactacgaaactcaggccccataacaagatgttgttttcatgggtgctggagaagattggtttttcagtatcttagtttgaaagtattaaattattaatcaattctatccctaaatcattcagtattccatccatcctctgtatttcacattaaaccaagttcattttacctcaatttcagaaacagaaaagcaatcaaacaatgacaaacagcaaagaaaacaagtatgcatttagaacagaagcagaacattgagcaagtcaagatcataaacatggcattactgctattttcaacaaattgtgcttgtgaataagaacctcatgtaaacatgaagcatacatggagacagagctcaagaaagttttgttcaaaattgtcagcttatatcatttggagaattccctacatgcagacccactgtacactgaggaagtgaaatcccacaaagggagaaactaatgcaaatgcagacagctggtacaagcacagcatcaaatccttctttgaattttgaaattagataactcacagagaatcaaattaaaagaaaaatgaaaacggttatgacttgagcacattaagcttcttactctactcaatgtaagactcataacattgccacctcctttaaaaactgatgtttacggaggcttcacactatcaacagaaaccctgcctgataatagccccttttcctcacctatcagtattggtacattataccttaatctaacctataagtagcccttaccatagttcaacgctcaacaaaagcataattgttatgacttgagcaaaagtggagagtccaatccaaaagactagttcgttatgtaagagaacttcatagctagtaccacattactcaacataacatacatgaaagcatcccattaacaattaaggtgacactcaactcaacaaaagataggtttttctttttatgccaaaaaaacttaaaatacccaattaagaaaaaacaaagtacaatgtcgggaagacaaagagagtacctggcacgcttgttctcttgttcactcttcattggcagaagccctccatcaaacactagaataggcttaaccccaaaatggcgcagcaaatttactctgtgcatgcaatactcaatgtgcctaaaacacgccaatgcataaaccaatctcggttaagccattttggggtgccataaattcaactaaaccccctttaaaaataaaaatcgaacttttacgagcgggttactccaaacaaaaatcaaagaaaaacccaataaaataatggtaaagaaaagtgtgaaagggaggttacctggtagtgggcatccctttgcagagttcggtgctgcaagagagggcacctttgtggagccaagagtaggtgtctaccgctacagaacaacccttcagatccttatgtggattggaaccataatcgacttcaatagcggcaaaaaccctgattcccattcctctttctctttggagtgaaattacaatgactaacactacatttcatttcatatatgcactaaaattgggcgcaaagttatattttggcttgggtaatggcggagtttaatttaatatcttcgtttaacgttacttttgtttacatgttttaatttttatataaacattttttagagaatttatataaattttattgatactaaaaaaataaaaatttaaatatatgtatccctaatatatattaaatttggtatttgatttctaataaaaatttatttttaataacctctaatatttaaaattttatacgatatttttgttgaaagaatatgttattttttatgtattgttaatttataatagacaaaatattgtaatgtgattatatttgagttggaattattagaaataaaatttttattttaattataaaatattatttaaataaaaatttaattaaattaagagaaaggaagaagagattactattatatcattttaatatatatcaatttttattatctaaaatacttacataagactaaaatgacactttaattttttttatcaatttgatacatgttgatttattctatttatttatttttaaacaaacaggtattgtcatgtctcaaatactagaagttctaaaattaatttgatgattaaagagagaaaaagataaatttatgaatatgaattcctcaaaatagtattttaacaaaattaataataatatttattaataaaaaatatgtcttaaatataattgctagaaaagcatgtctcaaacattgtttatacatataatactaatgactccaatatataatatgataacatgaagtgataaatctaaaatatttttttattttatgctatgctatgcttgatgcacacaaaataataaatgatattattatgttattttgtttcacacttattagatataaaacaatgataaaataagatataaattttgttcaaaatataaattctctttcattaaaattgtatataattttgtaaaaagcaacttttaatttatttttaatttttattgatataaaattataattttattattttttaattcaatcacactatacaaaaataagataaacaataacacgaaaaattatattatttttgcactaaatattttattataaaggatatgataaatatcaccaaacaaatcctaataaaatataaaatttatattataataaataaatatttaaacttatagattatattttaaatttatgatagatatattattaaaaaataattacaaaaaatatttatgatagataatttaatttgattaagatttttttagttattgataattttttaaaataaaatttagtttaaaaataaagataaaataatatattaaaagagataagaggttaataccaatttctctaaaaattatctttactaaaaaaatccttctttttacgtaagaaaaaacatttcctaaaaattcttaaaaatactatttttaaaaaaatctctaacacacttaattagattaataattataatttaagtaaataaataatttcatttaaggtgttaattctgaataataaaaaatgaaatttaattatgattatataaaaatatgaaaaattagttttatagataattttataataaattaattataaattttataatttaatgttacattagatcacattttaagacgaatttgattaacaatatcaaatgaaactgaaaagggcaagaagaagctgagagagaggggatcatccatccatgtagggaagccaatcgattccttgcgcgtttgcttgcttcgatccacaccactgcactctttacttcaatcttctcaaccctacttattcattcattttccgttaagtaagggtttctcaatcgtactcctccatgctcgtagctcgagaatgctaggttaacgctggcttagcacgtagctctaacctatgaacctccggaacggttaactgtttgttccaaacccaccgttccgcgaagaactcgtacgaattgacgatgtgggcttagtttcgttctctgtttccattctgtttcacttctttttctaattgatctgctgtatcgtttccgtgctcagtgccaccatgcctcgtaaagtaaattacggactcgattacgacgacgattactatgatgatgattatgatgactatgcttatgatgatgccgatgcagaagacaatggttagttactttaatttgctttattttttttttctaatatgatgctttgtttcacttgtatttcctctggtttggtgtcagttacactttacacagcttgtttcacattggtatctgtttagctctgctacattttttccatgcagtttctctgatttggagctgtggttgttatttgttaggtttcttgttattgctactaatttttttactgactgactatttgaatttttacattgtttattgttgatttattttttttctgccgtagcaggaggacctgatacaaagcaagagaccattaagcctggggtttggcaatgctccatttgcacttacgacaacgatgagagtatgactttttgtgatatttgtggtgttgcacgccgtcccttggttaatactggaacttccaacagtaacaaaacaggtaatccagttaatgaagaataattttgtttgttggttgggttttttacatttgttttgtatgaaaagcatatctcttttacactgtctaaattctaaattacactgtctaaattccatttgtggcttagggtgtgggggagggaaaactccgttgatgtggtacatacaattcttttgtcattctgttttgatatgggaagatgggacttggaatgtaaagtttctaaattcttctagctttactaatatcaacacattagtttaaatccgtgagatattttatttctatactccatccctagaaagataagctgagataaaaacttatctgaaattctggtttgtttattacttctaaggctatggcacggttgtagatacaaaaaatagacttgttattctcacagggtaggattagatgtggggaggaagcaaatcaagaatgaagcaaggctttcccgtctctctgtttgttagaaatggcaactgccttaaaatggccatatgaaagagtctaaaagaatgaagctgcgctttcctgtctctctgtttgactatcatgatgctgtatatcttgttcatagagcacccttgagtggatttgagtgcagttcagtttagatggctattgtaggaagaaacaccatactgtgaggtgtgttaggaatatggacagaatactccttataagactttggcaatcctcctcccttgactagcttttggaagtgagttaggactaatccatttctaatatggtacaagagcctattcagtattaatgttgggtcactcaaatgtttagtcttgcaaaactcacattctaaatatcctgtactgggcgtgaggcgtgtctgttaagatgtcctacattgaataggaatatggctaaaatactccctataggacttgggcaatcctattcttctgagctagtttttgagagtgaactagaccctgtccatttttaattaattgtaccatagttttcttgacaatagcaaaataatgaccagcaaatttaaataattgagctaaattgataaacaatactgactctggtattagttatttttggttttaacaacttggagggaatgcaacgctgttcctaaaaactgatcattttgcatcatccagatacaaaaaacgaaaaatattaaactgttacaaacctagaattaggaatggggaagaaaagaaatattttattgaatagtatgaaaagaacaaggaatagccaaatagaaagagcaatctcacctccaagggtttccgcttcacaaagagttaatgctcaatttacaaatgatacccgatagaaatgaaagctttccccttacatcttatttatttaactcactaacccctaattatctaatcaatagggacaggatttctcagtgtttctggttgtttggcaattttccaatttatctttttatgtaaggttaaataataataatttgctaataaaaggcgtagcaggaggatgaggaatcatcaatgaaggaaaaagaataatttaatctttttgcaaatctgataaaaggagaaaatggggagggaggagagtcagagaatatgagaacatgtatctggctgcatagtgtcaggttttcaacaatggccatgatattcctataacctattgaacaatgtctttggtgcagttgaagacataagcaaaagtcctggagcatccaagttggccaggtctctttttcaatcattacaacaacagattcccaaagagattgtattatttccaaagccagatgatggttttctgacagatgacaataacttctacaagcttgaaaatgtccgaggagaatttcatgaaattcataaggcttttagtactcaaaggcatccacatttaaacataggtcttcacaagttttgattcaggatgtgcatgtgactagtttaaacagtttcttctaaatttgatatttgaaggttatgcaatgcaattataattagagataaaggtcttattagttgaagatcagagtttttttaatgagtaatgacatatcatgatttagtttctgcaagttgtaactccttgcacatgtgagcaaattacttatttattcttttttaaataatagttataaaaccatgccttttttttttttttttgtatacagatcctttcaagtttgatgttccatccccagatgatgtggtttatactggcctacgttcttccaaaacgggtttgaaaggtatccttccctcaacaaatctaatttgcctatagagctcaagttggacaaaatgtgtttaatagttgagagagctactaaccatcatttaacctgaaagctcaatcatttttttgtggttcacttcaatattttctaaaaactttcaatccctcccccccccccccccccccccccctcccaaaagagaattatcattatcagggaattgattaggctttagctgttcaatttcaatatgttccctattaaagttgtgtccttgaatcaccctcgaaaagatttctaattcctggaggttgttttaagtccaatggcaggaagctttcattgattatgatagtcaaagtaattggaaatatctcaaggccaaactgggatttctaacaaaatctttatcacagtagctttcacccaaaaatgaaaatatatttctaggaaaaactgtttactttttccatattttctgtcttcaaattcttattcgttgtacataaatattaatccatcttatttgtgtaatgctttcagacaaagctacaaacactaaaatttctcagctttcatcaagcatcagagagaagaatgaactttctgtacaatcaaatgctgaaagttctgacaacttatcatccttaacgcaaaagagcagacagggtagttcagctgagagcaaggtttccaaaaatgtagcaattgatctacaaacaagtggtaaaacttcaaacagcttgccagaatctttgtcaaaagacaaaggtaacaatattaataaaataaattctttgaaaaatggtacaattgatattcaatcaagcaaagaaaagtcaggtagtttgtctgcactgtcaaaagtcaaggaaagtgataacattagtttctcttctatcaaagatggaaaaccagaaagtatttccagcagtttcaacaatatggctctcaatgtaagatctggaaattctgataatactaatgctaagggaactcgctcacatgtttcttataagccagaaaaatggatgctccctcaacaagctgaagatacattgactcagctgaatcttgcaattgtatgcaaatggccaattcttttgtacattccaggaaaatatttctcggaatcaatgacactaaattttttggtttgtctattgtaggttggccatgttgattctggaaaatcaactctatctggtaggttactgcacctattgggacggatttcccagaaagaaatgcacaaatatgaaaaggaggccaagttacaggtaatttcactgtggtcatcttttttgtgcttttaaagcttgatgtttctgaactcatgccaatttctgatccttttttttttgttaatcagggcaagggatcctttgcttatgcttgggctcttgatgaaagttctgaagaaagagaaaggggaataactatgacagtggctgttgcttattttgacaccaagagatatcatgttgttgtgctcgactcccctggccataaagattttgtcccaaacatgatatctggggcaacacaagctgatgctgcaattcttgttatagatgcctcgcttggttcatttgaagctggtatggatggcagcaaagggcaaacaagggagcatgcacaacttatcagaagctttggtgttgaccgggttatagttgctgtaaataagatggatgctgttgcgtactccaaagatcgatttgattttataaggcagcagctgggagtttttctccactcttgtggtttcaaagattcttatctatcttggattcccatgagtgctatggaaaatcaaaatttggtggcatccccttctgatgctcgtttaaaaaactggtatatttttttattactctagatgtgattttgactttccatgatgggcaatgaagagggatatagaaggggtggtttttttaatgtaaatttctgttagaaaccatacttttcactctgtaaatttgatatatcattcatggtgtctggggctcaaaagtaccatttgaaacagcactagtaggtgatttctacctcccaactctttggtacagacatttctcaacttcttttctctgaaacaaacaaaaaaaatgtatttagagaggacatggtgtgcttacctgtgcaatgtatggtgatggcttttatactattaaaaaatgggaacctcttgttagaggagtattctgatcataaaccccccaattcccaggactgagtatttagagcataaggtttgcagatactttttggtaagaaagatggatactatttaaattggaaaccgtgcaattggatagaatccatactgttacaatggtactgccctagttaatataaaaacactgatagtttggcagcattcatgatatattataaatttataataggtgtttatatactggcaatctatgcttgcatttagtgtgataacattttagcaacaagtcactttcattttggttttgattgtatgcaatttgtactgctaaaagaatgatggttgtgttcattgtgaacaggtatggtggaccttatctattagatgcaattgactctctccaacctcctactagagaattctcaaaacctctactaatgccagtatgtgatgtcatcaaatcaactacacttggacaggtgtctgcctctggtaaactggaagcgggagctcttcggatggatcaaaggtataccaataaggcaatgttatggctgttatgaaaaatcaaatggtagattaaatttggaattctccaaattaagtgttatttaccgatatgaataactgtatttctgctagacattaataatttttagttaaatattttattctgtgtttttactgtattacatagagagaaataaaaatgttgaaaaaggactcaaaatataattaaggaccaaaaacttgtgagtttaatttatatacagttagtataattttttatacatactttcaataagatttgactattttattacatcatcctatttgttaatatgatgtggggatatggtagatttttattgaatgtatgtgtaaaaatatttcatgctgaaagtgtatataaattaaatcaaaacttattaagcattattattttataaaacaaatgtttacttgatgaactcattgaggaagcaagggatgttatctaaaattttattcaggaaaattgtctagcatgaaaattgagataataatgtctctcaaagggcacaaattttgattttctagctttctacttttgtatcatgcatgaaactatttgtccataactgtaatttttgtttgataaaaaaattgtaggtcttggttatgccttcagctgttgtgggaacagtacgttcattggagcgtgactctaatgcttgtactgttgcaagagctggagataatgtagctgtaacgttgcaaggtgtgatggaaatcatgtgatggcaggagatgtattatgccatccgactttcctgttgcagttgctaagcatttggagttgaaagtgctagtgttggatggtgcaagtcccatattggtgggcacacaggtgtgtactacagatgcgaatgacgttcttgcactttattttccagtttttttttttttattggaggaaaaattgtattttattttttccatctctgcagttagagtttcacatacaccatgcgaaggaacctggtagagtttcagaatattatcagtacttgatcccaagacgggtaaggtgaccaaaaagtcacctcgctgtctcactgcaaagcaaagtgcagtaattgaggtgaataaacaatgcaaaactcgttgtttcaatgatcttcacttttctgtcatctatgatgccgggattaataaaacttagaaggacttttattgtgtctgatttttaggtgattttgaatgagacagtctgtgtggtagagttctctagttgtaaagctcttggaagggtgtccctaagatcaatgggaagaacgattgctgttggagttgtgacaagaataatcgaagaacaaggttaatttatgctattcatcaaataagataaaatgatgataacaaggagcgattctcaactacataccatgcatctttgtttgccatcctagtctagattaagttgtgctcccagacaacaggcagctatacaagtctcgatgaggttatggtttaatatgtgaattatgaattatgtaagaatggtgaagattttttgtatgtttttcaccatatatgtatcataagagagcgtttcttttcaaaagatctagacttatgtaccatagcaactagtcgaccgcgtcggatgcaattgcgtttattctttaatgcccaatcttcagcatagattgatctacatctgcatatctataatcaaattttgggcttggaatggaaatttcgtggtattttccttgggaaaggcatttctttttctactacagtctcttggttaagtaatgtggttgggacagtctagtgaatccctgaatgaattggactaaatagtttttttttttctttttctttggaaggcttgcacaagtaaccttaatggagtcattaataggtatgtttggaaggaaagaaagggttaattttttatttaagagctatataatatttataaaataaataaaagcttaaggcagtaagtttatgtggggcaaagaaaaattaaggccactatgaggaaagtgggctgtccatgcacttggggccgaaatgacacctactttcagttgccttttcgagcaattgtgatgtttattttccatttttgtttttcatatgtatcattttatcaaattagttttgcttgtaatatggtttgatattaaatatagacatttcttaatgggatttgaactatagttagttatgtggttgcactgtttcctaggagtttgagaggattagtcttgtgactttcgcatgtgtgaatactttttttaaaaaaaaaaaaaaaaaaaaaaactatcgttggtaggaagatgctgatttaaatcatataggttgcttgacttctatcatgtacaaggaataataacatgctggtctgcacgtgtaaccttgtttttcgagttactttgccaggatctcaatccatctatagatattagttacctcctttatacctcgaagtctaaatttgctcttgaagaaatgacagcccatattaggaccaaaacaaagccagttaagcatatatctattgtgcattgcacccttcattccattgattatgtggatatcctcaaatcaggcaaaaatttggacattctctggtcagttctgtacaatccaagatatatacagttacatacagacatatcactaatcaatttgtaacaaatactcaaagttattgccccctttaattaaaattcgttaataagaggacatgaattgaactgagtatatgtgcagattccattctctacaatgttttgcctttttcattccctctcttgctcgtttttattctaagacctattatgagctttgccttagaaagaatagaaaagaaaaacttctctatatgaataaagataaagaagtaatttcagtcattgatgaaaatattttacaataatattctaacaagtctgcaattttattatcaactattgatattacttattttatcgaataaaatgagttgctgattttaaaaatgtcatatccattaaaactaataaaataagtaatgacttcaacaaggataactctttgtagcatccctattcataccataccaccatatgtgaccttcccgggaagccacttaattatttgctcaaatcatataattgccagcttatttccttctattgctttcatcagtgcatgaaacgtctagtgcaccaaaagatcatcatggtctctccatcacttatataaactccatataaagagacatcttctcacactttaaactataaaattttatagcaaatatggtaaaatatgaaacctatctgagagtctcagtctattgctggcctctctcttgatgttctcttggagtcactgctgagggaaatttctatgaagatattgagataacttggggtgaacatggtggtgtaaatatactaggaagcaactctctcgtgctttctcttgaccagtcctctggctctggctttcgatccaaggcagaatatctatatggaagaatagatatgcagattaagctgtctctggtaactcagctggcacagtcactgcatattatgtgagaaatcctctgattctgttctcatgttaaatttaactgttttacatttaatgccgttaatacatttcatgtgagaaattctcgtgtgcactaaaccaaccaacattaaataattatacaaatctcgcgccacaaaaatattctatatttaaaaagtgatcatgcatcaattgttaattggcttagacagaagaatccactgttttgtatgtaactttttagtttaataggtatgccctgttagtttagaagtctttacattgttaatcagttttttttatgacttttaatataataattataaaagtcaacaaatttatcatgacacatgacgatttagttaaatcttttattgttatcattagttttttatgattttatataattataaagtcaacaaatttatcataacatgacggtttaattataagtcggataacaatataaaaaatctttagattatctgtgtatctattattattcataacttttatgatgcttttgactgagcttatgtgacatggtgcagttatcttctgaagggccaaatcatgatgagatagattttgagttcttgggaaacctcagtggagagccctacatagtccacaccaatatctacacccaaggcatagggaatagagaacaacaattctatctttggtttgaccccactaaacatttccacacttacactattgtatggaaccctcaacgcatcatgtaaggaacataaagctttcattgtccatcaatcctataatttaattctctaaaattttactttggatatcttttttctctatgaaattatgtttggtaaaaaaatgaaaattttcatggaaccatctatgatccatatgtaatgtataactagaccattgatcctctatgtttcaacattttggctagtttcatggtagataatatccctattagagtcttcaacaactatgaagccaggggagttccatttgctagcagccagcccatgaggctatactccagtttatggtgtgcagatcaatgggcaacaaaaggagggcttgtgaaaaccaattggtcttatgctcctttcaaagcttactataggaactttgatgctaaagcttgtgtgtggtccaaaggatcatcttcctgtccttcaaactcagcttccatgctcataataatacttggcaagctcaagatttggatgcttatggtagaagaagtctgagatgggtgcaaaaatattacatgatttatagctactgcaaagattacaagcgattccctcagggtcgacctcgtgaatgcaggctttctagattctcttgagtgtgggataagtaaatttaaaattaatttgatgatttttttcatttatgtgtatttaaaattccactcaaatacggttgaatttgagtaagttcaatttgattttacttttgcttgcttgaactgataattatatctctgtttatttacttatttttcctattctttctaaacaatgtaaaattattaaaacgaagtgaactcttcattttaaaggtgttccaaacatacaattttatttacaaataagttcaatcccatatttacaatgaaaaatgctaatcaatactcttatgacacaagttaaagaataaaaaataaaaaaattattattagagtgcactgttttgtaatttccaatgtaacctcaacctattttcaataaacttttttatttattgattccttaactagtttttcaagtacacctcgttaacaaaatccttttacagtacgttgaaaaaatgataattgattttttcatcaaatcaaaccaattccattcaaaacgtgagttatattattatttatttagtgaaaacgttctagagtaatttaacagacaactgatataaactctcgataaaaacaacaaaaatgaaaaaaataaaaaaaaaaaaaaactaacaacatataaaaaaaaaaaaaaatgaacatgaacatgaaaaaatcataaaaacaaatctccaataaaatatttctactttaatttcttaattattatccttaggacactcgttagcattttttctataaataaacatgagacaaatgaaactgttcaaggcagtagaaaccacactgctgatcatgatataatgacttagcattagagtcaggttcaacaaattcaaagtgaataacactacttgtgcttgagaaagcttttatctgcattgtgtgttcatgcacaaaaaagaatttcttttgtagatattagagaggtcagaattggcttttgaggcagtatggaaacaactcatgggtcgtctgcatgatgttatgaggaaacaaatattaattagaagggggattaggtgcttctatttagcaaatcgtccataatgctacctttgtagttctggaagcattgaaacaaaaagtaaagttcaagcggtcatcactataatatatatagcaaatcgatgtacagcaaatgatttgatccagagtacatcaaataatgtacaaaaaattcaataatatattacatataaattaaactactaggaccaatggcttcattccctattccaaccataaggtatattaatccataactccaataccttcaagcgacaaaaaatctttcatgtgttacagaagagtatcgactccttgtaccaggcaccacaaatttccccaaacctacaattcatgagaagcagttgggacaaaattttagagacgcaagtatgaaacaaaatggtgagaacataaaaaaagtaatatcagagaaaagaaaatcaaggctacattgttggccactatgtttttttttttacagaaaaataaaaaaaatataaaaaaaggataagaaatagtcgaaagcaaagcacattaggaggaaaacaaaacaaaaagtaataaaatacagcagagcttcccaacctatgtactccaaaattttgccataaaagtttgacctttatctagtagtagaaactgctcgccaaccaaggatcctaaacaaattttcctataagatggtaactgtttcacaatgcaattgcaaagcaagggtccaattgtttctgaaagcagtcactacgtatagtgcctgcgtggaaaggcgagagaaaagctctaagaaaaaaacatttcacaccaaacatcctccaaaagtctgaagcggagaaaacctctaagaaaaaacatttcacacccaaacatcctcaaaaaatctgaagtgaggattacccaacaaaacaacaatagtagccttatcccactcatgaggtttactacatggatcaccatcactaatagacttggttaaaaaccaaattcttagggatattattcaagtgagaaacacccacatgtagaaaattattgctctataaacttttgattgataaacaaaggagtttatcaaatattcaatactttaggcataaaatgcatatctgcacatattggccagaacatataaatgtttgaggaggaggaggagcaaggtagagtagttatcaatagcaaccggaggcccaaaagcacagagaggggcactaaattggtatagatggttgaatgggttgaaaaatcctaaattggcctcactaaaatctcagtcagcagtatcaaaaaagggattctcaatctctgctaggatttatgaaacacctatttcatcccagtgtagtccccatcatcacctcatgcttgcagtctacttaggttttcaatcctatttcacatgaccatctctgttttaaccccacctagcctcacccagatccatcctccatttttacactatcgctttgtttcacactcgcacaaggtttcatgttcaattgtattacactattaccagtttgtgaagtttttatgttgtatcctctacctttgatgtgtgtttgccacaatcagaaaccattcaatcgtgcaagaagtcttgctcttagcagcatttcccttttccaaataacttccacctaaaaaggaccagaatgataaacaatttttgtaaacgaatactaactttcaatttcccccctaaaaaatactttcttgtatcactttggtacattgaaagtttatcaaaagtgtatccaaaatcacattcgttagaccttccatctcctagtatgctagatacactaatcccctagttaacttgtgatatgttattctgttatacacttgccaatagtattatttacataacgggtaagactttttgcacatgcatgtattgcacttttgaccaactgaaattattaacatagtttcaaattcaagggtagatatcagcgaaggattagtcaacttgtgtatttacccattagactattgattaacaaacttgtggtattattttagaagagaaacaaaatcattatacatgggtacaagcaatcttcacggaaacaaacaggcaaaaaataacaattgcaatccacctccaaacttcccaaccccaactacccaaattcagatatatcttggacttggccatatgcaattgaacaattgaagaaaaaaaatggaaaaaattaaattcgtgaagaaaggatttattttagtaggccctagaagtccttgcatcacccatccaccatgtatatgcttgcaacataaagtagcaattttacctctactccaataaactatctcatacttacaaagcaaatcttccagatccacaagcacatgaactctcgcgacacaaaggcaacataagaaataatcactacatacattaacccacagacagaggatgggtgctgcacacaacacaaccttaatcaaccacaacattatacaatcaacattttcttcaccaccttccatccattaagtagcaaagataaataatactcatcaatctatgcatatctcttacatcactttatcaatcaaagaaagaccccaggcataaactagatcaaatccttggacaataactgtatgctctagcaccaagaataactacataaaaataccccagaggagaactgctagcatattgaaaatgaaatggagacccacatcagaaatgctggtaataaacccaaagtggtagtgcttactcagagacataacaagttcagaaccaaagaagaggctttaaaaggaaaaaaaacaaaaaagacaagtactttaagcatcaaaactaaaaccctatgagaatagaaaatgagggagaaggaggaaggggataaaagttacctttagagcagaaagcatgtgctgaggatgtgggtatgaaaaatgccatgggactgggaagagtgagtgagtattcgctgaagaaagctgagcgaagaagagaatgcaggaagctgagaccttatattacagaagtgatgagaggctcttttctttttccgaattccgaggtaatgtatttggtttgaaaatgaaaagccccaccactggttgtgttgtgttgtgtgctgtgcacccattgttttttcttgggtgctgagaccaatggtttaagaacatgaaactttgttcaaacaaaaaaaaaaaatgaaaataaaatataagaagagggtgaaaaaaagagagtaaagtgccaattttttgcatggaattttcatccactgtagttttagtctttaaatttagggaaattaaaaaaatctctcaaattacatttcatttaatctaagtattaaatttaataattgttgtcattttattctataaacatgtattaatattattatttaagtgcatgttccaattgtgtttcattaatataatagaattaattgatgaaagatgaaaatgtcgataacgagttttgttgagcgattgtgaaatgaattaacatacaatttgtggacccagaggttaaaatatgcgatttaaataacggaaaatcaattattttaaaattatatttaaaatgattagaaaatggaaacaaaaccatatataatttgatcattttgagccaatacaaaatcttttgaataagggacgacactatgtatgagattataattttcgatatgaaagataattctaaacaaaaataatcaatttttttggttattaaacctactcacataaggtataatgatatttttgtgtctctatttaattttctcatacttatctagttcttttttatacaaaagtcatgtcaatctcatctttaccaaagaactttcaaatattattttattccaattctcacctatttctcttaaatcaaacaacaacaaaagcataaactcgatctactctaacataagtcacttcacaaaaaaaatgagtacttgtttccggacaaaacattttacttcatttctcttttttaaaattatctcttttctattttcatttattctatttctctcttctaaataaaaatatacataattttaaattaaagtaataaacatatcataattgcaggatttttttcataccttgttaattctagatacttaaatgacaacaagtcacaatttcatgaactaaactcatcattcactaaaaaaaaaaacaatacaaatcgggggcagttggtaataggcacattaatctctggtgtgtccagagaccaaacaagttttaactacagaaaaaatattttgataaaaaaacgactatggaaaaaaattgctttcattttgagatatatttttaaaatgtatatgcccaaaaaaaaaacacagagatgattatatatgagtgtgagtgtgaaatgcacatataaaatgatcgtaaaaaaaaaaggattaactacaataaaatataaaaaatgtaaaataatttgtatgtaagtatgtacatcaaaattaatccattatgtacaaaaaattaataatccatttattaaattacagtacttaattttagattgttgcattcttgcctctaaggacatatttttgtattcctccccgtccagggttatgtggtgagcgatcttaactccaaaaaaagtaatgatagataagaaaactatctaaaatcatttttaaacaaatgacaacataattgacaaaatctaaaaaagataagataaaaaaaaaaagaataagtaaaataaacaactttacctccttaaatgaatccgtgccactaactcgaattattcaaaatgcaatataatctcaaatactgaaggtttatggactattttttatatatagaatatcctaatacatatatagatgtactcctatttttatacccttaagaattattaaacgcaaccttgatattttaagagaaaaaaagcttagcaaaataaagcaaactagttattaatcataatcacccaaaaaaaaagctccatttaaaagtaaagtgtactctacaactaagtataaaacttgatcaaacagtccccaaaagaacatgatctcactttagggtaatacatggcccagtccattagttctgtcttgcggatcacgatcctcagttactagaaaatcagacatctctttccattggacctaatgacatatagatacggctaaattgggattgtataaatttaaatcttatcatacttcattcttccaatatgtactaccacaaacatgaaatgatcatcaacaaagacacatgtattccaatcaatcaattacaatacaaaatataaaagtaaacccgtgtctgtggccgcaaagtaaaataataataataataatggaaaaactgtccgcaaagctagtgtcaagagtcacccttgagcaaggacagaccacatgtatattaccccagagcttaacaccttgtttttcctttttcttcattttggggtaacacttccatcaattccactatccgctacacccctttttcttatcctctttgagcagtgcagtgcaaaaccaaatatgggaaacaaacaaagaatgaatagcacaagatgagtagaacctagtaaacttcaccagccatactgctagaggggattctttgtcgtttctccacatatgcagaaggaaaccatcctgctttgccattgcattcgccttctgaccatcctgatgggctcacctgggtaagcatttggaactttggtaaacatggaggctcaaaaagattgagagattaaaccaaattaatcaagcaaatttcacgatgacatgacagtgatagaagcaacaattgatgactttatacaaacctttcgcacaacaacaaaatcgcccttagaaaagctcagttccttttctgattcagcactgaagggatgcgttgcctgcaagagacgcacccaagatcagttgatgaagaaataatagtattagtaatagtgataaatgataatcatcacaataatcaactgaaagattaggtttaggaatttagcatacttcagccaagaagtacattgttttctctgtgccattctcagaaatacctactggaggggcagattctttcttctgtctatctgagaccatctgagaagaagttccaatgagatgaaaattattgaattacgaaaatgaacacaattcatagaaacaacaccacactcgaagaaaaataagcttaaaatttcaggacagttggttctcacctcagcttcaatttcaccaagaatagctgcaactcttaaatgaaaagtcttttctccttcaacctataaaattataagcacagactataaataaaattctactccctccattccaaaactattgatgtttaaggttagggttaaataagagtaaaatattaatttatttagtctataatacccttaattaatacaggatataaatgtggttcactgtttgttgaagtggtcattaaataggctgtaagtacaatattcctcttaaagatcaaatataattatttaaaatatgagtacattcaatagttttggaataaaaagaaaagactaaacaccaatagttttgggatggaaagagaaaaacaattacaatttggcataaaagtacataaaaaaaatcaagtgttatcataccatggcaacaagcctttgaaaagtaagtctctgctgttgtgcttcaacagcggccaatgccgctgcagcttctttacctagaactgccatgtttgccttcagctcctgcatccttgcttctgcagcatgcagtttggcaacctgttcagcagttggagcttcccgaacccgtgcttgtcttctagcaatctcctctccctgattgaattttaaaaccattccaagttatatgattaagaagaaacaagtatgaacaccaaactctgaagtgaatgtaaatatgtaatagataagaaccaaggattcaccaaaaataaaaagataagaaccatgttataaaatggtagtcttcaattcatcaggaaaaaaaaatgaaagagaaatgacaatctgtgacagcatggaaatcaaagcaaaatggaaaaggcaaagaaaagtatctctcagctaccaaagttgtgagcccaagcaaatggctgaaagattcccaaaatgcagtccaccacaacaacctctcataaaagctatttctaacacaactacatccactcaacaatcaacataacaacctcctctcatatttgaatcctatagtgtccactctttccttcttgaataaactcccatatttttggtccatggcctaattgacccagcacctgcccatatcttctttgggctcaacttctcaagctctatcaacattgttatcatgtaacagctatctggagtctttctttatcaataatttcaacatatattgtttctgcctttctggtttatcatgcatcaaacaaaacatgaatcataaacttcactattcattccattccatatatgagaatgagatacagagttcgaatcacaattaagttaaaggttgatccaagagcagagctactaatccattctaaactttgacttacttgtgcctctgcttcttgtctcatccgactatatcgttgagcaagatggcgagcatcctccaaaggaacaccattgatcatttgcctcaaaggatccaatacctggaaattgaaaccattggattcatgtttctttccttatacatttaaagataatgcaaataataaattacattgacctcccttgaggattccaaatgtcatatagacttcctctgtagtatcaaaacatacaaatgttccttagattttcaccttttctgaagggtttcaagagtggcacatgtttgatcaaaattaaaaattgcgctatgtatggcttgaaagtaggaggtcaatgcagtatttaataaccttaagagatatcagtataatttactttaacatataaaaaaaagtataagcaaattggctgtattctatcttccaaactatctcctatgttgaatgatcagtttgatactcataacctagagatccacatcagagtttttttaaacattagtgtcttgttcatctgaactaaaactaaatttcacactgaaaaggtcatgcaaagtaatattgaaatggtgacctggtcccccatgcatatcatacacaaacagtagcagaatatggctatttatgaattagaatatctaaatccagcctcatttatggtcaagaaacactatatactgaaaaatatagttaaaatagcaacatggagattttaaactcctctgtaggtcaatgaaaagattctattactgtttcatattttaagcaccaattctttatcaacttttttaaacaactacttactcagctaatcattcacttgacaattagaacacaaaatttggtcattttaggacttcatcttactttattttccagtagactcttcaatatgattaatgtacaatagaaaaaacatgacagtgattgcttacaaagaatgccctagaaattgtagtttagtacagtaaatatcaattgacaatcaacatcaacatcaacagcacctttaacccaaattaattggggtcggtggtagatgaacccaatgataaatcgaaaataaagcaaaagagagaaacagagttaaatataaaagaatggtgagaggagaagagaaaagaggaagaaaagaattaaaacagggaacaactggaacatagaactactaaagggtttaaccctccatcagacttatagcttttctccactccgtcctaagacataccgtccgccaatctaaatcccactccattaggtcttgtttaactacctttccccaggtaagttttggtcgacctctacctctctttgtatctagctcttggtaacatactcttgttctaacaggagcatctaatggtcgtctcataacatgcccaaaccatctcaatctatgctctctcatcttttcacatactggtaccactgatacctttcgtcgaatatcctcatttcttatcttatccatcttcgtgtatccgcacatccaccttaacatcctcatttctgctacctctattttatgctcatgttgcctatgtgctggccagcattccgctccataaagaattgccggtctaacagctgttctatagaattttccttttagcttaataggaatcttgcggtcacacaaaaaccccgatgcactccgccatttcatccaccctgctttaattctatgacttacatcctcatcgatctccccacctttttgcaacattgatcccaaatatctaaaaacgtctttcttgggtacctcttgcccaagcagatgcactgtgtcttgctcaccgtctttaatcctcgaaaactcacacttcatatactccgtcttgctcctacttaccttgaatcctttagactccaaagtgcttctccacaattccaattttctattaacgccatctttggtctcatcaataagtactacatcatctgcaaagagcatgcaccacggcacttcttcttgaatatctttcgttagttcatccatcactaaggcaaagagataaggactaagagctgaaccttggtagacaccgaccgtgatagggaaataccttgatgttccattacaagctttcacacatgtggtagccccatcatacatatctttgattgcattaatatactttaatgctacctttttcttctcaagagtccaccataagactttccgtgggactctatcatatgctttctcgagatctatgaacaccatatgtaagtcttttttcctttctctatacctttccatcaattgtctcatcaggaaaatagcttccatggtacatcttcctgacataaatccaaattgatttactgaaatcttggtctccctccttagacgatgttcgataactctctcccacaacttcatagtatggctcataagtttgatgcctctatagtttgaacaattttgaatatctcccttgtttttgtaaataggcacaagcatacttttcctccaagcatcaggcatcttgtttgtttgaaaaatcctattaaaaagattggttaaccattttattgccacatctcccaatcccctccacacctcaatagggacatcatcaggtcctaacgctttattattcttcatcctctttaaagtctctttaacctcatatgtattaattctgcgcacaaatcttctattcagatcattagaaacgtcctccaattccacctcactcttgtcaccatttccattaaaaagattgttaaagtagtgtaaccatctttcacttacatcttcatcccttaccaaaagtttttgattttcatccttgatacatctaacttgggtgagatctttactcttcttatctctcatctttgcaagtttataaatacctttttccccatctttgctcccaagatttttatacaaatcatcaaaaacttttcctctagcttctcgcactgctttctttgcatcttttctcgctactctaaatttttgcaaattctcctcattaggacatttatgcaagaagtatagaaaaaaaattcatatttcattaaaaatatcgtttagttaaaaatattgtatttttctttcaaatacatgcattgtttctaatattattaataaacctagtaattattattattattcttgaaagttgcttttcaaactaaaattactcaaatcttttttatgttacatactaaaatcttatttgatattaactatgttatgaaataatttgaatgattttgtcattttatatattgacagtaaaatgctagaaatactttagactttcttataaaactttgatcaataatttcgtaattgataataaaataaaatatgacaaatattaaattaaatgttaaagaaaaatatagaagagagcacaaaacagagagatgaaggatctgtattagagagatgaacaatgcaaggacagaacagtgaacagcacggcagcaaaggtcgcggttggccagaaacagtgacaggttcgccagaaaatggccataaaggtcaggaatgactggaaactatggagaatagaagctgcagaggttggggatggcaaaaaactcacataaggcccgaaaatgcagggaattgccaaaaatgttgccagaaaagggtgtcttggtggaaaaaggataacaatatgtcataacagtgtgtgtaagtaattgagaaagtagagtttcagttgtgattcaaagaagggggcaaaatcattgcccactaaaacaccctaaataaagttgtttaatggttaaattaaaataggtttttttgtgacccactccaataaagcctgctccaggagcaatttctgctattttgctagatatgacagctgtgatggtcgctactgatacacttttcaattttcatagcatgctctagccgctctgcaatgcaattctgcgctagcaccactatttgttgctattggcaactagtcatataaaaactgaaaataattctttacgtgaaatatgttaaatacattcagcacattgctgatactgaatgaataaagcagcaactacttccctatctgaataattaaatgacataatttcctttggtgtcaccatgtttagcatctaaatgttttaagttttcttaattaaatgagtttttcagcacttaaaattataatcttttcaagcaaaacacattcgacgtataattttacaggtttatcaaacatgcctttaatgtaagtaaaccaactcgtgcatataagaaaaccaaaagcaatcaatcacgaacggtgacaaggcatctcaaacctgctttattatcttttttgacgcatcttgtaatatttttggctcagtaacgactttccgcttttgggcttcactgtttgaactacccctacccacagatgaaactggggctaaaggtgacaaaacaggtatttccaaagatgactttgctatcgaatgtgtagaacttgaaattccctgaaaggaaaacattcaagtaatacagtacgaaaaatgaagctaagagggtatgatcatattagcaaaagcaattcatacagagatacaaaatagtaaaaataagaatcaactcattagtcattggaaaataccaacatgccaataacaccatgcaatttgaaaagaggataactaaaaattacctgatacgtcgtattgtgatgttcatttagtcgagtctcttgaagtgcagctagttggttcatcatgtcagcctcctcgttaattggtgaaaaaattcggtcaaaataattgggtcgaccagcatctccccactctgctacattccatttcaatgcttcccaccagatgctttctcctttgatgatcttcaaagatttgcttgacaactctgatttggaaagactttggagacttgggcaataataaaatatcatttcttctataaaaggtccaacatgtatgccattgaaaatgttgaccaattcaggaagatagagaagcgatatcattctcaacttggggaggaaaaacactggtttttgttctggtgtggcatgacttatcagggtggttacttttggacagtcttcaataataatctcctccaaaaaggaaagttttttaagagaatctaaggtgaagatggtggttaacatggggcaagtgtgtaatgctatagactttaagcagagaaagaagggactactcccttcgcagacgcttcttaaattcttcatatagaatacactcaaaaacttcaacattagagaagctggcctatcaggtgaattgcttccactgacaattgtttccatttcattacactctgccaatatgcatacttccaacccccataaagacaaccttctttgacaatattttaaaaaaatcatttgtatctggaaaatatagttttatgaaattacaacttaaaacttttcaagactggagttaaaaaactgacttaattgggaaaaagcacagagagtgatatgtaataccagtgcacagctaggaatactcatataaattaagatgtggctaagagataaaactaatataatcttgttttgaacttgtacacctgaacaacatatgaaaagtccacctgtgtagataaaagccgatttaattcttcgtgctccttttccacatgcttgcgggcatcaccatatactgatgcagccttagctaatatgttgtcactgttgttctctgctccatatttacagcaatcctcagaaagtttcgttcctgtctaccatgggtattgtttatgaggatttaatcaaatcataagtcgataaacaaaacttacaggtgcttctcattcctgaacacatgctatcaagacttgtcaaagtaaactgaatttgcaggaaaaaaagaaacaaaagctaattttcacctgtttcaatatgcttataacctatagctgtaaatgtttctgctgctttaacaatttctttctggaagtcctggatcagaggatagttttacgcacatcaatatacataaccaccacgaaaagacaaatcatttaagataattttttttatgaatgttgtatgacaactactacaactgtggttcagaaaggctgcacagccatgtttaagttaactccacccccaggttaatttatacattccccatctctctctacatcacttaaggtaaagctgattaatagaccttccataactaacatgtattccaagagatataaggttaaatgtaggatatcaatgtttggggtaatgacagcagctacaagaaaatcattcaggataactacccccaacccttcttttccaaaacctctttacaaactgccaaatccaagcttgacataaaaaatggatttaaaagttgttgcaaaaaaaggtttaaaaaaaatgtgagtccataaatctggcaagcacagtaatgtcactcaccatgcatgaacattgaatagacttccctaataagcatatataacattctattttgagttaatatgaaataggaaattccttgctgctcaagcatagcaaagctaacaatcaatctaaacacaaagagaaattgcataccttcccagcacgtgtggccctgtacagcttttccagctggtggtgtctctgcatttcgacctcatcgatgaccacaacatctgaactctcataaccactactgctgaactgctttattactgcctgaatcacaagtacactgacaaagattacaaactagcaattggaaaacattacttttccctgttactataaaagtgtgaatctaaactaataaaacactatggttggttgatccacaagaatgtgccaaacacaaccagggaaataataattcaacatcttgcttaagaaaatgagcgtctccacttaaaaaagccataacattagtcgaactaccccattttcaattgcatttcagaacaacgaaagaagaactaaaacgtcaaaagttatcgccaaatactgggaatttggggtacccagatgcgaatttgagaagagaaacacggtacttgaagtgacaacacagaaaaagacaaccttgaagggaagtgagagcaaacctgttgctgtttggcaacttgctccctgagcttgctggcttgtttcctcagagcgtccatggcagattctttcagctctctattcttaattctcagaatataaaagacagacaacaaagtatgaaatcagatccaacgaatgttatctgagaacccagccccagctcagctaaacgttgtcaacttgaattatgtcactcttttcccctcttttttcttcggtaaatcccaaaaccgtatgtgtaatatgtaataagaataaaccatatatgcaataaaccatcaatttggcaatgatatatcactctctcttttaaatatattcttaaggtattagaaattatgttatataattttttaagaattgaaaaaaatttcttcaaattaatctcctagtattagtaaaatacaccaatccaaacactaaaataaaattatagacatttaatactttccaaaagagagagagcatttgattttttattaatgaaaataatttagtttctcaactttgacgttaataataataataataataataataaatcaatagttacacaattcttttcctccacttattgataattatgttgtcttaattttgaatcttcccaaattacgacatcaagaatatgatctaatgtaaatagtagaaattaacgaatcgatatattttaataaaaataaatataaaatttaatataatataaataattttttaaattcaaacatataaagtttgtatctacagaaaccactttttacaataatttatagcatataaaatggccatttgaaattaagaagacgttgctctaaattttacattattaatagttagttacgcgttttagaagattattttcattaaaatggtttccgcttctgaaaggtgttgttcattaaaaaataaccaattaaattcagtaaaataaataaacacaatcaaaagaaaacctatgaaaatccaaaagcagatcccagaaaaggtaatttgtgattttaattaatgattaccataaaaacaaatttgaaagtttgaaacttttctcggtgggaagcttgaacatgacaatgatatgacacgcttttcacaagcctaataattctctttgctgtgtcactgcattgcaacaatatatattcagagcacaggagaaacattcgtacatacatagctactagcagttcactttcagtctctgtagatttggtttgtgttcatttccccactgaatagtgaggggtagcatcgcaacccaccatcttatttcactctccacatcatgccttcaggtgctaggaagagaaaagctgccaggaaaaagaaggcaaaggaacacaacatcaacccatcaaccaacaacccccaaggtaccatttttcactcaaatgcatgtgcatctggcaattaatcatagatgggtccttttcagttgtgcattatatcttttttttggtctttttgttctattagggtagatggagttctgttaattattcttgttttgtttactttgatttggaatatgcagcagtgattcattgtggttggggtagtcgagttgggtacactggtatttattaatttggttgttttaattgataatagcttgattgattgtgtaaataataggaaatgatggtttgaagtcacgagatgagaaaggaagtgatcgtggtgagggtaattctcctgcatttcatgaacatggtgaccatcgtaatccattcaatgatggaagtgaagatctggaagagagaggaccatcagctactcaaccgtgtgcttctgatgtcgagaccctggaagaagtccctagtgatacttcaaaggaatcgtgttatgagaatgggaatggtggcgatacttcaaagggtgaatccctcgctgagaagaactcagaggatgggaattgtaattcagttgaagaggcaattgcaagtcatgagttggttaagtccattgattcttcccctttaaaatgactttgattactgaaatggcaccagttgaggagactgttgattcagctgctaactcttctgttaatttagttactgacatggcttctgtgtctgaggtggaaaagagtgatactggaagtgtgttactagagaagtcagtagtccatccggtagaagtgaccaacgtcgcaatgaagataaacgaggataacacatattccttaaccaatgagaatgtgacaatgtcaagtgcgggggagcctaagccaaaggaatgtgatagtaaaatgttaacttcactgtctactagtcctttaactaaatttaccaatggtgcagaacatattaaggattgtaagactgcaaaacgttctgaaaatcaggttttacattttctcacatatacactacaagtttttcatctcaattatgatttgtaaatttttgtgaaaaactaattttaaatatatttttctttgctgaattaatttgcagcctcatgtagcattggctccaaatttggtgcaaaagacccctggttgagttgctgtggattgtttgaagttttgtcaagttcaaatagataatttcaggtttttcctttgaagttactttaccttgtaaaatcatgtttgtgtgggttctctttcaacttaaaaggttgtgtttacataaatttgctaccctcatgtatgcttgcttatggttgtttttagctttagttttgcaatttttctaattggtttggtaatttgcgctttgtgacttttaaactattagagggaagtttggtggtgttttctttcactttttattgtttgtttgtctttggtgaatgcaggtgtgtcatgggtctttggaccaatttgtagatactagctttaatggtttcagtacaaatgaggatgctaaattattgtgactatcaatccatgctattatatttggtcatttggtgcatttgggaagagcataatgctcatatttttacgagatatgcttggctgagcagctattttggaatgtgattaagcaattagcatcaatttggttttaaacacatggtctttaaggggatttctgtaacatacacggggttaggtaacttcgctccattagtgatttgtatttttctgttattcattttccaaattctttgttatggaggatctcttattctccaattgtcttgtaattttattttcttcatgctgacaccgtcttgttcatgagattcatgagcacaaagggagggtgtgattcttctatacctgtgtgtgtgcatatcattctgaaggtcatactctgttattattctagttcaacttagtctgagcgttatcaaatattcatgccttttggatatggatttaaataattaagatgtacttcttagttcttcatttggtatcaattggttttttaagttatattattcgttctaataatgctcattttggggattattgttgtagtatattgtgtatcagtatacaatcatacattttaaacttgcaaattacgttatgtttgacaacatcttccctctgtttttcttgcagaaatacaagatacaagcatcaagcgtgagtatctcaactgatgggtcaaacttgtgaagatttagaagaattttgtgatattttgatttagattctctcctttaagcttttcaaaaatatagcaggcaaccaggccaaagtgtataatccatacaacttttgtttacattacagtggggtttgtttgtagttattgtgctagcaacaattacagtcttttaaactgatttgttaattctgcgacatggaatttgtcacaatactgtttatttcgccctttctaattaatgtagagcagcagtgagacctagaaactccttaagaaaattcactttgatctttttcatctaatgcacgattctcatgcataaagcacttagaacagtgtttgcagtgcagcgcactttgggtgcaactttaaaagtttatctttaatcagattaactaccagaaccataacgaagcaggactcttcgtgttctaacttatggtgcaatcatacctcggatgtgtccctgttcaaatgtccttagctatcatcttgagaacttcattgtagactgatgaaactttgttcttgccctggtcatggaaatgtccttctttgatatttggtttttcttgtcaaggttacggttcaaagattactctttcatgtttttttgctctagaccatcctgtggataccaactgaagatttcgtaattattgtgtgtgaattgcttttctaggaaatatatcctttaaaaagatctaaaaacctgttgactttgcatacatggtctttgtgtaaaaatgtttgggttttattgtaccccatgttcgttaaagacttataaatgcttatcaaggttatgcagcctgatgtccctatcatgatcaatgctcacagcttactcctaagaaagttggaggaaaagaaatagaaaataaagatagtgttctcctttattgctcttgtaaatggcatattcttgattcatacaaatccaaattccaatcattcaaatcaaaccacaatgctaattctcctttaacttgtatgaattaaaagtcttgattggaccgacagaagagaaaagaaaaagcaagagggagagaaaaacacaagcacaccaatacaatccttcttggccaacaaaaaaagaaattccttcaaccttcaagtttatcttctatacgcagcagcactgtgaatagcaactatgtagaaaagctgtgtagctgaaagtataatgataaaagcctccattgttttctgtaaaattggacatttcagaggcctgacacttgaaaatatactacaagaaagttattaagaaagtaaatgaatcttcctgtcttaccaggcgtgcatttctgatacgaagctcaatctctttccaggcaaagcttcattaatttaattatagttagataattaaaataataccacaaaattatttttttggaggggataaatagaaaatagaaatcatagagaaaagattaccccatggccaggagtgtaagagtccaagccattgtagcaactgaagctgcagatggcaagctctcagcagtccatgactggatatgattgattcctgaaattgctgatgcagcaccaaccactccagcaagcaaagcaaatgtgacaaagaatccagtggatgcattgcccattgggaagaacaagggtgaaaagtgtgctggtagttttaattctggacctgcatagtgcatagtttctcaacataagcaagctgaagaaacacaaagaaaatgattggttacatgagactatgagaggacacataggtacatttggacattttaaattttcatacctataataaaaccatgatctattgctctgttcatggcccatccactaatgcccaaaactatggcatacatgcagaagttcagccccaaaagaagagtggctataggcttcatttgctcattagccatatgtgttgctgtttgttttttggataaggaaaaagctgttttgaactagaaaagtactaggggatttcaggaacctaaaaagcagtgaaggaaagtctataaatccaaggaccaggagctgcatatctttggtacaaatgagagttcttatatatatgagaaatggataaaactgaaggttgggttcttttcttgacaaggctgctagttagctaaaaagcttcatgcaggcctgtaaagatgatgcttcacaatcatacttagacattaaattaaaatatgtatgattcttacttgtctcttatttttaaggtttgtttaactgtaaataccttcccaacaggcaacttcttaggagttgtcaattgtttgttctctgaggcaagtcatattctttgccactcctgaactcttctcattcacaacactctggcccaatccctattaaaaaaaacccttacactgtttctaacaaatttaattatatcgcgcaagtatttattatttagttttatatactaaaaaactttttatttttattaaaacagttgttactatcccaaaaaagtcagatatagaaaaatatgaaaattctaagattagttaaaaaaaatattttgttatttgatatacaatgagacaattacataaatgtcttatattttataattttgttagtaataaaataaattatactatcagcgtttaacacacatttttgtttacaataagtgataaaaaaaatactcatctctgatatattaatatcaatatgattttttttccaaatatattgtaccccttcctttattatcttaaactttatacataatgcctaaatctataaatttatttaaatgttaattgactaaatctgactctgaaatgtatgtgaacaaaatccaagttaaaaaagaaaagaaaaaataaactttacttgagttttatagtaactaccttgaatactaatggtgattcttaattgattgacgtgtaaaagtgtttacactggtcacgtacgacaattaaactcaaaagaaaaatgaaaactctaacaacccttaacttctcttaattctgtaatttttattttatctttaatgtgcaaaaaaacataatgccgatcgacagtattacatgactatgagggtatattccattcttctttataaggtcacaaaaaaaaatgacgttcatcaatatttcttataagttggttaatactataattcgaaccatgcctgttgaaattaatttactttaagaacaaatatattttacagttttcataaagcaataaaaagggatatttctaaaaaaaagtaaatgctcaatcacaaaatcaaactcaaaatctatataaattaattgatataaaattattctaacttaattgagatctcaagttcaatctgagtaatacatcaaataatcgaggtagagtttatgctcatagtaatcccacaagacttgaacaaaattatctccgtgaaaaatacttgtaattcatataaaagtatctcatcgcatgagattgctttaatttaaccaaatgtctcattcaaattttgagtatgcaagtatgttctcatgtgaaggatataaattctacataaataaatttttctgcattatatataccacttttatactaaaaaaaatactttcaataaatttacttgagacccaagacttacattttctacaaagctaagtgctaaccaccaaaaattaattcggtaaagtaacaaaaggaattagctattttaaagcaaaaatatttttaataaacgttacaagagggggaaataacatattaaaataataaaataaaataaacttctcaaataaactaaaataatcttatatgccacaactttttaaaaaaaaaaagttaatagagcttaacattcttaccttaaaatagttttacatttaaaaaagtctcataggttagaagttttcaaattgggccgaatgtatcaatagacatttattaaatggaggagttggccaagctttccataaaatccaaaagacaacaacctaagccaagagaaactactatttgggattttttttttattaattattatttgaagttctttaattattattcaaaataaacaagcataaatctattataacttctgaacgaaaagtcataatcaatttactcttctacttttttaattgaattcgtaaaatattttatgattttaattaattttttttataaatttacaactttaaaatcataaattaattttttaatttttttataaaattcataaattaatttacgacttctcttttttaaaatatttttttaaaattgtaaatattttttatttaattattaataaacacatatattttttttttagttttatttaatatttttatatattttttatatgtttaatttaatatttttatttttttatattgttcattttatattttctatatttttatatggttttatttaatattttcctatttttggtatattatttatttaatatattttttatgtttaattttatatcatattatctaattttttgtataatttttatttaatatattatatatatattttatattttttttttactaatgtaagattattatttttttataaattaaaaataatataaaagattaattaaataaaatatcagaatatttgttactaatattaacttataatttatcgaataatattaaaaatttaattaatttttaaattatcattaagtaaattaataattttgtacaataatattaattaattttattttaaaattattttaatattaataacataaaataattcataataaaaatagttgttaaaaaaaaaaaaataataattaatataaaataaacaatacaaattaaacaaaacataaaaagtataaacaatattaatagtcaatttgcttatatgaaaaaattactataattatgttctttagttctaaataataaacatttcatttaaatttaatcttttacattattttttaatttacaaaataaataataatccttaacattagttaaaaaataaaaataaaatatagaaaatatattaaataaaataatatacaaaaaatatttaaaatattaaataaaaacatataaaaatatacaaaatattaaataaaacaaaaaaagtaaaaatacttttatttgttaaataattaatttaaaaaattatttacaatttttaaaaaattataaaaaaaaataacaactttaaagtcgtaaaaaaattaatcatatgattttaaagtcataaatttaaaaaaaaaaaactgaaaatttacgactttcaaaagtcgtaataaatattatgacttattcacttttgagtaataattcaaaacaaatatccaaagtaattaacaaaaataatcgaccccagttgtttgcctctaagccaacacctaaactgaattgcaaacatccgtagaggcaactcaaaatttgaaaccttgaaagacatgcacttaatttgaaagaaatatatctattacactcgtataatagattttgttattagaaagaaatgaactaatgagtgaatgatataatttattcatcagcactgaatcacattcctctttttcttcgttaagttttttggttctggataaaatgctatgaaaccatttttttttttcattcagaagacacagtcaccccaccaaaatctacagtgtagtacaaaggcatgttccatgcatgcaaaaattaacactaccaatcattatggctgataaacctcaggaagctgaagaccaacactagaagcagattttccaagagtcctttttacttcatctgacctatccacggcaatattgtatgaaaaaagtaaatcctgaaaaattgtcaacaacgatgcatgatcaaaaagccagatggacaaaacgtagtttttcttgaaaatatatttattcacaggcataaaatgagtaaaaataattatatcaatgataggatacaatctgcagaggatttctcccggctcggccacaccttggtgatgctgatcactagtcaaaaaccacatcctcttctgtgcttttaatttaactatatacataccttaactaaagctgttgagtgttgacaccttgtttttaactaaccgagtttgtgtaaatctcatttgaccaataataactgttcaatcaaacttcttacccacaggcacaaacaaatgactatttgaattttgaagcaaaaatgcatcagagagcaataccttgtgatggtgtacactgttaagaagataagtataatcacgagcaagctttattttctgttggatagacacattgtcagacaaattttggttgttacggaactctgaggttacaaattctataaaatgtttcttgttctcttccttcccaatatgtttcttgaccgccttgagaagaaggcgataaatgtgagctgtttggaaggcgtcggatctcatttgtttctatcaatatccactacctactttcctgcataggatgacaagttttaaatataaacatttataggaatcttgtttgcagaaaaaattaaaattagaaacctaaatgatgagagggagaaggtataaaagaaagaaatgctactatagagaataaagaaagattacaacagaaaaaggagtgcaaaatttcatcctaagaaggtgcaaagaaacgaagaaaagataaagaaagttgtatagaacgaggatcttcaattcctgtgtaaactaggatcaatcttgggtttggtagagttcctaattcaatattacgctacagcaattttcttcttagaaaatcccagaagacatgcagagaagaagtttatcctatgtttatgtataaccattccattacaacatgcacttaacacaatttgttgcatctcagaaaatattttacaaatgatgcaactagttcaaaacaacttgacttattgtactaaatggaagccatgataattcaaatttgaagtcaattccatcaacaactgaacagtggaaaatacttataatgatgccatgatcactctgcaagaaatcatcaactcttggcttgaatatgcagctacagctagcatatttttcagattccttgctctgtgaacactgtcacaatgcatatgcaagatgttgcaacaagaggcaactaaattcattaaacaaaaatccaggtgtgtatttgaatggtacatttgaaaatcctaggaaactcaattgcttcaattgaatttccttcatttgtaaaatttgttagtctgaatgagtaatcagattccctccattcataaaattcaatattaggataaagtaattaaatcccctcaataacaatgataattttgatatgttatgtataacttcatatggaatagacaacatagagcttagcctacgagaaactctaggcatatactgtgtgtcatatgatcatatatgtggtctaataaacaactgagaacgaaagcaaggggggtacgtcaaaagaatttgttgtgaacattttcattaataatattgatcatatatggggtctgataaacaactgagaacgaaagcaaggaggctgaaatcacaatttgtttgtggctcccaatgtttcagaacacacatcaaacagtttgtgagcaaaatcaaatatactgcaaaagtaaaacgcaacaatatgtggagcataatggaatgggcaaacaaagtaccatacaaggaaaaaataaataaaagtcagatccacaaacacaagtgggcagttagcaaaataaacagagagcaaataaaaatgaggaataacacagcataatatcatattaagaaacaactaaatatccatattttgcaactatgaaaatgcagaaagaaagttcattgacatttgtagaagaagcgattgaagtactgcaagcaaatcaacgaaaatcaaatcagcgttgcttacttcctttcttactcgctgtggacgaggctgaaatcaaagcgttgctagttgcgtttgcgttgcaaagaaaggtgtctctgcctctagttatctaaacgaacaaaaacttgtttaaaatgaaaagaagaaaaaaaaatgattaaacgaatttataactttcttcgaataattaaatttagcttttatatggaaacatataattttagctttgaaaaaaaaattgtgattgtgggttaaaaacatattgagtattgagtagtaattaataaaactgaacactaaactaattaatctaattgtttgtaaggtttttaatataagttattaaattagttaaaacatattatattttcgaaaactaatggtctaagggggaaaatattttattagaacagtctatccatttatgtgtgtatatttttttgagttaaatgttattaatgtaattgtgtaaaatatttattgatttcataatttctgtcgcaaaattgattaatcacttttaagttaatgcatgagtcgagctggttaatattgctttgtgcaaaactcgtggaaacccaagttggtgaacaccgctttgttcatttaaatatttttaagagtttaagggctttgttaaaaactgctaaacaataagaacctatttaagaatttagtaaaactataagggcctacaaagtaacttaaaaaaagttgatgataattagataaagttcagaaacaacaaagagaataattaaattagaagatgctaatatgccctatcattttagtatcaatagggatgggtagtgatgtccaacaccgagtacttcaacacccatgaaatgtcattgggccacatattaactacaacaatgatttctcttttttctttttgtggggtggtggatgagggtgtcaattgtcaaaacttaaaataactccagtttacaaatgagagaaagtttgagtaacatcaattcaggaaaaattgatagaattgtgtctaagatggtttggacatgtgagaagaagatcaatagagcctccaatatcaaatggaggatagcctactaattagaagtatagatagaccaagaaagactctgtgaaactattaaaaaggatctaaaattaaatggcttagctgaagaaataagaattgcttttggaagtacacaatgactgttcaatttatgcagctgactccacttagtgggaacaggctttcatttttgttgttgttatattaacttgcctttttgctggccgctcaagactttgtaaagcctcctggagaaatttggagtttacgccaacaatctgatcactaagcaagctccattgatctttctctccatattgaaatccatgaaatacatgtttttgctccatttcaatgagtttctttttggctgctatgagatgcttttgaaactttttcctttctttccattcctgacaccattaagaaattatccagaaccaattaaatatttgtatcaattatccacggcaaagagcacccagtcaaatattgatatcaccacaaagaaattattccgaaaaaggaaatttagaatccaaataatacaagtacaaatgttgaagtgtaaagcagaatgccaccttatgaaaatcaaattccacttgggttggtataatgtaagtctgccagcatgacttacatacaaatggaaaaaaaaggtacaaaaatcatatccaaatgatagataattgttccattttttgtgtgtgggagttacagcacaattcacctttgaatggtagatactgagatatgtaacatagcagcaggaataagaacaaaactaaaaaaacatattcagtgacaataaaaactcataaaagtaacaaattagtagtaatgcattagggaagtatggctcactagttggcgcctttcttttttggacctctcatcaaatcgtaaatttaattctaggagtcccttgggcggtgtaacatgcatttctcttcttttcatatcaacatctggaacaatggcttcaacgaaaggtaccaaaacaagctgatcagatgcatcttctgctgatcttgacttgccacttttgtcaagcatatcaaaagatgaatcgagtacaatttgtagtaggtcattggctccactattgaaaacattcacaacagttcccacaagtttttcattttccagatgggaacaagcatggtcaacaccttcaaaaattgcattgaggattacaaaatcacaataagatgacaaaaataccgaagtagaaaattcaaagctcatacaaaccaatataacaatatctttaagttatttataatagtccttttcatttttatcactatattagcacttggtatttcatttgctgaatccttggtacaaagggacagctagcggtcacatatgcatctagaaaagagcttaaaaaaaaggatagttcagttttatgaaagggaacaattatatggtaaacaattggcatttctgttacgatagcacacttgtgagaatcgccaagttaatactgaactccaaaatataacagaaaaacagctgatgaatataagatagagaatttcatttcattagtatttagtaggtgatactttagcaaaactttaaataatgaacaaggaaaggagaaagtggtttgtcttcatatatacacaagatatgtgactaagaacaaaccttcataaaaactctcatccctatcagatcatgtgtataaaattcaccctcctctaattgcggcctgtcttcgtccgtcacaagcaaggtagcaccaataagcatcttagcctgcatgacatattgattagccaaggccaaaatgcatgcatatcatatgatcacacgagccaggtctacataggaaacttgacgcttcccacttgcaaccacaagtgctacatccctttcaaggatcaataaataaaggcgagtagaaataattttgacagtgtaatatctatggttgttattgtggcatcaaactgactttaaaatatgattagtcaatagatgaattcactaaggtgcttccactttcttgaattaacatatacagatatacttaaatactgaaataagggacatttggaagagcttatttgggctaatgagaatagcttacgactcctatataggttcttttcagcttattttcaataagcatgacttatcaaaataagctctttctaacttcttccaataactttcatgatcaaatttattagttatgacaaaagctctcaagtgacaagaactcaatgaataagcactaaattaagtgttgtttaccaagtgcacccttgttactaatcaacactcacttcattcatccaagttcaagatgcacgaaacatggaagagaaagaaaatgaatcagttaaaaagatgagagaaaaaatatatgcacggatagtgtaaagtattttttacatcaccatccaatcataaattgtcacaggtttattgacttttataataagacaaatgctaactagtacccttagagcattaaggactaaaaggagaaagattttattgggatgcacaattcattacacttttttgggctctcccatgattcccacaataaatactttctttttttaattccttaaccaatatcctaaagaaactggttaacaagacccttatacttaaaagttaattgtttctaattggttgagtgtaaaattttctatactgcatagaaattaaactctattgttcgtacacaacaaagatgggctggtaaacaaaatttgtaaaattagacagggtacgaggtattgaaaaacctgctccacggtgtcaattcctctgaatttgagtatccaactcttgagtgcagggtgctctgtaccatcctccagctcaacttcttgaacgctttctccacccaaaaccttgctcttcaaccatcttctcccaggctactcaacaaacaaacttagccacttgaatttccacatttccacaaacacaagaaattaacaaaaatcattacagtggaaaagcgcagttgaggaaaatcggtggcgggcttgatttaataaaagttagtaaaagaaagattatattcattttatataatgaaaacaagtatagaaactaaagaagaaagattatattcattttatataagttagtaaaagacaatttttatttatttaataaaagacaagttagtaacaaaataaaacttaattctataattcaaatattagaattaaaattaactaaaatgatttttcaagttgtctcgtcccatttacaacaaaggactcaaggtactccctatctgtcaatcgcattaagaggtcataattactcaaaagtttatcgatttcacattaaaacttgaagagtgacgtcaattaaataaaagtaacaacttatagttaattatgagaaaattaaaaaatactaagtagccttcagccgttaaaattaatagtgggtagaaatagaatcagaggtaaaaattgcatttgtatgtatcatactatagtagctatagagagaggagaaagaagaaatgtcaacaatggcaatgcgtgtgtcttccacttcaacttcaactgcactctctctcttcaatttcatgcatccgtgtaccttctctctcttgctcttcgccaccatcgctctcctacaccttcaatcctcttaggtactttccattcattctcatctcactctatttcactctttctctttctctcactttgcttttccgctttaagaaggtccttcatcggtcacgacggaatcagaagcagaagcgcagggtttcgtctgcattgctacgctcctgctcctctcaatcctcccaatttgcaatggatctctaccatttcttcagtgtcagttcacttccttttctctatttcatccttttactttttcaattccgctatttatttatatattatatattctgaacatttgatttcatggagttatagactacgcacttttaatattgtatattaattattcggttattttattccactgtctgacgagtggaagaaacatatattattgaataattatttatttctgatcttcgattaatttgccaaaaaaacagaaatgtttgttcatgcatgtaacttaatcttataatgaaattctgcgatgatggatgttcggaaatcggaacattgtttgtagggttttgatactggcgagaggccccgcggtgccgaaatcgtatattgttccgttgtttgctttgcaagcatctgcaggtgtcgtttcctggatcaagtatgtcgttcattcattctgatgttttgttttcttgttcagtttatatgctaaaactgaattgtttatttaacaattcttatttgttcaacaatattttgtagagtattattattcttaatttttacaccaattggatgtacagaggtagatatggtgtatggacagcattcttggcacttctgattcgtctattcttctatattcctggtatgttctcttatccatcacgtgaaatttaggaaatattgaagaagaaacaatttgtactgtagatctaaaagtgtaaaatacaccttttatagccctcattgaagttggtgtaaattaaagcatttttctaggaacctcaggctgggctctatatcttctctttgtataaactgcgaaacatgagaaagaaaatcctggttgtggagtgtaataataagaaaaagttgtgtattttgttttttcatacttgttggataatgattgaacattgaatgaaggaatcattttcttctgggtctttttcatttctaggtgaacttgagttgccatttctggcattgctcttggtgatggtagctccatacaaggctatgtaattaaggtaagcaagtccatctttttgggactttgggctgtcgcctcttttacctttttcaaaaagtaaaataaaatgcttcaacatctttcttcatcagggatacaaaagaaggtgctgggatttcattgttgattgcagtgtatctggctttccagcatttcacaagaacaagcttacatcaatcatttgaccaaggttcagttgttgccaccttagctatcatttgtatcactgttgtatctttgttgcttcttatttgagttggctttgaaatgatgtacactgattgtaaataagaacaatacttgttggaatgacgatataaaaaatttatggattatgttggatactcaatcttgtacttttcacttgttaattcaaataatgaagttggaatccgtatttggtatttgtcatagaaattgtgtttagaacatgatgttctttataccatagttattaataccaaatcaaaccatccagttaaccataaaactgtttcaataaagaactgtttttgaaatattcaacaaaatgaatattgcatttgaactgtggcaagttaagcattcaccatgaacacatttaagtgtaaacatgttgaatttggtgtttaaaagctagcatccgatgtaataaagtttttttggtgcttctctatcaaaattgtttaatagaaatgacaactaacaccatcaagccatgtttatgttgtgtgaccacatcccatgtttatatgtcactgttgtgaataaggtagatttttccaaagtagccttctgagcgtcctggactcaacaataacatgttctagaccaaacatgatggttttaagttctttaatgtattttattctgtttagtaaataaaatggcatgctagctgatattaattacaaggattttctatggaagagaagctaatactgtagaaaaactgtctactacctataaatccttttggcttgatcaactaacagccatacatagatgaaaggtataagtaattttaattgcaagacttgttgactctgactcgttgaaattttgcaaaaactgctggaagactgattgaattccagcgcatcacataaagaatgactgaaccttgtttatcgtctagatgtaatttgatagttgaagggaagccaacaggccacatgtgaacagcagcagcagggaataaaatgcagatgtggctgtattggggcttcctgtaggttctgaaccaaagacagttgatccgccaccgggatttagcatgcctggtggagttggggtcatcactggagttggtggacttggtgggctgacaaatgttggtgctggtggtggttgattagtgctgcattggtgagataatatattaggatgtataggattgcatcttcattaatatagggtgaaaaagagatataggtgctgcaaattctcaccttgttgacttggacgatgcgtatttgcaattcccactacctgcgatggagttagatgttattttctacttttaaggtacagaagcacaagcaaaagacataaaacaaagtagaaattgtttacaggcgcagcctaatccccttaaaaaacaattaaataaatgaagcccacaatccttagagtcatgatgtaaggaaagtaagctaattgaggacattcatccgttgctgagaaaggcgttcaacagacagcagctggaccttcatcagttgcttaaagaaaaacattactatacttttttggtacaaaaacattactatagttggtttcgtggaaggggattcattcctgtttataaaataaaatatatattttttaaaatgacttcacttgatgccttgtcgcttgctccacaggtgaaagtatgagttcctggcctggtaagttatgggtaagtagagactgtacttcagaaaatcttagatataggtatgtaaagatatatggttaaattttttaaagctagaaacaagggaagtggggtgatccaactagaaattattgagttatatagtccctcaactgcctctcaagttatagaaagtttgcataagaatcttcattttatatgaaagaagaatagtgacttgagctatccaagctgtactctaaattcccaacaggtctgagatattggatgcatgatggtatgtataggatacttgctctgtgcctgacatgacgtgttacccttaagacatgtaaaacattttaaatatcatggtcacaaccaagaaaattatcacaagaagataatcatgctttgaagttcgatgaaattcttacttggatcattgcttgtaagagatgctgttcctccaaatacacagctggtaggtgctggattcttctggtagtagtcattgaatgcataggaagcatgatcacggacagtgttcggattataacagcttgctcctggttgtattgctgagcagtctgcacctccatacccacaagcatagtcaagagcaacctgtagagctgtgtctgaagctccctggttagcaacacaccattgaccacctgatgatgttggtgttgtagttggtgtggtgggtgttgtggttggtgtggtgggtgttgtggttggggttgttggatttgtgtttggggctgtggggttttgccctgatgtgtcaggtgtttgaggagtgttagggtttcccatatatggatttcctgtgccaggagttgtgggattgacgatagggacatcatctaattgagtacccaattccgatgatgagaagatttcctgttttttgtcatttaatattttggttgttcctagacctggaaaaagaaacggaaatttaacaccttagtaggacaaatgcgaataacttttgtgatgcacttgagctaaatattaccctttctaaatcaatttacgcaaattgcaccaaatcaagttcattacagttgtacaaagaagtgtgcatgcatgactacgatatcttagaactggaaactatcatcatttgtagacagaatttatctatcgaaaaatgattgaagtttaaagataaactttgatcatattttcaattgataaattgtgtacaaaattttatggctcttgatataatggcttgggttgcatatcttctcaatccaaagttggttttgttataaatgcatggaaaaaatggtacctgaaccaaagaaaagacataaggagaataacacgaggtgccagattctagcattcattgctccaggtcggcttgtgcttggactgcaggtgtttccttaagatttattaaacaagggcagctccctgctgttcctgtgaagaggaatttcattacttaaactttttatattttacatataataaaatcatgaagaatcatagctttcttggatcaaagagagaaggaagaatataggcaaacttgagaaaggaggcatgggataattgaaataagcaagcaagagaaggtgcaaactgaggggaaaaaaggtgcatgacaaaggaaaaaggtgaaaggtgaaagggcgatctgatgcttgagagctgcaatgtatatataattaatgtgacggtgatgtctctgcaacgtcctttctcttttgtgccactcttttctactgttttatgggactgaaccaaaaagtaaagcctgagcaagtggcttgccttttgggtttgtaacgaagaatgttgtctcccttctattgtttttatcctccacctcttaacacacaaccacaagtcattttctattccctgaataagtggttcctctggaatgttttcgaagtacgattcctttcctacgaaactcaagttatctactgctgccttgtatcttgtcatgcttaagcaaccttgtctcaaatctaagttgtctattgtaacaaaccaaaaaaagtgtctattgcaaaacttaagtaacttaaactataattttttttttttttttggggggggaataggaaattcagaatgcgattgaaaagattctcaataattgcagtaagggcatgtcaaagtccccacatataaacattattaataatttacttgcaacaatcatgatgagaatatcaaagagaagtcatagtactaattttattcatatatatcaatatattttcatatagaatgtaattatcaattttttagaatattacagtatactaacaattcgtctatacatatttttcatataactcattatatgtataaacattttatacttaatatatatttttcgtgatcaaactaatttatgtattaatatttgattgataattaatttattaacatgaatctgttatattattgttgattatatttgtttgaattaaaaataaaataatcttatttaatatttttgaaaaaataatataaaattgtaatgtgatctcatctcatacaacaaaatattctttatatatattagataataaaatggaaccaaacgattttccttaaatatcggacactgagtttatttcctaaactcctcctatttgcttaagctttaaaataaagtaatttttaaatataatttcttcaaaaagcattttttataagtaacttttttattataaagaaaacaaatagtacaaacgcagttaacgtaagttcttaaatatgtcttaaataaaataaagattttcttaaaaaaaagaaagaaattcaaacaaactagcataagtaaggaaaggaggaaaattactacaaaagcagaggaaggagacaccgaagttgattttcctgaagcttttaaccttgtgggtgttggtgtcttcagttcaggtaatttgtaccctttatttaaaatcaaattactttttcaaatcagatttcgaatgatttaataatcaattttccattgaataatcaatcgagacactaatttaggcatgcaaacttaaaatctctttttttttttttcatatagctgtggaacaaagatttgaatttttaatcgcatgcgaattcataaaatacctatttttttcacgattagaacacatctagtggagccatgcgcaaattaagttcaaataattcaaatatctaattattccgcgtgaaataggtttatggcttaattagttttttagcttttagattgcaagcaataaatatttattttatataaataaaatgtataataaataaaatatttttaaatatataaattactatatttgtttaattcataggaattaaaaataatatcaaagaatatacaacaacaagactatattcaaccaatttagttagatttaatcatgtgaattttttaaaaagagtcatgtgactttttaaatcttgatcgtccatgattaattatatgattcataataattatctcactcttacatagaatacatttttctcatatgatacatcatctatatgtgtaatccattaaatatataattattcttaccggattttttataaaatgataaattagattttcttataagtgttcttcttatcaaaaataattatatcataatatcacatttcgatcttttctaaatcctttataatataataaaatatttttctatattttatttattatactaaaataaatatgtcaaaagaaataattatcacattatatttcaatcttgaattttgaagaaagtaaaaaaaatcaacaaaaataaaaataaaaaataaaagatggggtatcaatgcttggacatagaattataagaccaaataaagttcgatccttttcggccctattcgttataacccatggcctccattgagtatgtttcggtaacctattttgttacctaatacaagtataaacaactagtttttcaaatgtgtgtattttatcccttttattaccttatcaatgtgtatattctaaacctatattataacagtttaatggtgatacactaacaatataaagtagtttttacactataactaattacaaattatcgttgatatgactttttaaataattttaaaaaaatcaacaaacttaccataaatgttaatttctaattggatgaccctataaaactcattacataactttttttttcttcatattatagtacccttttattagaacaaaataataattaacaagtagttagtttgagtataatttaatttagatattttaaataagatttcaaactcgagacttgttaatgaagatagctggggaaagatccaccagcatcaaagatgatcaatcaagttcttctaaagatattactcattgacaaaacttgtgatacttaacacaaataacatggtttaaaaaaaaaaaaaaaaaggaagacaagagtaagattgcgtacaatatccattcctcttattttcacatatagaggagtttatgggcaatgaggtatgtagttgtttttttaaagaaaggcaagaatgaatccatattgttacattgacatatgttataacccttttattatcttagagtatctttagcgtcagatcttgaacaaagatctgatattcattatatctctcaataaaggagatgaacaaatctccaatggcaaatggattattgtagaaaaatcctgaagatttgcataatattcaagaaaggataattttttcccctctctttccttaagatctgaaaatgagatctatcactaaagaaaaaaaataggacatatctttaatcctacgtgacactataaagtccatcaaaaagtggtttaagatctcaatttagaatctaccactaaaatgctcttatcaattctattaagtttattccatgtaccgcacgaccatattggagtgtataaagttacttcaatgtaaaaattaagcaaaatcaaacatgatacctgagaggaggaacacattccacataaaaatgaaattgtcgctacatttcaaccctataattcaaagaatagtgaaaatagaagcagtaatgattcccgatttcctttttcgtcattgtcaatatgtaatgaattctttaccaataaagtggcatttttccatgcacttgaacaatcaactaatacgtctggatacactgtaatattggggaggatgtggtgcgagctaaaaaaaggaacatagtatcaaaaggttcataaaaatgtacaacaaagcttctctatgttagtatgcattaaacccaggttacttcagttctgcactggctgcttgaatacaaactcttgcatgcgtcctagggtcatttcttctcatgtaatatcaactatacacttcatcttgaatggaacggttacaaatattccaagccaatcttgggtgttaggccaatgtatgttaaattaaatgccattgttgccaagaaggctaggcaggccattcaggcatatatctatattaacttgaaattcttgagatatacatagcagcttccagccagcagattcttcaaaagtttcaatttaaatgataaatccaaagcaatagattgcgttggaataccaaagaaactgctttatccctgttgtggcatactgcattttttaagatgtcggtgatatcatcccatgctgcaaaaatggggctcagatcatgcaccatattaccattttgactacggaggaaaaaaagaaaagaaaaaaaaaaaactaattgtacctggaagtttctggaagtcaggctctattccattgccgtttatgtccttgtgatttggtgttacatacttcccaacagtgataaccacaccagatccatcatcaagctcaaatacagattggattagaccctgatagaagcattgcacatcaaagtgtcatgaagaggttgttacaactacactgaatgcatcacgtaattatacatgtgtaagagctaaaccatgcaaatatttttatttttattttttaacaacaagtcactgaaagacatcaatatgattttctgctattatctccctttagtaagagaagcataatgagaaaagaaacccattttatagaagcaaagaaacgctgcacagtctttgcggtacactggtgtggtactccttcaaaagatatacaccagaaaataaagctaacgtgattaaagaaaaatgctttcagatggacatggggttctcataacaaagaatgcagatcaaagtctacattggttgaaccatacagcagtgatggaaaatattcataaaccttgccatatgtgcgttttccaacaagaacggctctacaattatcatgcagtgcagaagcaacctgaaataagtacaacagctatagtgacatcataaaaataagtggaaaatcaaacaaataatatattgagaaattgagctcctcactatttcacttgcactagcagttttgtcatttactaaaatctgcaaaggttcaaaccaaaaagaatcataatccttgtcatgaagtcctcaaaatgagaattccattgatcaatgatatataatgaacactcatacggagactattttaatattcgcttgcatgaccttgctcaatatgacgggaaaacactttatcacacatcaagaataaccttataaaatgatcaaacatatagatctcaacttaattcaaacttttagctagtcatgtgcaaggggtaatgaatttttccagaaaacttgagaatattctcagatgctctttaacttatttatttataatgaatttgtggaattttctaataataaagccttatctcggggagtcagctagattgaccaaatgatgtcattggagaattggacccatcaaaaaccaaattttcaataaatccatttttgaataatggtttcctaaatttttttcaatatatcccattggatccacttttagcatagggtcaccagttggatttctcctcagtcctcatattacccaactatccatcatttcctcaatgggcatgctccacttttgtctcaaatacacacttgttctttttttttttatttctctgtcactcgtccaccttgaccttatcacctctaggctagtcttattgatacccagtagaatttgcctttgaatttaaaaagcactttgtatacttaaccaaaaacacttggattcaaaagcttatctccacaacgcaaatttagacattcaacttatcaactagaaatatatcatctacaaaaaaaaaaaaaattgagcactggctcctgaatgtgcaatttgtatttactcaaatggtggcaataaatcattgacccataatccataacatatccatcatagttttcaatagtaggaaattctgttactgctccatgtgtttgcactcaaatcattacctatcatacataacatattcaccataccatagcttcacgcattgcacaaatctaaaatctttatctgctcctttatttaaagggaaaaaatccacaataaattcaatgtatcttaggttttttccctatcattgtattttggaatatctaatgcttatcttaccaaagtttatcaaatgggcatctagaatcactatttatcagtcaaacaatcaataatttcatcaaatcagatgtctttgaattattcctgccccaatgataaaccaaaaaagaaattcagaagtagaaatagttccaggaagttaattcaatgataaaaaatcagatgtagaaatttttttacaacaacaggagcttgaatcaatggtgaagtatctgtaacaatagctttctgtaactgaggatctcttccaacagtgtagatcacctgtcatggagacattagaaaaggacacgtctaagaaactaaaatgtattcgaaagaatagttgaataattatcacaaaatagcagactttttaaagatcagtgttcctacagtataataaaataaagcaacagatatatataacaatgtctaactctgaattcacatgatagataacagatattgaatatgaaatcataaaaccaaaaaaggatgccaaagcaattggcatgttactacttcaacatgtaagcaactatcaacttggaccattcggcccagaaaaggctgactgtagaagcactaacgcccttcaagctcaacaattgaggggtcgtggactgtcctgcctagaaaaagtcgaccattagaagcatccacaccctttaggctcagcactcaaggctgtgaacagtctggtcacagaggtcaaccgaatatagtgaatggatcgtccaatgtagaatgattgggtattctaacctttggcccaatcacattcaataaataggggtgacccccttagtcacctcaagtcacacaaaaagggcttactagggtttctttgaggactccttagtatgctggacataaagattgtttttgacataataaagacctcattcatttgtaatttcatcagtcattgttttggatgtcacatgataattctattagatatttagtgcttttcttaagggagagtgtttttcacacaaaacgtgagggcaaggagctcgtttgcaccatttcaaaccctaaggtattattgacatgtgatcataaattgaaggaggtaagcaaaacttatcctaaccattacaatcagcaatgagcataaaacgacataccgtgtctccttcatttaggaaaagctttgcaatttcaattccggcctgaacgagttaaacataataactacattagacagttttaaaaagcaaagaaaaactacattcaatagagaatgcagcatcatttatcttgtcatcttatatcaaccaaagcatatgtaagcacaccatgacagaagaatacaaatttacttaaatttctgaaaataagagaatataatttcttcataccatgatgcagttgcaataccttcctgcaaaggcaggttccacatatgcaacagccaatatgtacaatacaagttcttagaatgtgggtttggacctaactcaatcctacaaaatcagcttgtaaggtgaggttgcccctacttatatacactattttgaccatatcactaatcgatgtgggatctccaacacaagtgaatagatatatattcaatttgtcctcaaagctgcacaattagtgactcaaaagtaaagagctccaaagctgcaaatcagttcgcaggttcttttgtggtagacttaaaatatcaaattcaaatatatgattaatttttcttagagagctagtcatctgcaaaaaggtaattcttttaactatttgtgcaacctgaaaacagaagcgaaataggcagagtttacaaataggacagtcagcccatgtcaacctacaacaaattataggtctatatccattggcagatgcaccttatctgttacctacggtgggggcaatcagattttttttttatttgttaatgtatataaaaaaaaattgcccccataaaaaaatttaatctaccaacttggaccaacatcaacatcaacatcaacagcacctttaacccaaataattggtggtagatgaaccaatgataaatcgaaaataaagcaaaagagaaacagagttaaatataaaagaatggagaggagaagagaaaagaggaagaaaaataaaacagaaacaactgaacataaactactaaagggttaacctccatcagacttatagctttctccactccgtcctaaacatacgtcccaatctaaatccactccattagtcttgtttaactacctttcccaggtaagtttggtcgacctctacctcttttatctagctcttgtaacatactcttgttctaacaggagcatctaatgtcgtctcataacatcccaaccatctcaatctatgctctcatcttttcacatactgtaccactgatacctttcgaatatcctcattcttatcttatccatcttctgtatccgacatcacctaacatccataagacattcaatacaaaaactacatgataagcccaaaccatttagccaattctcattactgttacaataaaaaaaaaaaaaaaaaaaacaccacactgcatagggcacaaataaagattatctttatttagataacgattagctaaatatatcttttagtaaaagaaaagatagattaaattgttttcctttacatatctttttgaaaagatattagtattataatatattagattgaagataataaaaataagagataaagaaatattggttaaacaaatttcaaattatgtacaaatacaaggatagacaattcattttcctagaatcacacaaataaacagtctctcttgacattaatgggttactcaacgattgagaagaaggaagaaagtggaaaattttgttgaggcaaaaataacgaagaagtcaatttacttgcttcaagaggtgactacattttcaaaacttccatggtatacttcttttatgagcgtttttttttactgtgttcttaaagaaatcaagattaatgttttttagtgtgattattttaatgaaggatgttacatttcacactaaattagtaatgacaatgaaaaaacatagaacatttttaaagtatgaaaatgcgtaagaacaattgtaatttgtagaagcttaagtactttagatttttttatcatgatatatgtattttgtagtacttgtggtattttacttttgtgaaaatattagaaattatttcttgctcccactaagaaaaatttctggatccccactttctatatccataggcaaaataatgagaaaagttactatggtcaatgaagattataaagaggaccccatcagctcatgtcaaccataactaagtcaatgattttatgttcaagacatatgcagggccatgctaaaaaaacaaatcgaatccattcataaagaaatggtttaatgacaacttacttatacaccatttgtgctacttcaagattaggtacacgtaatatatttaattcataatttcatatacataagaaaatcactactgtagtcaatttcaaagaagtgaatcaaaatggtaaaggtagatagggttatatgcaaaagcaacctgtactagcccaccaagattgtctctgagatcaatatgaaatatgaggcacccatgtcttgaagtcgtttcattgctgcaaaatccattatttttctagtgtcacgtataaaaaagtggaaacaactaataaaagagtccagaagcaattataatacaaatcaatataaggatccaaaaaagcagcagccttactttactaacaatgtatggtattcattcttgcatgggttacatagcctagatgacaattttttatactaacaacataaggtaaataacaaacccctggcagatcaatgtcaagttattcagaggcgaaaggtgtacttaacatactaggggtttttaatgcttgaggcaagaagcacgaaaaagctcacatctgactaagaaagggattacaattgaaaaggaaaacaaaaaatattaaagtattttacattgattttccaatatatccattattcaatcaaaacatttgccgattgtgatcattaattgacttctaagatagacttgataaaagcatagaacagaaccccatagtatattgtatttcatctccatcctttacaagtctgacttagaagtcaattttctctcctcaaaacaatatgtatccgtaatcagttggtctcaaaattaatttagcatccactcagagtaagaattagtaaaagaagacttttaaaaaaaatgctcttattgagaaaacattattattttagttttaaaaaacacatatgaagctgagaaaagcttaccaatgactaagtcttttctggccaatgcattgaactctttgaggcgtatatacccaacaggagtaacaccattgtccaattgttccagccgataaaagactggggtacgagcaacaagttgccgctggacttctattgattcaacgggtccacagttgccatgcttgacctgacagtaatgatctaatattaaacttgaacataaaatttaaactaaataaaactataaacaaaggctagagcagtgccaaactaacttggaattagaatccaaaacctgaatagtcacagatgttccattagggccttgcaacagggatgatacttcaaatgctgattttccctttacctccatgttattgacagccaatatttcatcccccttccagagaaacagaaaaagtaaaggaaacatattatataattcaaaatagttctttgtgcctaccccatttgcttctaggagagaaactaaaggacagagtatattctgataaatggtaaagacagagaaagggaagttgttttgaatggttaaaagaagcaaaaaaaaaaaaaattgttcacctatttactgtaatggataccagagattgcttatgtagcaattataatgcaaagcatgattatttgacatatttatttcattgattaaaaacatagaagtgaaggcaagagagatgtatgtgtagattttgaaggtgaagaagatgatgatttgaagagctgcaaattattaagaatgttcatcatctttgtgtacctgtctaacaccagcagaatgagcaggaccatccaatataattcccagtacctccagtctgaggtctccattttcatcaggaacttccttaaggtttattccaacaccagtcatgtcatacctcgccatcttggagaacttttaacagtggaaaagtccatatgtcattcattaagtaagaaacatgagaagcacagcaatagaaatcaccacaatctatataatctcatacataagaaaaacaaataacagtgaagagaacaatgaaacaagaacgcatcacaagtttcttattgttaggaacctggttcagatttagagaagaaagattgaaaagaatggatcttttatgaaattggagaataatctcctgcagctacaattgtgataattcgaggaatcatagcctcctattacttccttgcttacaagctgccttatgctcagccacccccctcctatttataatttctgaccccttcccaactaactaactaacagcaacaaaatattactatcaatatcctatcaataacctccccttcaagatggaccttgtccccaaggtccaggtaatgaaaaacctgtatttttcagcaaggatctccttcatcttcttcttccattatcatcaacctcagctacttgttcttgcacacatgtgttggatgatatttctcttcacatgtaaaacactcacccttcctcattttctcattcactgttgctggtgacaatctatggatggttcttctaccttgccagccattttcctctgtactaatagtttggacagattcactgtccttactattaactggctgcccttccttcccatttcttgaacccaataaactgggtttcagaaaagtttgaagctctttcctcagttttggtagatttcccagcaccttatgtttttcctccacttgccttgctttcatcatggtatccagcaaagacttaggttcatgcaccctcacttcagtcactatttcttccttcaatcccttcaagaaaatttccttcagaaaactctcatccaaacctctcccagctccaacttgtctttcgaactgcccaatgtactcttgtacactatcatcctgtttcagagccaacaaagcctgaaaaggatttgcaacaccagctccttggaacctctgcaccacatccaatttaaatccttcccaagatcgagtcttgctccactcttcccaccattgaaaccaagataatgcttctccttccaaagccaccaaaacagcttctaatttttcttcttctcttacctcctggagccgaaaatacctttcaattcttgagacccaaccaactggatcatcacccgcgaacaagggcaactccatttgcctccagttgcgcgctactccttcgtctccatccttgtttcgtcccttcctttccttcacgcaaatcatttcctccttttccgaattatccagcgtcgcagccaatcgatgtagtagattctccatcgaacccagtctattctcaatcacgacctggttcaactggttggtttcactcaattcctccattgcgcgttccagtgcttcgattttggcctccatcttcttcgatcccattcacctcacaaagccccaagattggagctctgatactagtgttaggaacctggttcagatttagagaagaaagattgaaaagaatggatcttttattgaattggagaataatctcctgcagctacaattgtgataattcgagaaatcacagcctcctattacttccttgcttacaagcagccttatgctcagccacccccctcctatttataatttctgacccctttccaactaactaactaactaaaacagaatattactaacagcaacagaatattactatcaatatcctatcacttattcactgtaataaatgcaagggcagcaatatcttggaagattcatatgtaatgtgtgtgtgtgtaaatatttctgttaaactatatagacatattaactgttagatttcatcttaaaatcagttggcattaagtgaaattgtccaacatgtatataggctccaccccaagaattgaattgagacgggctatatgggactttccaacactccttgagattcacattgacaagtgactaatgatatgaccaaaatagtatccaagcgtatcctagtagttgttttgtagcttattgcgccacacataattgggtcattattgtgttatcagaccacctgataacgcaaatatacagtcatgcaaactagtatataagtggggcgcaacccttaaactatggagtagctttagtttaaaggattgagttaggctcaatcctaagtttagaccccttccatagatgtctgctagctaaaacaggtgatggcgatacacagagagaggctataacaagtaagcataaaagctgcaccccaggaattgaagcagacatgtgggtctttccaacactaatactattgattaacaaacacagtaaaaaggacccatgaaaaatgacctcatcaggcgagagaaagcgagtataaggatcggccaagctggagagcattcgtttgatgatttggtgcgcctttgatcttgtctgaatggaattgctcaaaatagcttccctcttcagctggaaacaagaagcgctatattagcatgagccatgaagcaaccaaccatgagacactatgagagtaagagtagttgatgttagttacctgccaagtgtcctgggaccatctgtggcgaccagtgtcgagaaaggtgtcgttgacaatctgccatgcttcctcaacgaggccttggttggtgacaacctctggagctgtttggagcgtctctagtaagggcaccacatcaggacaagtttgggaagcagagacagaggggaaggagaagacaagcccgaaggagagagcagcgccgaggagagtgttgcgaaccaagggaatgggaatgggaatgggaagatgaggagctttggagaggaaagttggaggtgctgagagtttcatacacacatagccactcatcttctgctgctgtcttttttctttgtcttgctctttaacattaacatcgtttcagcaatgtaggcgtcgccacttcactcgttccttatgtcatccgtaggtggatcccactcatcatccccaagacgataggaaaatgtatacttttaactcatcaaattttaaaattttaatatttttaaaaatttcaatactttttcattctgtcaaaaatgtttattttcgtctatgttttaaagtttaaaataatcaatttaatataataacgattatcactatctttattttattttaaaattataaaatttgaaaaaatattatcatccatcatcttcttcaaccttctaccatcacccaaaacctccaccccaaatagaaaaaatcataatccaattattgataattccaaattcaaatcaaaatcgtaaaatcatatttcagcttcaaatcaaaatcctaaaaagaatttgaaaaccaaagcttattctctttctctctcacacattatccatccttgttccagactttgtttttctgcgtgctttctccgttgtcactcatacaggtaactcagttgtgttgcttctacctctgcttccacttgaaccaaacaccgtcattggatattattatattgacggtatttgtatgtatgatgtagtcgaggacaatgtcaggtgttcctctcttcaacctcgctcctaatctcactgtctcaaggctctgcttaggttactctcagcctcattcccgaaccatgaaattctattcattcacttacacgacacttgtggttgtgggtggcaggaaccatgactttcggggagcagaacacgctggcggagtcctttcagcttctggaccaagccttccattccggcatcaacttcttcgactccgccgaaatgtatcccgtgcctcagcaccctcgcacgtgcggcatgagcgaagagtatctcggccgttggatttcacaacgaaaaatccccagggatagcctcgtcattgcatctaaggttctcttctctgtctccttcgttgctttgtctcttttctttagctcaacttgttcttattgcaagactaggttgctggaccttctgggcagatgacttggattagaggtggtcctaaatgtttggatgccgacaatatcactgaagccattgataataggttacttcctctcttaattctttctcaattcacaccctacatgcagactaatcttttatatcgtatatgtagagagatgctggacaaataatactagtggaaactgtttcaggtcttttttgctcgatctaaaatgaattgagcttctcctgtaagctaaaattaacttatgcacttaacttttatagaagctctctcgtttaacttctccaaaagtctttttttaacaacccctccaaaaaaaaaaaaaaactgtaaagagtttcatttcagctggactatagaataagaaaggaaaaaatgatcagaacaatagtgatggagttttagattgtgatggctcataatatacactcaagagaaacattaagatgggggtggaactggagaggaggggtgcttgtttggaagagatataagatattattaagtttgcatcttatgattctctttctagtaataaactctgaaagcttttgttattgaatttatgcagtttgtcgcggatgcaaatggattatattgatctttatcaaattcattggcctgatcggtttgtatgtttttgttagtttgaagatttggacatttgtttacattgtttttgaatattacatgttcgtcgacttcttatttttgtcccagtggacgtgcaatatggattttaactcttgaaatgttacaccttgtagttatgttccaatgtttggagaaactgagtatgacccggtccaacaatatgcttcaattagcatagatgaacaacttgaagctctcagtgcagctgtgaaagctgggaaggcaagtggtatttttaaatagtttcaaattgtcaacctgtcactcttgtaattcctgaatcatgattcatgagtatgaaaatgaatgcattttttgcagatcagatttgttggtcttagtaatgaaacaccttatggcttgatgaagtttattcaggttgctgaaaaatatgcttcacacctgaagatatatctttgcaggtttgatcacttaccatccaactccggcagtatttttgtttattttcatcatggaacctcaccctacaattccctctatgaaagtttatttcttacactaatttttttctgtttagtgacagaattcatatagcctgctctgtagaacttttgattctgcaatggccgaatgctgccatcatgagaggtatttaatattattgttagatatgaaatcatttatgtgccttcacccagcaacttccttttaggatggttcacaacatggtatgattggtatcaaagcctctttgactaagtggtctagagtttgatctttgttgaccctattcttctagataaaagttaaattttaggacaaggtagggggctagtgcattgtcccactttaagcccaaaggttgcagagggggcatgttagatacaaaatcatttatgtgtcttcacccaacaacttgagtttctaggatggttggttcacagcaattttaaatataagtttgatattacttgattttggtcttccaaaagaaggtatctaagatattctgagttgttattcggattgatatgaaatgttggggtttggggacataattgagagggcagaatggattaacattaacaagcagatttatattatataaatcagatttaatacaagcagagtcataaaattccatttaatttagatagatggaacattggaagcttaatgcatgaaaatttataagtttactacatttgttggcctaaatcattctcctgcattttctatgaaacctcattgtttataattatttatcttttcagaattagtttgttggcctacagtcccctggcaatgggtatactttcagggaaatatttttccccaggcggtggtccaacgatgctcgtttaaatctttttaaaggttaattgacatctttatagatatgttttgtcttaccagctttttcacctcttgccctccttcccaacaggaaggaagggaaaataaatgttcctggtaagtatgagtttgccaatgatactattgttattattcccagggaagtattcagaaggagaatctaggtacaacttgtccaataaaattataaaggcagctactgtggtagtggattcttgtcagcattgttgcagattgcaatgctaatactttgattagcttattggaatctgatatacatttccttagttttcaaacacattttttatttttgattagcatatataaagttttcttaatttaagagcatacgatgcgatgtgaatggggaaaattgttttaatctgaactgatagccttagaacttaaaaacatgtgcaatagctagatgctaatattcataggtgtggacatttaaaactgaacctcatggttaactgttgttaattagaactctgttcctattatttcttctgtttactgattttaatctccatattcatatatttccccttctgcagaaataccttaatattgcaaaaacacatggtcttcatcctgtatctctggctataggtttgataatcttttcctagatcttcatgtgcaaccccgcatccccacccccttttatattagtgatgtaatttgcatgactccaaacgcatcaaatattaaatcagatggctggtccaccatattggttgatagttgataccgttttacaaggaggagttgctaaattctaatacctaaagtagtttggtagctgcacttgtactgacattgcctttttttagtccccatgcatatgttttaagtaaattcataggtaatcaattacactgcgtatgtagaattcaataatggacagtctgtcaactgtcaacactgatagaagttggtaaattgggataagtcatgccttcaaagttggagtttttgcttcttagtgatattggatgccgtacattggcttcttctaaataaacaagaatgttctgtttttttccttccttttttgtcttactattttaaaaggatgccaaaaaatggtttaatttagtagtatcttatcattgctggagatagttattaatgcacacgcataatgcaattttatccatcatttgcaattaactcatgctttttcattttttaaaagcatccattgactatgttattgttgtggtccttgagcttatccattagaggttgtggacttgtggggcattagtttattttttaattttatcctaattttatttcctgttcatttttgttttgagcagcttttgttttgcgacacccccttgttgctagtgctgtttttggggctaccaaatcatggcagcttcgggaggttctaaatgcatgcaagattgagctcacatctgaagtaattgaagaaattaacaagattcattcaaggtttccaaatccatgtccctgaagaatacaaattattaattaataatatgacgaacatgtttgaaatttaggtaaaaaaatactttttaaaaggataaggattttttattttgctttcattttatttttatctattagatttatattaaaatgtgtggggcaataatttcaacaaatcaaacatttaccatctcattatcataaagaggcagaagatagcgtagtcataactcgtaatacattatacaataatcaattcgcgacccgaaaatcagaaggcgaatataaaaagagagcatgttgaatgatatattttcggcaaattgttaagtatacgcaataaatataatattagtagtatatcaattatcaatcatttgtattcttcgtggatcaatactcctgtgggtcccacttttactccatatttcaattgaaacccacatcgattattcaatgaacaaagaaccaaaactatcttcatttggtttaacaaccatattttcttagttttttaaaatctttttattattccagaatagtgcttagtttatttgcatctatacgctactatgtctcgatgcatatgaaaataggagagagagagagaaataagttaaaatatttctaaggtggatgtatttattcccctaaattatttaatatagaattttgttctcaggcctaatggctaatttggttggagagaagagaaaagaatggaagaaaattaaaaagaaaaagagatgtgagatctaaatcaactgtgacattttcttttcctttcactccaattttttcgcagtcaaacatactataaatgcatacctataaaaaaaaaaaaaacaaacaaacgcatatctcatgtataattggaattgaatattctttgcccatataattactattaacatagcctaacctaaaattagaaagaagatttgaattttaaaggagaagttgttatcctattaacatcgatctgggctgcattaacacatcatttaaagttctaagtgaaattacagtaaaaatgatagttaataatattttactacttatttgtacacttggaaacgaatttaaccttttttatatatagaatttaatattcaagttttttttcattttaatttaactttaaaattatcaattctaaaagaacttttttaaaaaaaattgtatataggtacatgcttaattctttttacgaaccctagtgaaggctggaaataaaattgtatgtaggttataatatgccgttaaagatataataggtaaaggaaaagtgaatttttttataaaaaagatatccctttattttaattttttgaaggaaaagatatccctttattattagtattgtatggagtatattttgttattagtgttattatattgttttaattaattattaactatttagtattttctttccaagggaattattagcatttttagtaaagattctattgctcataaacactataatccgattaaatgaactaagtggagtatattttattcagaataaatactgttatcactcctctaaaattacgttgaaataaaaggatacacacacgcataaattaatcattgttaaaacactaaatcagaaacaaagcccttactaacgaagattttcagtttctcacaaattgttgattaatggttatttccagaaaaaaggaggaaaaaaaagaaaaggaaaaaactccgaagagagaagaggagggttttgtttcgtttcgtcctctttccgtttcgggtgcaaatcattgacaggagagagagagacagaaagagtgcgtgtgagagagagaaccagcgcgcggagagatattttaaacgcggcggaaccctaacgaggcgagcggcggcgggggcggcggaggcagatcggagcgcgagcgaggaggatgagcggcaaaggcggtgggggccagaaggcagggattcctccggcgagtcggaagatggttcagagcctgaaggagatagtgagcaacatgcccgaacacgagatctacgccactctcaaagactgtaacatggaccctaacgaagccgttagtcgcctcctctcccaaggtataacactgcactgcactagggtttttcaatttcaatcacaatcactccttcgaacgtgcctaatcttctgtatgttcgtttctcgttgtgtagatacttttcacgaggtgaagagcaaacgtgagaagaaaaaagaggtgcgttttgagttacctttagttcgttttgtctttatttttgtagatgcttgttatgaggagttactcgagttagttaatactttgtttatgtatttgcttgtgatgctcagtgacgagatttttttttttattcttcagggtaaggacacaacggattccaggtctcgtgtggtaagcaatacatctagccgtggcggtggtgctagggttggcgctgaccgttatgttgggcgtggaggcgctactcaatttagtagtggtggtggtaagcggatgctggttgctatttttgaataatgtttggattaattaatatgctcttaacctaatactttatcaagtagtatttcttatgtcgctattgttgttgtgttgttgcttttttattattgtttttgttgtcatcatcatcatcaccatcacatatgtttggaggtcagattctggtctcctgcagggaaaacctgtattcaaaaaggaaaacggaacacctgcttatggaggtcttactgctcctgcatctagcgcattggacaataatgtaaacaggcaactaccatcctacaggtatattttccttcaataattttgtgcactactggaggaactaaaggaattcttgtggttatgataaacaccagttcgtggttatgatctgtttggaaattcagactgttatttaattgtatttatttctggcatttattatgcttcctccagttttttctgaaaagcaagttagctcacttggttgttaaagcatccaatccaacttttgcaagctattttcaatgcagattcacttcgattcttttctcagacagttggtgcattctgtaccacttattcactggattactctatggttctgctttatctcgtgggatgaactttataaccgtgcaaatgttcatttttctcttccaaagatataagacaccaaactgatcagaaatgtcttctatttgtaaatttttgaatttattataaatattttaaattggtcgtccaataaaatcaaattatctttcaaagtgatatattgtcatcaaattggtttttggaggaagactctgatggcattagtgatcatttaaggatcaatatgatgttgcatatatgttgagtgggccaaagttagtgtttagttgtttactcatttgtcttatttttttcaaacaaaagttttcccgtaagcgcttgaatactgagcacacttttagtatgtaagatagatggagcgtctcatgaatgttcaaaactgctgtagtgattctgtccgtgtctgtgatggtctatcttcatcacaacatggtgggttgcaatctcaatgggcggcgaacccaggtcaagtatcaatggctgacattgtcaggatgggtaggccacaggccaaggcatccatgcctaactcttctgtccacagtggtagccatcagaatgtttttgcaaccccagcaacttcacataccaatttgcattcattgcaaggtcatgcttctaaggtgtcagagacaaataatgaccatggctttgctattaactccaatgttgaacagaatgatgaatggccatcgattgagcatcaaccagctgtttctgtatcctcggttgtagatgatcatctaacatctgagtaccatacaaactcatctaactctggtgaagctaatcagcagctgaagacccatgtaaatgaatttgtagctgaagatgatcatgttgagaatccagaaaatgttggatctgcttctatatctgctaaaagtatatctgaagagaatcccgaaagtacatctgtttttgatggtagcttgtacaaggacttaaattcctaccaacctcatcggcatcctattgaaactaatgaaggtgactaggatgtttatcagtttgcatgtcttgtatgtttatttatatcgagcatatattttttacataaaatttgttaagacttagtgtggataaacttcttgataagcatttgtagaaaaagaatttggaggtaaattaaatcaaacttctcccttaagttaaaagtaaaatatgcaccttagcttttggaaaagtgaagttagatcaaagagcctctaaacaaggaaagaagtttgatttattttacctttttttgttctcctataagttcttattgagaagtttgtgcaaatagggtcataattatcatgtaattagagggatggtactggcacttccatataaaattgctttgaaattccttagttttcatgttgttatctcttttatccacgtatattctgatttggttgattgggctgaatcgttgaagtcatagaaatagcataatgaaagaatatttcaatatccttttacaagtcaatcaaagttcatcattgttgttattgttattttgttgttgttattattattattattattattttgtttttattttctttctcatccttttaacatgtgaatagtttaaaaggagttattttattactaaaatagtcatgtgccctgatctctaatggtttagagagttattataatacaattatttgaagttcattcatgattatatcaaacattcgcctacatgtaagtcctaatttcgtaacgttttctttcagctgaaggtggtgtttcatcagtggccgcgaacttagagcagctaaatttacactcaaatgatcaggggacagaacaagaggaggaaaattcttctgtagtaattccaaatcatttacaactccattctgctgaatgcttaaatctgagctttggaagttttggatctgcaaacgatgcttccctttctggatctgacccatatgcatctaggcccttgaaaagtaatttggaagatacatctggagcaaaggatgtttcaacaattgggtcctcagatgttaggcatgtgcttagacctcagtatactttgctgcactattctggtcatattttacttatgtgttttttttttcttgcagaaaccgtgactttatggcgatgagcatcttactactacctctgatgggaatgtagctcacataactggtgtggatgctgggacttatgagcattcctccatttcacaatcagaggctttaaaatctgaaccccctgaaactgctcaggaaaatcaatattcatttccttcttcttcacacgagtttacttacgaaaatgcccaacaaccgatgttacataccctcattcacagacaagctcacagatacagaacctgtctcccttctctagtgtaatggtaatgcataaattttatatcttatgacttgcaatattcagcatatttcaaggctgggtcttattttgggtgttaagttaattagagttggttctaaaatgatttgagatcttatagtgttaaaactaggggatgatcagtgctgctattcatctctttgagaataaatcaaagcttattctctccaaacaatagaacttgtggtagagtactgttttactgtaataaatactttttcgaatggacatttttaagtatattttatgattgaattgggaattgggcatagaaatgcctccatttggatatttcattcatattgttgggtggtgtatgatttctatcacaggtaattgagttgagtgtgaatttcaatgctcagttgctttacttgtatggcaacttattactacagtaacttgtacttttttccagaaaactataatatggtgcaggaccatttattgctttactgaagtaataagccatatatattatgtagtttcttttatcttctaatattaatatatgttgctattctgctatttgcactaatcttatagtgctattgtttagcaggcttatacaaattctttgcccagtgcactttggcttcaactgttcaaacagcaagggaggatatcccatactcacccttccctgcaacacaatcaatgcctgcaaaatatagcaatattgcttcttcaattggtggtcccactataaccatgtcagaggtgaacttctgctctagcttattttagtttttctatgtacaagcttttgagacaggttggatcataaataaatttaggattacagcttacagagtgttcaattattcttgtttccaagaggatgtgtactggaatttgcatgtacattatgtttgggggctgcagttatataccaatattttggttaacaataagcactaaggatatgtttgcatgtacgtgtattgaataccaactgtccagttgacttccatgtgacatcagttaaagatctgacttacattaagagcatcacaaatcaaaagattatatcttggttcaatcacttgtgtcaaaacggcattttgcatgttttgctttgagctacttgagtgcttactgattagtgtcttcacatgagctgatattttgccaataactgttttctacatatgaacttacaaagtttatattaattaattaattaattattagcaacataagaggatgtattggatgagataaggcatttggatttttatgcctaggtgtcacatcaattgtatcctgtacccattttgtgtttgattcaatacaagtatttctacactctgcagtgcaatcttgtttctttgcctgataaatggctggggatctatctgtgataaatcttgtgtgattccatttccatgtatatacattttattatactactactagacaaatccattcaatgttactagtcattttggtttcccataaaaatatgggtgaaaaatttgtagatgatatatgtatatataccgtgtgaaggtactggtcttgcaatgctatagttatttttaaaaattaagatcctggtgagacaatatgtattaaataaaatgtttatatatttaaaaataaaaattaaatttatcaatatgtgattatcctatcctaacccaagtttcatgctttctcccactgtcaagtcctgtgatacttttatggttggcaagtactttgagggtgttcatatttgaaaacagacggaagtctaaaaacacaaatatggatgtgtatgagtgcatcagtattgaatatggatttgatacaagtatctgggcattacatgcgtgtgaaagagaacacaggatttatcataaatctaagaaataatataaagtcatgggtgcaatttatattgaaattgttttccaatgattacatttgcacagtttaatgttatatctgtatatatgtatcttgattttattgttttttattaagagggagaacatgggtatttggtatcattaattttatttgtcaactcgtaggctctaagagctaataacattcaacacctcaacctaatccacaagccatgcctggtgccaatgttgccactggacctgcacttcctcaacaccttgctgtgcatccctattcccagcctactcttcctctgggacattttgctaatatgattagctatccattcttgcctcagagctatacctacatgccatcagcatttcagcaggcttttcctggaaatagtacataccaccaatctctggcagccatgcttcctcaatataaaaatagcatttctgtcagtagcttacctcagtcagctgctgttgcatctggatatggttttggaagttccaccagcattcccggaggaaattatccattgaacccacctgctgcgcctactagtacaactattgcatatgatgatgttataaactctcagtacaaggagaacaatcatatgatttcactacagcaggtataaagatcttcattttaatgcacatttaactgtttttgttttccatatgcaatttttctcttgggagttgagccaatttggtttcaacagtgcaacctttacaaaatagttattttttagtttttctatttatgcttgtgtaaaaccatgatccttttaaagcatgtaaacaaaaggtttaagatgtgtttcattttgttgtcaacaaattactgtcattttttgttgtgagggaatggggtagactgattttgtgttttcttctgtcagaatgagaattctccgatgtgggttcacggacctagctctcgaacaatgtctgcagttcctcccagcacgtattacagcttccagggacagaatcaacaaccaggggggtttcggcaaagccagcaaccctcacaacagcattttggatcccttggataccctaacttctaccattctcagactgggatttctatggaacatcagcagcagaatccaagggaggcatcccttgctggttctcaaagccaaccaccaaagcagtcccaacaaatatggcaaaacagctactaatcttattcacctcccggtttttaagggtcttgatgtgagtttgaaagtgactggtcacaggcatttccgcggtctaataattaaaatgtgccattgtttggtcccaagagaccatatatggcccgctgctgccctgtgcgaagttgtattctatacaagttataattatgctcgtgatgtttaacttaggtatttaagtgtgctaattttgtgtacaacgcacagtaccctttttatcaacattcttctcatctggttatagtggaaagtttcttggatgctactaccttggattttactcctttcattcttgcccccttcccttttatatatgcatgtctgtcgtttacctgagagttaccttgtattactgtctttgttccttttaaatataatttaatgtttttgctttttattgaaattatctaattttgtattatatactatgtttaatgattattttgtcatttattatttatttttctctttaacttcatgatttataaattgtaatttaagtgaatggaagcatatgattaataaaatagtttaatttttagaatgacattctagcaatggtagtttattgttattattccttccgatcttatttataaaacacggttttgaaaaacattattttttctataagactttcaatatctcgcaataattatttttactaaaatatttttatttattttaattatagttgattgctactcttaattgtttcttctctgttgaagatgaatagattctcaatagtattaaggacaaatttggaaaatattataaatataggtaaatttaatgttaatacatgatatgatagaaatagaaaaaataaaatatatcgtggagtgtttaaaatgtaatctcacttaaattttattgcaacataaaactttcaatcaaaatattacggattgtgtaattttgttttgcaaatccaattcaatatgatgataaatgagttgggttggtttggattaattggatttgaatatttaaaaaatattttttttttttaaaaaataatatttttaataataaattatttttgtctaaattttttaaatatataatgattgaatacattcaaaaagatcaaattgtaaaaatatttaatttatagattaaaatttcaatactaatacaatattcttattttagataaaataaaatataatattagtatgtgaaaatattaacaaaattaaaacaagataagataacttaaaaagaaacaaaatcattggtgttttaatttaaaaatttaataaattatgtgagttcaaaattattaatatattttatatttaataattaatttatatataataaataaactatataatttaatttatatatatattcaacaaatatttagaaattcaactcattgaattggattgggtcacgactcacgagaacaatgaagattcctaacaattataatcaaagtttatatcacaattataatgaaatgatacaaaaaaaattgaggttgtttttcttaatagaaattaaactctaacttgtattatttcaaaaaggaaacgattttgtgtttttttaaaataaaaaaggcatacacatggtattgcaatttgaccgagactcaaggaccaccgctaccctccaccctaaacatagtagtgcagaacaaaaaaagcacctaattatgcatcacaaaaatggaagctaacaattcatagctgttctgttctgttcctatgggatactaccatcacaaaaggaatgaccgtctcatattattatcataattattataatattccattcgcgaccttcatttttctcggagtttcaaggacgtggttgcagtggtggtggtggcagcgacagcaatggcgcaaggcatggcgagtaaccgcaaccggaacgcgagcgcgcaagaagcgcgcaaggtgatggtggtggcggacccgacgcgggaatcggcgggcgcgttgcagtacgcgctcgcgcatgcggtgatcgagcaagacgagctgattcttctgcacgttgagaaccctagctcgtggcgcaacaccatatcgacgttcctgaagatgccgtcgttgggaagctccaccactacgtcgctggaccttggaggagggggagccgcggcggatggagaagggttcgattttctggaggagatgaagcatgcatgcagtgtttctcagccgaaaatgaaggtgcgtgtgatgaagtggagatcgatggaagagacaaggctagcactattctttctctgagcaaaacgcatggggttgatgtcgtagttattggccagaagcgcaatattacttcggcgttattagggttagtatactacttcaaactgctatttaattttctgctggaattattcattcttatcaaaaatgcattgttggaactggattataacgccaagtaactttagattaaggggtttccgctatagcccaacacgggaaacattcagtcttcttctatctcattttcatcccatttttttcttaaaattttcctatttctttttcattctatcaaccttttttcttttctctctatctctctattttccattccaattcaccccaaaatgggattatatttgagatctactttctgtattttcttaaattcttgtctcaatgaagagaaagacagattcaagtattgtttccatagtgtttgattaaagaaaaaggatttttaattttttttttttatttcatttacaagtttaaacaaaggaaatagaagaaaaaaagaatcaaaattcttcctctgtctctttctatctctgctttgatatgagatttgaaaggaaagaaaaatgtataaagtctgtaaccttttgtgactggattatttttaatttgaatacttaatagtagaatttaattagaatgtactaaaacagcctacttttgtaataatttaaaattatttataattaatccattatattaatacaatattagttaattttcttatggtagaatcaattaatttcacgtttggttcatgatcaatgcattaaaaaacttttaaaaggaatttaatatgtgcagtatgtgttgtagaatgctggtgtagaagttaattttatgttgctaacttatattcttcttttgtgtttgaaatttgaatgcatggcaacagatataagcgacctgctggtggatctatgaaaggggtgaaagcgatagacactgcagagtatttgattcaaaacagctcgtgcacctgtgttagtgtacagaggaaaggccaaaatggaggctttgttctcaactccaaaacccacagaaatttctggctcttagcctaaaggcttcacacccccatggccatggatggtagacatttttcattacggcttgaacatatcaatttcgctgaggatagatttaggagaaacttttaaatagacatcatatcatatattattattacattattcattaggcactcaaatcatttaactcccagaaacttacatgggtcacaactaataatttgagtgcttatgatcaataatgtctatctaaaagttattctagatgtagtgaaattggtaagatttccccgtaactttgttgtttgcaaatggtgagaacccatggatgttatcccagattacctaaaaacaccatctactcatcttaaagacgaaaattttctgcttatctcaatgtttccaaggagaaaattctgctaacaaatgtcataaaaatgttagttaaagaattaatcaatagatagattaaaaatcacagtgtgttgcttgataaattaaatgttaaatttttacaaacttttcactatggatttgttagcaagtgttcttaacttactagcagcaatctatcatttataaaaggacatacacttaataatggaacaacactctcattctaagattcctccatgtatgcaaacaccctagcagtataaaaaggcagaagcttatctgaaactcaccagatcacagttctgaaatagacgtggataaattttgttaaaatatttgcacattcttcatcagatttgcctaaaagcaaatctgatataacaggccccaacgcaaagcttctcttgtttaatgttaataagcaaatccgtaaagtcaagccttctatgactgtataaaagaacttcatagaagcagacaaagcaaaacaatccttatttcatttgatctcatttgaatataacagaactattgttgcttgtaagctatgagaaacaatttaatggaacgaaaaatttacttatccctttgaatctttgatttcaacctttcggttttaatttcatgttttagtacacgatccgtgatgagtactcgtgtatacatatgagaaaaattcacatcaagagaaaattaaaagcttaaaaatacacttgccttcataagttagtgcacacaatttaaagaataaacaagcccgttgaattcttcaatcttcattacgcattatattgacgctgtgatgaacaaatcatgtaactccttttctttcaacgggatcaccttcctccacatccaaatttccaccatatgaagttatgagttctcaacataattgaagacgttatagaaaatcagctccaagattatcttcaggaagcaaaagttccaccaacactgtgtacactctaactgttgacataagaatttcatttttcaaaacaccacaggacgctccaatcttgaaaacattcaattgtgtgcaacttacaccaacagttacaccttcgtacttatcatagaaaacccacaaatctaagtgtgtgccatagtttcagttctgagctaataatcactgcaatagaatccttgtaccacagcaagtttttaacagcaatttaaaaaataatctttaacagacgtgttgaacgaaataatcatttcgttactaaccttgtcactcacctccacagccacccaaaacaaagtttcctccaacgtcacactgttctctgtccaaaacaagtatccattcacagttacacactgattactactatattgactacaccactgaatattttcaactcgaacagcacaagtttggtgaaataaccaccaaaacatgcattgtttgtgtttacaaaagagtgttgaaatagaagcctatgagacaatgtggtggcatcttatgaggaagcaaagcgttttgtggttccatgattcgcttggtttgtcttgtagctgggttccaaagaaaaatggtagagctttggtccaaagaataatgaacgacacaaagtaaaccgttacataaacccacaacttgaaacccatgtcagaatctgtgacttttggaacatgaagttgtttgagcttttttcttttgacatctagcagaaataagtgatggccgcagattttgtccttccagtgaaagcgatcgaggattagaagtgtgtctcttcgatgaagcgaagaaaatggtttgagatgaaggacttgacactggtcagcaaggacttcattgatggacttttgagaatgactttgatgtttcttcttgttctaatgaataggaagaattttcatctcatttagaagagttgggtgctaaacatgagaagaaaccttttttttttttttttgaattctgaattttggattatacagtactactgtatcagctctaaagaaatactactagtactaggcttaattttacattaaaaaatttaaatgagcattgaaatcaaaagggtagaatgtgcagaagcaatttggaatttcgaggctgtcttgcaatgtgagtcatattgcagtaattggtgagttgatttcatttgatgaatgatgatggcttggtggaagtggaacaggttttaagattagatcaattggcggaaacagtgaacctaattgatctctgaatgagggatatgataagttacaagttaacgatgattatccacctcaataccatacattcaattttgtttcttaaaaatgaaataatttccatatgttctccttttctcatgcagctaggtgagtaggtgcctttttcatcttgtgagatactgattgacttgagtagaatttgaagggaaaaaaaactcactctgctctgatcacttgagataaattagattagattagtttcaatattttttttttctcaactaactcaatctaatcataatcaagttttaaatttagactatttagtcattaggttgtacacttgcacataattaactattttataaaaaaaacaagattaaaaggagagcaaagtttcatactatattatatttaataatatgtttaatgttatgcaccaacggtataaaacaattttacattgtcattcaatataaatcactatatgaattattttaaataattattttaaaaatcaatatacttatcataatggtgaattataattggatgattgtaaaaaaaattatattgttagtgtatagcccattttttcttcaattatttgtctaatttttaattttttgaaatcatatttataaaaaaaaaaaaaaagataaagataaaagtttggatgtgtgatcaagtttgattgggtcaacatgcaaatcttacctattgatatattaagcttaacacaattgatctatataaattatgaaaaacaggtggtttgaattttttatttttttatcaattaataggatctaactgctagatcctattaatatatggatctaaaaaaattcatcatcacaatagaggggatatcatccattctcctctttgtgaagaattactcaatgtcaattaaattgaaataattctagagaaaattgaacaaaatcataggacaaagactagggagctaagtaaaaatcgtttgagaatcatgtggtaaggtaacaataaaataggggcctaaaactattaattgatcaacctactttatttctcaaacataaatagtagtagttatttagttatattattctacaaaaagattcacacatttcaaaaaggaatcaattatattagcaaaacaataatatcatattccgtaaaaaaggaataatatatcaaaagtacaaatcagatgcaaatgcatgtataaatacagaccttgtctccatggaaaatatcccaaatacagtatggagtaacaatgtaacatgatcaggaagttatacttcgctaatccagatcagtttgaactcatatttcacatgtcacgaatgagcttcaattttcaaatattgcaaaagtaccaaaatttccattaatgtaccccagaaaaataactgcaaaagtacattgtactaaaatcatgataaagtgtagtagcgaaagtagctgataaagtgccctacacatacggctctttcattctatacatacgacaatttcatgtgtatctgttgtattgataaaatcctaaaatactacgactaaagctataaaagactacagaaaataacataaaactgaaatatttcattcattgattaataatattaaagagaatacatttatatagacctaagtatgtcaattaataaataataattatgcaagtgttttttttttcctttactcaaaatttaggagaaagaaatgacgtcccaattcaaacagaaaaaacctattttaacacaagtaaaataaaaattgtaatttataaaatacatatttaactccatcttacatgacccttcaatcattttattttgggcataaaatccattctatcacattgtcactgggttgtgatcaccgaacgcagcagttcgtctcctaaaatcaatctgactttgtttacccattgttctcgtgaaatattttgttcctgactccaaacagattaaatttaatcagttactgcaaatttttaccttacaaattaagcagtggataaaaaaacacaaaacacaataagaacctgaaagcaagacaattatttaatattgatcattactttgaaaatccggtagtcttttgagtaacatagacatttgtgctggtttcaaatggtttgaaacccttgccactatatcgggaaatgacacatatggtgattgaggtttccgtgccccatgtatctctggatctgcacaccaaaaccaagaaatgattaagccttgatccaagcacttgttacaaatttgaaagagaataactgcaactatgctttaatatactctttctaacatattatttattattaatttgaaattattgaacactataaaatcacaggcaagattatttaacagaagtgaaagtcataattttcaatcaatttcagtaaactactaaaaaataaaaaactacttacctcattgttcggagggtccacgctatacgcagaccataactaacgagagagatattgtactcggtcttacccttgatattcaaagagactatttcaaattcgaatatccataaccaacaaatcactaagacacaatttactactgagtaaacaataacaaaattatttaaaaaaatgaactagggaatattttatatacccttaatataattatacttgaaacttataatataatttggatgaatgtgtgtattcatataagcagtccatacaatatgtcttctaggtgctgatatatcatccaccccagtgtcatattgcttagaactaggttggctccttccctaatatcaccttgcatagtagcacatgcctaaaaccatgttcatctgccacggtacacatagcactgtgaattaaatgaacaatttcttagctctatttccacatagacataaaattagttttttttatagacaaatgttagtgtattagaatgtcagttttattagtagagtggataaaattcataacattttttttatcttttcttctttcttaaccatcaaactcaccttatatcccctctcaactctattttcacatagacataaaattggtataacaaaaatagaattggttcatagaaaacattattgcacacttgcacctacctatcaatggaaaaattggcagcaaataaaggaatagcaataccatgacactcgtctttatcaccatctcgtaatggtttcgtattcttcactccttcaacttacattaaccccttcgtaatcgagttctctattggctgctgcatgtttatttatttatttatttattccgatacaataagatgattgatatgtaagtaggctatatttgttttgtgcacttgtaacctcaatatgcgattagcaatgcatgaaagaaagggttgaatatttatgtaatttgtcatgggcatgaacctggaccaagctaaagatgtttccgtgatgaaattatatttataatttcatacccctcagtttaatggatcctctctcatgtgaaaatcttcaccattaactgataattaaaatgacataactaaaatttatttgatacgaaattaaaaaataataatactaagcaatatttttttgctgaatataatactaagtaattacaattacataaaactaaaatttgggaatttaatattgtaacataaaatttaataaattaacttagattttttagggaaaaaatactgcagaagaaaagtttgttaaaaaaaactattacaaaaacagacgtgttcaaaatgagaattttgaatttgtaatataagaatttttttaatttgtaatataagaatgaatatgttgataaatgaaaattgtgtgattccttgtcactatcaagcgtgagtgattctctacattggctttcttaaggctcaagccaaagcagtgatgataaacggtaacagcttccacattgcatttcacaatgcaaattgtgagcacctttttcttttctattatcagtcgtgaatgattttattttattttattgtttttcaccttcctagttcctacttatcaattactgaattgagttgtgaatccgttgtcaaaacaaagttgaagactcccattagatttttttcttttaattttgatgacgagttagcaatagcatccattatctggacgtctctctctctctcccagaaaaaaaaatttccttaattttttccttatgataaataaacaaaacctaattctcatcattgacaataaaaagtttcttatgatacttgaaatgattttatcatccttaataatgatgataattatatatttatcacatttaaaactatataaaaaaacatgcagtagatgtacaatttgctaatcatattaaaattacaagtttagataaatataattttactgaattttatcaacacagttgaacttgttaatcgatgaatcttaacataaaatgtcatcccgaattccattgatcctattcgatacaagttcagctatattcatctaacttactatttttgccgcccgtactatgatattatctatcatagccaggtactattgttacattaacaacaacgataaattatagttagcatgtattagatgttcttatatatatatatataagaatgtgtaagaagatgttctgagctctcataatatggaagaagattaaatggcatcataatcccattcgcacacgtatttagttcttattactaccaacgaaacatcaaaatttcacaacccaaacactgcctcagaaagacatgtacaagcatgcaaccagccaatgcatgaccaaaaatgtttgcctaaaatttgttggaatataaaatgctaagatttaaataaacgctactttcagaaaaataattagaacatttttccttcaagaacaagggcattgaagataaaatgcagataccctctttaaatgcacaccagcacaacctgcaaaactctcccttttctaagcactgggaagtagatgcctcctagattcagttatactttaatcctcatttcgactttcatccttgacaagcttgatcatgtcatcaattcgaaggatagtaatagcagcttcagtagcaaactgggaaaaaaatacaacttatcagacagctgtataagaagaagctgtatcttgaagtcaagaactgttgatatttaactcaatacatacctgaataatttttactttgctcattgcaggctcaatgactccggcctccaagttgtttctaattttcccttccgaaaggtccaaacccatactggggggaaaaagagcaaaataataacaataattagcgagatagaaaagaatgccaaagtttatcaagcatcatttcatatgtattctccattgttacttttctctaatattcattaacgtattcacatgttggaataatacctgaatctacatattatgggcagatgcacaaacttattttacctgccaaattcaacatatcctgccctatatttctccttgcacacaacacccaaataaccaaaaatatggcacatgatattgcaaaatcacgtgagtagcttcatgtcaaatggttacgaagttctgagtgagtgtgtgcataataatcatatacgatgaattaccattccaacacaggttggaagaaatactaatgtttaaaatataatggcacaacaaagataaattcaacaaacagacccgaagctaggaagaagataaatacaaaggaaacaatatagttactattactagtaagcaaataccttgataaatgtttcttatcgctttagtttgtgctgaatggtggtaggcccgtaatttcgcgaccagctcagtggcatccttagcagcattaacagaaagcacctgcaccagttaagtgacaccaacatatacattgtcagtgcttaaatgtttggaaataagaaccaatcaattaaaagtgtctcaaaagagtgaaaagaccaaatatttaaatataaagtcaaaaagtaaattgtttaccacactaaccccacatgaaagtacactagactaaaattacagaatttaattattggacgggagatgaagacaaaactcaaactttacaccatgtgttcaactaggcccaaccaccctagttatttgtaaaataagcagaagacccaaaccttaagccattaatttagcttgtaacttaccttaggaatgattaacagagactcagcaaattctgctatagccaactgctcccgagatcctaacgttgtagcaaggtactccaaataaactgataatgctgcttcaacagcacctccaccagctaccacctgaattttatatattaaaaaaacaagcacaaggaaggcaaaataaaaagacatcatttgaaaaacttaatctaaagcaacattttgatttcaaccaaagtaggattaaagctacgtatgcaggataccatatttgattcaagagttctcttgacaatggacaatgcatcatgcagagctctatccatctcatcaagcatatggtcatttgcacctcttagaatcaaagtgacctacagaagaacacagaatcaggtgataccgcaagctatccacaatgtgcaccagataataaataataaactatcagtgtccccccgtacgagcatgcgtgtgtgagaagatgatgagtaaaaaatatcatatttcttaaaaaaatatttataaatataattttaatagatatccaaaactccttgtgcttttctgtctacaaataatctacaagttaataaaaacttactgcacttgtagttttggtccctttgatcataactacagcatcatcagaaattcgctcctcaacaacctcatcagcagatccaagaaaagatggttcaaatgtttcctccccttccatatcagcaaatgttgagacctgtgtcaaagtaaaaatcaagtccaatataataaaaggaaatagtattcaaaacttctatccaaaaaagaggatactatacaagagactgatgttgcttgacaaaaaatataaactgagatattgttaacacagaagtttggcattaattcaaggaaagtcaataactattaggggaaggataaaaatgcaaattgaaatgaatagaatcgaggataatgattacttctctggttttggcattttattaactacaaattcatccctcgtggttgctaattaagacacgaagctcttcttttttgtgccagaaggtatttaattacaaaagagaaaccaaaatacgattaataaaatgccctagcaaccactatttaagtaatgatcaggcatatataaaagagaaccatcttaaaacatcaagaaacttaaaatgcaatgaaattagaaaaccattttactgccagaatgattaaaagataatgaaaataaatcccttcaccaatagagaccccgggtaagacaaagattaatttagttcaatttaaatttgacattaacaatgttcatatttcagaatgcaaaagggtttcttggatggcaagcttttaaaaatctaagattttaagcaggaaatattcagagtcatcaattgttagaatgcattgaatcagtcgcattcccaccaacccataaaaatagcaacaactagtaaaaaggagttaaaaaaagaaggaatggagccctatctaatcaacactcattatgacaaatattcagctttactgtcaacttgctaacattgcaatttaaatttataaaaagaaaaaaggaaaaaaaaggctaccaatgttgcaccagtagccttggcaacatggcgcatgtcctctttccgcacacgtcttacagcaattgccccagcctcaacaaagtactgaaacaagaataaatgtcagaacaaatgcataaattcatgacttatatgtcattcatcagtaaagaacatgtatcttgaacagagaaccacaaaatccatcaatgcaaaaggaagaaaaccagaagtcatgtttaaagatccataggcacatatgtcaaaaatttggtgtattttcatcattctgaagttagtaaggtcaggcatttattccctaaaaatggaccttggtaactgaattccacaagccacaagggttataacttcaaccttttgtaccatttggtcctcagttttaactatagtccaatacaagtaatgataccgcaatcaaaaaaaatgtataggaatgaaaagaaaattttaagtaaaaatcctatcttctgtcatgtcatgagttcctgggtgtaatgcctcatccgctaaagtattaaaaactccccatcaaacccctaatactcagcttgaatttccctaaatcgataaatccatcaaacaccaaactccaatctaagatgtgaacttcacgcacccaaacagccaccaaacaacccttgtaattgatcaggatgagtaatttatacaagggttaaaacatgacatgctcaactgtcaacagatatatattatcacataatacaaaaagataaagtcaaacactttctttgacagcctaaatgtaagatttataactaaatcctcttgctcgaagaaatatatcgaagaaacataccttaagagccatgtcatcaattcctttagttgtcagaataacattagctccagccttcagcagttttccaatgcgttcttagtcatatcggcctctctgcaattagaaaaaaaggccattagtcaaaatgtattatagatattacttttttttttttttttttttttttttttttttttttttttttttttttttttttttttttttttttttttttttttttttttttttttgtatttactttatcttgcaagatgtatggatggagaattgtcccaaacaaagcaaaagcaaattcccacaatgaaacttaacataagctggcttacaaattagaacaatagtctttataagaactacacaaatcaataactaaccataatattttgagtatttagcttaacagggctttggattgatttcatgctatcatccaagttttctatttatgcctattttatacagctcttagaatgtgggtttgggcctaactcaaccccaaaagctagctaatggggaggttgccccccacttatatattctatctttgtcttattctagccaatgagggacttgggtttttcccaataacagcttattcaataagataatagatttattctcattatatttaaggaaaatgaatccagaaagttgggtatcatagtaatatagaacccatataatcatactgacagtacctttgacgaattttctctagttccctaggatcagtaactaaaacttgaacacccaactgcatttttgtcttctgaagattgaaatcaagacaggcaattcttgcaggggcaccctaagaggcattccttgagcagcacggccagtatttagagcataaccattcatcaaaagctgtctctagcactttttccatgagctttcaagatattgattccctgaagcatgaggcacaaaagaagcaagaaattaaatcaattcaaatcctatgaacattaaagcaagtaagaagcaagattaaaatatatactacagatgttcatattgtgcaaattggcatctttcatccaaaaaagaactgaaatcacaggaattctactaccaaccttgattgggtatttaacttcaccccgagcattggtcatctttacagcttgcactgcgtctacaacctgtgtaaattgcacacataatcaattaatagtgactacttatacctacagtctacactctacagaccaaaaaaaaaaaaactgtcccaaaatagcagttagcatctttttcgcaactaatccataacttcagaaaataacccttcataatgaaaacagagtttcaaaaatcacttagaccatatcccaaaaattcaatttattgactataaaaagtctcctagaccgacaacaaagtttttttcagtttcatgtgacagcacacatactgccaaaccaaatatggtcaacaataaacaattttacacatttaaaacacagtagaaacagatgaaatcaagaaatatttgaactcctttcctctaaagcagaaagaaagtgtaaaatctagtaaggttaggagattttttattttacaaaaatcaggttttaaatgagatgaggattgaaaagaatatagctttatcaatatcaagttttcaattactaatccaactaaatattgatacaagaaacagaaaatgcatataagcttcattcaattggatatgcactagaatttgcagaagcagtagaacatggtgtgcatcaatcatgtgataaaactctcaacattctatataaagccaatgcaattacaaacataccaaactggcaaagaagtcactatcaccagctatcaactttgaggacatactggtcttggcacagttaattagtgaatcctttcccagcttttcaacctaaaagtcaagagaacaatccaactgagtaacacatgatatacaacaatttgcaaatgcattaattaatagttggacataacataacaatggtcatatggtccaaagtaggtttttcaaaatataaaacagggaaccaataaccaagagatgcaagctttcgtcctcagtcctcacatcccaaacttctttttgcattagttaatgattgtatcattgatgcaaggaagacatgaacaaaaaatatgcatacaaaataaaaaagtttattaaggagatcttaccttgacagctagtttttcttctacatatttacaagcctctcgcatagcaagctataaagaataatcatcataaagagaagttagttaaaccatgcaaattcgcaattcaaatagaagaacagaaaaattcataatggtagctacaaagattaaatatagcaatcgacaattaattaagtttaagaaattattaaaagacacttactctatatccactgataatcgaggtaggatgaatcttgttcctgacaaggtcatttgccctctgcagaaaagaacactcacactcgttagttagttacatctgagacaaacacaaagacaaacaaagtgccaaccaaatagagagcgatgcagttactttgagaagctcagcagcgacaatgacgaccgaagtagtgccgtctccgacttctcggtcctgaagctcggcgagctccaccaaaacctaaaaagcaacacatgtgagtaataaaaagcaatggaacgagaaaaaagagaaagcgaagagcgagtggagtgtggttcaccttagcagcaggatgctccacttcaagcatcttgagaatcgtggcgccgtcgttggtgatagtgacgtcgccaatgtcgtcgacgagcatctgaaacgaatcgcatcagacattgcttacttcgtctaagatctaactatgtatagagagagaaagagaaagacagagagtgagagtaccttgtcgaggccaacggggcctaaagagcttttgacgatgttggcaacggcttggcatgccacaactgcatcacagagattgaacgatgttagaaatggttgttacgtttttcattgtgaaaaaaaaggagagagagacggtaccgttttgggtgcgaacgtcttggccggactgtctatcgccggcgatgtcaggggtttgcgcaacaaccgccattgcgaagtgtgtagtagtctagggcttcagtcgcagagggttttggttttttcaacttcgcccttcctttacttttctttatgctaagctatgctttcttttccctcctcctctttatttctttctttttcactttcaactccaagtgcattttttttaattatgaaaaattaacaataataattatattttaaaatgagtttatgtagattttatcagaaaatttataataatttacagatctcaaacaactaaattaaccctcttaatgtttatcttatttatttattcttttttaacatgtaataataatttttacattgattaaaaaataaaattgcataatatattattaatatatcttgagagtaagaaatttaatgtataatgatttttttaataaggataatgatttgataggttatgatttaaaaatatatatatttaatttttctatttatatatatatatttttttttttttttaaaccaacattctgttatatacttttggacatgattttcactcaatttctcttattttacaatattaaattcttaaattacataacaaatcaagtgacaaaaattaagtttgttttttatatattatgtaatttgtataacacggattttatacattttttgttttgtttctattttataagatattttatactataatttatgttgataaaattagttaaaaaattaaatgaaaattataaagttatcaaaaattaattgaaattgaaaaattaattggtagttgaaaaataatttattaatttataatgttagtaaaatgttgttgaagtagtaataagtataaaatgatgaagtaataaaattataatttattttaaaaagataataaaaaattgaataaatatattgaggataaaaaaattagaagttgtcatttaaaaatatatttcaatagagtttcaaaaaacgttaaagttattaaaaaaatttttgtcaaaaaattttcaactagtaaaaaaataaaagttaacttaaatgttttataaacatactatatttgtcaaaactaaatgaaaaattagttgatagttaaaagtcaaagttaaaagttgttagttggaagctgaaaatatatcttattaaatttctagtattccacaaattagatattgaatattgaaaaatgacataaacataataataaattattattttgttttaaaatgtaactaggaaattagataaaatattaaggataagaataaaaaaatataaaagttagaaactagagttaacatttaaaaaatgttattttaagtagtctttaaaaaatgaaaagttactaaaaaaatttattttccaataggcaaaaaaaattcaattaataaaaaaattaaaaactaactataatttttaccatcataaccttagtcttttttctcttttttaattctataatttttagtcttcataaattttttattccatgttaatatattttgacaattttaaattatttttataaaataataatagtagatatttgttaattatgctttactaatttcttttactaaatataacttaataattacttttaaatatatattaaatattgaatgtagtacattttaatttaaagtaaatttatattgttaatgtgatatttttttaacttgtttttacttccaaacaatattgatattaataatcagagcttaatggtatgcattgtaactttttacatcgtgaatcaaccaaaaatattgttaaaataacttttaaaataattgtatcacataaaagtcaacaaattcagaatactattatgatttatagatgaacaatagtacagtataaaatattgtgtcctatcattaagtaacttatttcctcaaataatggtctggtttagctttgggtgagccaaggctcgtggatctacatttaagttaaaagatggtgatttaacgttgatccaaaataagattagaattgaagtattttcaaaacatttcaacactcattatgtgtttggtagtgttaaaaaaataaaactaatgaaataaattaaggaaaaatatttaaattaaaataatatattagaggtgtgagactcacactaaattttgaaatataagatatttttgtaaaataaatttgtgcaattctgtttcttatcagttatatatataaaactgttttatctatgttatataactaaagtagtatgattttaaagtaggtaatatttttaattctatatattttaaaaattattatacatttatctggagttataaggtggattggatcattaaagaaggagaaaagcgagtaaagataactgagtttgatttctgcttgcaaaattaacagttctacttctaacaactaatattttttttttcgaaaaaattattatttatttttatattaaaatgtgcatgaacctaaatgaaaaatatgctcttgatccttttgttttatttcttacttcgtactattattttggtagaatgactcacaacattcttatgattatgtttaaatattgaaactaaatgttatggtaacgacaaatattcttctatagtattttttatgtttttaataacttataagtccaatgaaataaatatttttgaaaaacaaattgcgtaatattgtttgttcttagttttatattaaaaaaattgaatttagccatgttatataattgaagtagcatgattttaaaatagctaaacatgtctaactctatatatttttaagttattatttgtttatgttgtatatatttttatttttatattaaaatgtccatggagaaaaaataaaataaatgtttgataatttttttcttgtttcatattaattattataattatctgaatgtgaatcactcataaattttggtacgtacgtagaatcacccacaatattattaatttattatgattatatgatataaatgttatgttcacgagaaatattctatagtatatttttcttttgttaataacttataagtctaatgaaataaaatatttttgaaaaataaattcgtgtaatatttttcttctcattttttatatataaaaaactgaatttaactttattattatataattaaagtagcatatttcaaggtaggtaaacatttgtaattctatatattttttaagttatgtttcatatattttaatttatttatttttatattaaaacgtccatagccaaaaataaaaaataaatgtttgatgatgttttttgtttcttacttcatattaattacctaaatgtgaatcacttacaattttattttggtagaatcactcctaacattatttatgagtatatgctataaatattggaactgaatgtccacaagaaatattatgtatatataaaaaaaaattgaatttaactatgttatatatttaaagtgcataattttaaagtaggtaaacattttgtaattatatatatatatatatttaaattattatttatttatttatcttgtatatattttaatttgtttattttatattaaaacgttcatataaaaaaaatgaaaaataaatgggattcaaaggtagagttatgaaagttactttagtatttgtaagtttgtttgttttttttttttttttttttttttgcatttgtctcatagagacccatctagcctgccaactgcgaagcacaagatctttaaggatatataagtaatgcaagttatctcatacaatgatttgacatatatcactattcccctttctctggtaaagaacattatcaagatgttctaatatgtcaataccacattatcaaaatgtttaatacgtctttcttgaatttttttcctattaagattaactgcaaaaacattactggttctctttaacctcaagcacattccaaataacttagttccaaatacacacattactacaaacttttagtcccaaaccttcaaacacaacaaaccataaaataatacaatccaagctattttttatcgagtttcttgcaataaactaaagaaagacaaataaacatttatttttcacattcaacaggaattcttacacgcatgaaagaaaatatctaagaaaaatactcattagaggcagcaaagatgggttgcaatcgctgataccctcgttgtttgtccactccaactcatcccaccactcttgctgccctttaatggactttaagttgactgcattgtcactgtctagtggtaaagttttcaaattaggacagttatgtatccttaacagctccaaagaggaccaagccaatgtatgagttgagcatatagttttgaagttaggcaagttaaccagcagaagtatttctagttttggaagcacatccctttctctttcaatgttttctcctataagtacttcaatttttgaacaatcttcaagttttagattttgaagttctgaaaaatgttgaattgctccattgctgaaaatgtcactgagtgatggacaattcttcaatgacaaaatttgtaatttggaaaaggttccactgtgcaagggacctctaaaaacacatcttaaattgagcaaattttccaaatataattgctccaaatttggtaagatgactcttgtttctatttggattccattcatggtgttgctacttgtatcggctgacacaattgataaaactttgttacatcttgtaatcaaaagaccacgaatgcgttccaaacacactatgccagcaaaatttgtcaatttttttatatcttgatggcaaactaattcaaatgcatcagtttttggtagtacctcaataattgccgagtcatccttctgtccaccattgcagtacctcaaataattagtaattttatactcaaaagattcaagtatttgaggtgccttgtgttttggcatcccacaaaaatctaaatgaatttagctgcttacaactccatgatttacttcttgaaagaaattctccaagaatgattgaggagggaaaacaacatatgagatgtgctacattttccagagaagccacatgttgtaaacaattcagcatcatgcaccattgttcataggatatgacttgaatggttaattcttccaacctatgcagctttgaaatcacatgaacattttgagcttcattatcttcacttgcaatgaatgggattcgcaggcatcttagattaatcaaacatccaatttgtagaggtatgaatgttactttagtatctcgtatgtcaaggacctctagaaattgaagtgatccaatttcagatgataatgattccaagagctcgcaattgttcaagaataaactccgcagacaagtcaattttgataaagacgatggcagttgtgtaatcatgctattatacaagtctaacagaagtagactgctcatgttctcaaaaaagttcgtggtattgtagttagttttggattttttctcagcaacaatgtcaaaatcatgctgcaatcttggcttgttggaaaatcaagcagttgtctcatagagacccacctagccttctgccaagctcttgaatttgagagattttcagattctccaccatcttggaggtaaaagctacattcaggatctttagaggatatgtgtaatgcaagttgtctcatacaatgattcatgttgacatatatcattgattcccctttctctagtaaagagacattagcaagatgttctaatatgtcaataccacaattgcgtgcactttgatatgaccttttgtcatttatatcaccgagtaaaccttgtgctgcccaacactccactaaataatcagtgtaaaccttgctatttgcaggatacagtgaagtgtataaaaaacatttctgctttttttatctttgagttcatcataacagaatttcaggcatgagtacaactcttctaaaccttgattttcaagttctggccaaggtttaagatcttcaagtcccaccgaccaacttgaagcagactctttcaatttaaaagaatttgctatattgtaaatgagaagtggaagacgagagcaccttttgcatacaagtttggcgataggttgaatgtcaagggaatcaatattaggataaaggcatgaacagtatctctgaacatcttccatgcttcctcaggagataactccatgactttgatgaccctctgcaccttattcaacttataaactcgagggagtcgagtggcaattaccaccttactgccattgttgacatcactaggaattcccaactgctccaaattgatggcatcctcaacctcatccaaaatcaataaatacttcttcttttctagctctttgtgtattcttcttgcaacatcatcgctatgctccttgtcggtttctatgtccagtatcaaccgatcaacaattttctcttgaagcttatgatcatcagctgtggctttcacaaaaatgacaatttcaaacagtttagcaacctcttcattgttgttgaggttctgcattattgttgttttccccaccccttttgttccacacactccaacgactttaatcttattattttttagcaaacccagcatgttttccaaggcaccttgaagggttggatatccacttatctgtgggacatttaactcctttaagacaggctctggtggtttatcaacaagaaaatctcttaaacattcatccttcttaagttcacgaacacagttgcactcttctccatctcttcactcagatgtgaacgtcgttgaatacgccaccagggtagcattttctcttcgtatttagctttcagcttctgcacttcttctgcagcatctgataccctgtttgtccacagtttgtaagcattagtggtatctttgtggttgtttctttgaacctccctctctttatccttctttattgcaagtagcatctccatctctttgagcagaatgttgtagttgtcatcaaggtttctggaagacgcaattttagatgcaattgtagtatgtaattctccaaccccatgcgctcctacctctccaacaagaggggcacaacctcaagcccagacattatgaaacttcaaagcctacaatacgttaacaaagaaaataaaataaaggttatattcatataatacaccaaatcaacgtatagaaattctagacatcagcggtatagaattttgaagcatacacaaacataggcgctttattcaatatgatatgtatgtaacacccaaagccaaaacttcagtatgtaaaaactaatgattcaacctttagtaacacacttgatcattatttatcttttctgtttgacagtaaaaacattttaaatatagacaattacaataaatcttaaattctaaagcaatcattaagaaacacaaaaaaaaaaaaattatatatatatttatatagtatatataaaccttgagactagaagtagcaccatttaaaagtagtaacttattgaaactcggacggatccaggaatgcatagggacggggggggggggggggacgatttttttttcttacacaattatttaattatttaattctaataaataatatgtaataaataaaaaagtttcacaaatatttattattaattttatgcgtaaaaagaataaatatacttctagaaaataaacaaacattaactcaatactcgatttttttattcattttttattaaaatattttctttttcttgtttctcaatccgtccctattgaaactgatatacaaaatgattggaatgtatgtgagggggaatcaggagcaagagttaagtaagaaagattcatgtgtacctctgctgctaactgttaagaattgagatccatctcaagggtgagtgaggaatcagaagaacagctaagaaagattcatgcatatctacctctgccagcagctcttgtgcacagatttgcaaaatgatgggtaagtcaacgcatgagcagctccaaattgagtctctggtgtccttgttcaatactagtggaggacaggcaccaaccaaataaatactactgattaagatacatttgattattctaggtctgtttaatctataacatctacatttttaaaaaatatacttttgactacaaaattaaaaagaatatttataaatatattcttcatatcattttacatttattattagttaattcaataaatacttttatctaacgtttctaattaaatgatctactttaacaactttgatttcaaataatttgtcatctttaagccatttttttttaccaaatataatatatctgtttgataagtcatttcaaataattaagaacttatttaatttataagtttgttctaccttaatgactttcaagttttagtttaaaaaatcacttttaagcattgcgttaacttagaatttttttgtcagatatagtttcaaagctattgaatatgaaatatttagtaaaattatctaataaactaattattccatatatatgttatcagcgtgtgtataattaaaatgtaatagatttagatagatatggattatttagtattattaggtataccatattttataaaaaaattaaaagagaaaaaattaaatatacaaatataatttgttgaaaatacgagttttattaattaggaaggagtaaaataaaatcatttttggaaattagcagacaaaataaaaagacaacaatcataaaacttttgtgttataagttatatatttggaaattattgtattttagagaaagatgaaaacaaaaatagaagacaataaattaattattccttaattagttgaaagtgatatacagaatcaaactacttaagacttaagaggttagaattgagatccattcaaggtgagtgaggaatcaaaacaatagttaagaaagatttatgatatgactgtgtacctctgcgagtgcgagcagccgtagccgacagatttcttcacccattttgcaaaatgatcgatcaagtgtttgattatcgcttgctctgttttttcacaatggattcaagtcaacgcgtttatcacttggtgtgtggtgtcggctcgataccatccttataatactaatataggaaaaaaagtaaagataaatgctattgcctattgatgattttttaaaggcaaatagtattgattatattaaattaaaaatatgtatacaattacttttacattttaattcaatataatttttatcatattattatacaaatatctattaattttttataactaatcttcataaaaaaaaatctatctaatcacatctttacaagattcaaaatgaatattttgtttactagtcaaactaaagagacttatcaaatacatttgattatatacgtgaaatatatgattaaaataaatatatttaaaaaagatgaatttattttattatttaatgtgttaaataaaattgatctttttttatactgtgtttaaatataattttatttttcaataaattgatctgtataaaaatacatctttttatattttaatttatcatcagttaataacgaattttaccaagggtctattgccattatcaactgaaaaagtaacttttttttttttttaatgaaaggggctaaaaccccaaggaaaaaacactaaagccactaggaaagatcatggaaatagcatatgctaaaatataacatgtgaccctccgtagtattgacataatttcattaatttgctagcaaatccacaacttgattggcctcgtgtaaggtatgagaaccggaccaactgaaaagctaacaataaatgaaaattaagcagagttgaatatagtgtttgacaagtaattacaagtaactagttatattcctcatgaaaattcctttcatctaaaacatagagtaacagaatcacagagagtcagagacagtattgattcttacgatattcttttagtaatttttttttataaaaaaagaccaagacacgtaatgatattgcaaaacgattattatctaaagaatatttgtttctattttgctaaatcaaacattaagtgaaaacgaagatgtttacagccaaggctaaggcatataaataactctgtttaacaattagcaatagcatgtactcgaatataaacataatccaaaagaaatttactactaagattgtaatatatgaaccagaaagttgtaattgcatccttcctttcctaacccatgcgatatttaattaattctgatctaatattgttaacatcctctgcctcatggagtagggcttcaagctctgcgacctttcttttattttttgatgaggtctctgcttcggttttctattgataagacagcagtcatgccattttttgaaacaagacacgacagaaaaattttaagatggaacattcacatgaaatatgaaaaacaaaacaaaataaacgcacacaaagtgaagcataatttaatatgtatgcatctaactagcaagtaaataacttattctgttagaactgggagaaagtgacaagattcaagaaagaaatcaagaacagaaatatctaattagtaatatcctcaccggaaacataacacaaatactagaagagacgagtacgtttagtgataatggaatggcatgtacgttcctattaccttgtgtcgcaaatttatatctatgttgtttcttttttctttttatgccttatctgatttgatttgtttcgcatgcatgtgttatatactttgattatttagttatatttatattgaattgaatcgaattgtatttttattttatatttgtttcaaataattttttatctaaaaattgaatcaaacttcactgcaaacactcctatccggctctttgcatgatgcagaccccaacgacaacattgcttatagagttatagtttcgttactaacttggtatatcctttggtaactagtttttttatctttgcatcaacggagcttttaatgttgagtgaggattataaaagttattatatttaatttatatcttttgaaaatgattttttataaatgaatatattcgatagagttttaacaaaaatctttagaattattcatatttctataaacatttaactatttaattcactgtctttaatagagcaaattttgtttcttttttttagttaaaaattataatttcttaattaaattatttttatcacatataaaaatatgacttttgttatcttttagcacaataagacaatacaattttaactaattatataaaaaatattattttatatcatataagaaataatagtattagttttttttaaatcatgttttacaatttattttaagtaatctgtattttacaacaaaatttagtctaaaaataaattcaaatttgctaggcccggtccgattttgaaaaagaaaaaaaaggaatgacaaataaaacaaatgtaaaataaaggaataagaaaatgggattaaaaaatccaaacccatgcaacgtgaaagaaaaaagaaaaaagtgtctttacctttcaacatacaattttaaccctagtaaacttgactatttttatggaccgtttgcaaggagagaaattttttaatttttcaaaaaccataggataagaaacttgattttccatatttgatatacattttagaaaaataacctcgaaaaatgatatttcttgaaaatgttttttaatcaattttttatgaaattttttaatgatagagctgaaaatcttacttttttcaagtttaatttttgtctgttataaaaaaataccatattattttttattaaattataatgtaataataattaaaattattaataaaaatatgtataactttttaatttctaaaaatcttatataaaaattattaatgttgaatcaaataaattttatttattaccaaacagattcctaagaatcataatatccggaacctcaaataaccccgtaactaagaatgatgaatgtttcatcattccaactccagcatttcatttcatccacgttttgtttacggaacagcttgtgaatatcttcattttcattgatgtccatctcttgtcggacacctcctaaaccaactatttttctcctccatcgtagcacaatcttgtccaagattcgaactgccagtgcccatatagattgtaatggcccctcacatgagcctgcccaaataaattagaaataactaaggttgaatatcaaagcatgcaggtgcatgcgtagtgttctgatgtttgtgaatagctagaaaagatgctggtaatttaagttggatcaagctctttcttaaggtatttatatagaagaaatatcttcagaagtcgatcattatgtacaaagtgatatttaatcagtgaggtgaagtgtgtgaacagtgtcaataaaataaaagagaacgagaatatgtatattttttcctctgcaagtatcccttgtttataatgtacttaattcatggttagttgtggatttcacttaaggtcaacagtccactattcttcattgtaccttatcactaaacacttttaaaattcgtaacagataacttgtctataatcaactgtttttttgtttataaaaaaatcaaatctctctatatattcactttcagggtatctttaagtgctagctatatataaattaagaataatatctttttttttatcagccaaaatgataatatattaagaataatatccatgtagcagtagctcttggaatttattttgttctagtcaaactatgaagttaacatctgttacctgttccttggctactttttgattttggcgcaatgcaaagaaatctttgcgacctccatatatcttccgaatcaataaagcgactggcacgaggctagtgtcttgcgcgacgaatagcggataactattactcgtatttgcccgctctgttatcattgcaaatttacataattgggtaattttttaaaaatagatagtttttgaaaatattgtataatattaataattcgtgtttaaaataaaattttctaaaaattgtattttaatacacaactttaaaattataatttatttaaaaaatactaatgtcatgattcaaatacgacttcaatattttatatttttctaaaaaaaaatagtaaaattgtattttaaattactacttttaatattttattttttaaaaatattaaaatgatatctaaaataaaactttagtatttttttaaaaaattataccgttctaaaatatgttttaaaatatgactttttttataggaaattgtgttttaaaatagacttatcatatgtataatattttcaaaatctattaattttgtaatttttttaaaattaccccatgtaaatttgttgctatcatccctactcattaattagacttcgtatcaaatggaaataaacttttccaatctcctaatttgaaaataaataatgggcaaatatgaaatatgagtttcccaaaaataaaatatatgcaatataattatcttgttacctcctaacaaatgtggcgatattttttgcaaactcatattcccataaataaataaattgtgaaataagtattccctaatttgataatcttataagtttttattccttgtactttttgagacttgatttggttttttaaattttattttgtttatgattttaattatttttatttattttagatattaagtgatgatatgatatttattttattattattttaatttatattaaatatatttttatatttgaattttttttagtcctacaaattatatttgttttgttttttttatctttgaaattttagataatatttttatggttcaaaatattatttaaaatactttaaaaactaaaaataaaacaaacataaatgattaaaaaaacaattgtacaagaataaaaagataaaaaaggataaattataagtaaaagaatggattcaaatttttagttattacgttttctgacggccaaaaacgaacagaaattgaacgaccgaaaattttaaattatttcttttttccactttggccagagtcattttctctgctcctatcccctccgacagcggcctcttcacgcacaccgagttgagttaatgaagagaaagcggaagcggtggggatggctttgaagagagatgttcaatgccagggtcatcctcttcggtgacgtcgacgtcggcgaccaaacctccagatctggtttcactacattcaattccctaatcacgtcattgtcctctgcggtggcaactgaaagtccccaaaaactgatcgagatgctgggaaaaacgaggaaagtttcggtgcgtggcaaatctgtgacagctaactacgcctttgcttcttacacgcatcaccaccaccaggggctaccctcccttgaacaagtttcagaagaagttcaccgagctcctgaggtgaacaaggaagacaacttttttttttgtgacgaaaaaaaaaaagttacagctgtcaagttttctggaacaagcaaatttcacataggtttggattgcaggccaaaaagtcacaatataaatttacgaggacgaataacagataaaattttataaagattaaaaatgaactttgagcattttgtatagacaaaaaacatattttaagtcaattaataatttctggtttttataattttatattaatttatcatgaatacttttgatccccccacccctctcttcaaacatccaaaaatcatttttttcactacattttgatggtaaaatcatttaacccaatttcccccacttttttgccttgtaatggaggtattttttgtcttgttatgtaggcaacctttgatgatgacgatgattcaacaagagattacatgcattgtaacaatctttaattaacattcattggatactagcttgatgttttgtatgttccaagtttagtggattaccagtaacattttttggatgaaatgtatttataacttgaagattgatcactagtctttttgttcaaacttgcctcatccccgctcttaatgatcaaattctgttctttggtgcatgtatgtcttccttggtacgttatctcaattattgctgggttttcgtctaacctttgaacttgtttttttgctaggcacccttgtacagatccatatgcgcatttgtaatatcctctgcaatgcaaacgactagttttgtcaatttttcggcaaaactagaaaataacttctttttatgttcttaatataaagattaggctggcaacttagtatggtacgaacatcaaataaaaatattaatagaaacccctcttgttttaagccttgataaggaagttggagaagaaacctacattctctttttagttgctgtgaatgttatagtatagttatgtccaaaaaaaagaatgagatgttatctggagtttgtggttgttctcggttttaaattttcgtaaaggtagttgtcaaatgaacaagtttttgtcgagaatgtcaataacaagtttccaacagaaagcactaatttgggcccatttgaaaccagctgacatggtcctttagttaatttttcaaattgcaagtcattttgaaaacactgggggcatagaaccattaaaacaaggaaagagaactcattgtacatgcatattttattttccccattacgctcattagctaattggctactgattttccagttaccaggcctaaggcctctggtattaactaaacgagaggggtgaaacttgtacgtcaataacctagagggggtgaacctttctgtcacattctaatcaaatgcaattatataaacttatactacgaaaaaaattgctaattaaacttgtttaatttataacaataaaaagttaaatgagaatagaggttttaactaaccttgaaaacttagctccaagaatctcttttgcccatattttatccaattatatccatcatctaaacacccttcacattaacgcttaaaatatctttaatattagatcttggagatagattaagatctaacatttccaaattcagcaataaaaaactatcaaaaaatataaaatctcaaaatcgagaaatggagatcaagcttggagatagatcttaagctgaagatctaacatttcccaaattcagcaataaaaaactatcaaaaaaatataacatcttcaaaatcgagaacatggagatcttgatctccatgttgaaaatccagttcttcaggaaaaaatgtgtatatctgcacagattccaaataaaaaattattcatcaacaacattaacaataaaacgcagaggtaacagattcgttggaatgaagtaaaaacacaacaaatataaatgaagaagaagaaaaacaaacaacgcattggaaaaaaaaacatatcaggtgaagggggctcgcgtgtgtggaggaaaagggaggtgggggttgcgcacgcggaggagaaggagaaggtggagccgcaacaaagaaggaagaagaggaagaagaaaaagtggaataacagaggagagagggaggaggaaaaaagaagaaaagatagttttggaagttgaagaagtgaaaagaggagagagggaggagagaaaaaagtgaatagtgaaggaaaaaatggaaaaaaaaactaaaaatatatttaaatatttaaaagtgaaattcacgtgcaatccattagaagttatataagatttcaaaaaatatctcttaagatattttttaatatacaataaaagtagactaaggtattctgtagaacttgaaattcctattgaatattaaatgaaataatttctttgtgtaccgtgtttagcatctaaatgttttaagtttttaattaatgagtttttcagcacttattatatcttttcagcaaacacattcgacgtataatttacaggtttatcaaacatgctctaatgtaagtaaaactgtgatataagaaaacaaaagcaatcaatcacgaacgtgaaagcatctcaacctgtctattactttttgatgcatttgtaatatttttggctagtaacgactttcgctttggcttcatgtttcactgtttgaactactaccacagatgaactgggctaaaggtgacaacagtatttcaaagatgatcatgtgtagaacttgaaattccctgaaaggaaaacattcaagtaatacatacgaaaaatgaagctaagagggtatgatcatatagcaaaagcaattcatacagagatacaaaattatataattataacactagctcatatgacccatggttggagtttgatgagtagggagataaatatgaacagacttgtttatttaaatctccaaaattaagtatgatcataaagtgcaggaaaaaaaattgccacaatttttaaagcaccaagaagaattgttgtgaagttaattttgttttgacataaaaagatgtcattaagaaagagatatacaaaaataggaagatatcctacacatgaaaacttatcatagttattaatctcacatagaagtacatagctttaaacactatagcaggaagcacgatggtcattttttaaatattataatgcaagctaaatagtttatactacatatatattaaaaataagaaagaaaaaaatccaaaattaaagaaattcatgataaatattatttttttaaaataatataatatattttaaaataataatatataatgcaagcacgatggtcattttttttaaatattatattttgggtggttcggctctggattgggctccggattcgattcccggctagggttcaacatcaacaatatattttaaatattatttttattttagtaatgcaaatttgcaagacaagtttttttattcaaacttgcctcatcccaatctcaatgatcaaattctgttctttggtgcatgtatgtcttcctcggtaggttatctcaaatgttgttgggtcgtctaacctttgaacttgttttgttgctcggcaccttgtcattctatatgtgcatttgtaatattctctgcaatgcaaaccactagttgtcaatttttcggcaaaactagaaaacaacttttttatgttcttaatataaacattagactggcaaagttagtatggtacgaacatcaaataaaaatattaatagaaatccctcttgttttaagccttgataaggaagttggagaagaaacctacattctcttttagttgctgtgaatgttatactatagtctatgtccaaaaataaagaatgagatgttatctggagtttgtggttgttctcggttttaaattttgtaaaggtagttgtcaaatgaacaagtttttgtcgagaatgtcaataacaagtttccaacagaagcactaatttgggcccatttgaaaccagctgacatggtcctttagataatttttcaaattgcaggtcattttgaaaaactgggggcatagaaccattaaaacaaggaaagagaactcattatacatgcatattttattttccccattcattagctaattggttactgattttccagttaccaggcctaaggcctctggtattaactaaacgagaggggtgaaccttgtatgtcaataacctagaggggtgaacctttctgtcccattcaaatcaaatgccatttatatgaacttatactacgaaaaaatttgctaattaaacttgattaatttataacaagaaaaagttaaatgaaaaatagcttttaactaaccttggaaacttagctccaaggatatcttttgcccatattttctccagctacgtccatcatcaaaacaaccttccgcattgacacttatcttttctctccaaacttcagtttgaactgttcttagtttacgaacctgttaattgccatgccaaaatataaaaaccacaatagtcttttattcaacatgttaggttcgtgaaatttatttttgtttaactaaagactatagagacaccgcctacggacacatcttcacattggaactcagcaacagtatttgatctcgattcatgaataaaaccatcatcatcatttttcagttggggaagtagcttacattgtgttgaagctaaagatcgatttgcaatatagagaatatctaccttctgaatcttttgtggtataattgatgcatagtaaaattagagaacaaacaatttcaagttgcaggcgtataactccctacttatatgaccatgcatcatagcttcattggaatgagacatttccaaagtgatgttttccttttcttttctttttttcgtgacagcaatgaataacttaagttgctgataaagagtaagcaaattccactaaaaatggagagaatccgtctgttagcactttcagacccctctaagattcacttctaactagggctgtggcaaccaaaaggccatggccagttaagtagttacgtttagccttaaaaaatttatactttttgaaaaatatttattattaatttgaattattaggtgataaattttataatgacatatattactatttttattattaagactgtaattttaagattgtattaattgaacaattgaaaactttagatgaagatatggattgaaaatacttttaagttctactaagaattataatattgaaaatcttgatttatttattgcaacaaggatagacaaaaaaaattcatatttcactaaaaacattatttatttaaaaaattgtatttttctttcaaatacatgcattgtttctaatattattaataatacttgtaaatattattattattattaaaagtagttttttaaactaaaaatactcaaatcttttttaacatactaaaaatcttatttgatatactaaaatcttatttgatattgaaataatttgaatgattttgtcattttatatattgacaataaaatgctagaaatactttacactttctataaaactttgatcaataatttcgtaattgataaaaaaataaaataaagtatgacaaatattaaagaaaaatacagaagagtaagcaaattataatattgaaaatcttgatttatttttaaaataaagatattgcaagaagtatagaaaaagaaattcatatttcactaaaaatattgtatttttctttcaaatacatgcattatttctaatattattaataaactagtaattcttattattattgaaagtagtttttaaaactaaaattactcaaatctttttatgttacatactaaaatcttatttgatattaactatgttacgaaataatttgaatgactttgtcattttatatattgacaataaaatgctagaaatactttatacttacttataaaactttgatcaatgatttcgtaattgataaaaaataaataaaaatttgacaaatattaaattaaatgttaaagaaaattatagaagagagcacaaaacagagagatgaaggatctgtattagagagatgaacaatccaaggacagaacagtaaacagagcacggcagcaaaggtcgcggttggccagaaacagtgacaggttcgccagaaaatggccataaaggtcaggaatgaccggaaactatggagaatagaggctgcagaggttggggatggcaaaaaactcacagaaggcccgaaaatgcagggaaatgccaaaaatgttgccagaaaaggtgtgtattggtgggaaaaggataacaatgtcataacagtgtgtacaagtgattgagaaagcagagtttcagttgtgattcaaagaagggggcaaaatcattgcccactaaaacaccctaaatttaatggttaaattaaaataggtttttttgtgatccactccaataaagcctgctccaggagcaatttcagctattttgctagatatggcagctgtgatggtcgctacttcaaactgatacacttttcaattttcatagcatgctctagccgctctgcaatgcaattctgcgctagcaccactatttgttgctattggcaactagtcatatgaaaactgaaaataattctttacgtgaaatatgttgaatacattcagcacattgctgatactgaatgaataaagcagcaactacatcctatctgaataattaaatgacaataatttcctttggtgtcaccgtgtttagcatctaaatgttttaagttttcttaattaaatgagtttttcagcacttaaaattataatcttttcaagcaaaacacattcgacgtataattttacaggtttatcaaacatgcctctaatgtaagtaaaccaactcgtgcatataagaaaaccaaaagcaatcaatcacgaacggtgacaaggcatctcaaacctgctctattaccttttttgatgcatcttgtaatatttttggctcagtaacgactttccgcttttgggcttcactgtttgaactacccctacccacagatgaaactggggctaaaggtgacaaaacaggtatttccaaagatgactttgctatcgactgtgtagaacttgaaattccctgaaaggaaaacattcaagtaatacagtacgaaaaatgaagctaagagggtatgatcatattagcaaaagcaattcatatagagatacaaaattattataattataacactagctcagtatgacccatggttggagtttgatgagtagggagataaatatgaacagacttgtttatttaaatctccaaacataattaagtatgatcataaagtgcaggaaaaaagatttgtcacaatttttaaagcaccaagaagaattgttgtgaagttaattttgttttgacataaaaatatgttcattaagaaaaagatatacaaaaataggaagatatcctacacatgaaaactaatcatagttattaatctcacatagaagtacatagcttaaaacactatagcaggaagcaggatggtcattttttaaaatattataatgcaagctaaatagtttatactacatatatattaaaatcaagaaagaaaaaatccaaaattaaagaaattcatgataaatagtcacattttatgcacagagtcactatcaatctgagaacaaaaaaagcatagtaatagtaatgaagtaaaagaaatgaaggatgatagtaaaattaatagaaaaagaacataacgagttatatttttcaaaaatgcattaatgtattattttaggtatgttgctaacttttgttttttcctttccctatctatttatctttcaaaaacactgttcagattgaccttgcttttggggcctccaagatcaggaaaaactacactgctgcaagcacttgctgggaaactggacagggatttaagggttggccatcctcttgctccatttttaaggaacgatgcaatgatatcttcctacatatattttttcattaaatgataattttgcatgatttaggacttgcttttaactaaccaaaaaaaacccttcaatatttctccacatttggtgtgtcagtcagtgtcagtacgtataaaatagtgatacttcacgtgttaagtgaatttaaaaaacttatcatcatgtcagacagcatatatttccaatcatatctgtcatatgctaatgctttgaagtgctcactcgctgcttttgagttcaactcattccaatcatgatcatgttaggaatatggtgaattggagtgttcattcttctatctttttctcagttgcgcattatttctagtatggtgaatatgattcattttccattattgtgattatagattgtacttctcacctaaggatcatagacaaggaagttcagtaaaatgaacaacataaaactggtaattcttattattattgaaagtagtttttaaaactaaaattactcaaatcttttttatgttacatactaaaatcttatttgatattaactatgttacgaaataatttgaatgactttgtcattttatatattgacaataaaatgctagaaatactttatactttcttataaaactttgatcaatgatttcgtaattgataaaaataaaaataaaaatttgacaaatattaaattaaatgttaaagtaaattatagaagagagcacaaaacagagagatgaaggatctgtattagagagatgaacaatccaaggacagaacagtgaacagagcacggcagcaaaggtcgcggttggccagaaacagtgacaggttctccagaaaatggccataaaggtcaggaaagaccggaaactatggagaatagaggctgcagaggttggggatggcaaaaaactcacagaaggcccgaaaatgcagggaaatgccaaaaatgttgccagaaaagagtgtgtattggtgggaaaaggataacaatgtcatcacagtgtgtgcaagtgattgagaaagcagagtttcagttgtgattcaaagaagagggcaaaatcattgcccactaaaacaccctaaataaagttgtttaatggttaaattaaaataggtttttttgtgacccactccaataaagcctgctccaggagcaatttcagcaattttgctagatacggcagctgtgatggtcgctacttcaaactgatacacttttcaattttcatagcatgctctagccgctctgcaatgcaattctgcgctagcaccactatttgttgctattggcaactagtcatatgaaaactgaaaataattctttacgtgaaatatgttgaatacattcagcacattgctgatactgaatgaataaagcagcaactacatcctatctgaataattaaatgacaataatttcctttggtgtcaccgtgtttagcatctaaatgttttaagttttcttaattaaatgagtttttcagcaattaaaattataatcttttcaagcaaaacacattcgacgtataattttacaggtttatcaaacatgcctctaatgtaagtaaaccaactcgtgcatataagaaaaccaaaagcaatcaatcacgaaaggtgacaaggcatctcaaacctgctttattaccttttttgatgcatcttgtaatatttttggttcagtaacgactttccgcttttgggcttcactgtttgaactaaacctacccacagatgaaactggggctaaaggtgacaaaacaggtatttccaaagatgactttgctatcgaatgtgtagaacttgaaattccctgaaaggaaaacattcaagtaatacagtacgaaaaatgaagctaagagggtatgatcatattagcaaaagcaattcatacagagatacaaaattattataattataacactagctcagtatgacccatggttggagtttgatgagtagggagataaatatgaatagacttgtttatttaaatctccaaacataattaagtatgatcataaagtgcaggaaaaaaaatttgccacaatttttaaagcaccaagaagaattgttgtgaagttaattttgtttgacataaaaatatgttcattaagaaagagatatacaaaaataggaagatatcctacacatgaaaactaatcatagttattaatctcacatagaagtacatagcttaaaacactatagcaggaagcaggatgggcattttttaaaatattataatgcaagctaaatagtttatactacatatatattaaaatcaagaaagaaaaaaaatccaaaattaaagaaattcatgataaatagtcacattttatgctcagagtcactatcaatctgagaacaaaaaaagcatagtaatagtaatgaagtaaaagaaatgaaagatgatagtgaaattaatagaaaaagaacataacgagttatacaaaaattagcaaaaatttgaaaataccaacatgccaataacaccatgaaatttgaaaagaggataactaaaaattacctgatacgtcgtattgtgatattcatttagttgagtctcttgaagtgcagctagctggttcatcatgtcagcctcctcgttaattggtgaaaaaattcgctcaaaataattgggtcgaccagcatctccccactctgctacattccatttcaattcttcccaccagatgctttctcctttgatgatcttcaaagatttgcttgacaactctgatttggaaagactttggagttttgggcaataataaaatatcatttcttctataaaaggtccaacatgcatgccattaaaaatgttgaccaattcaggaagatagagaagcgatatcattctcaacttggggaggaaaaacactggatattgttctggtgtggcatgacttatcagggtggttacttttggacagtcttcaacaataatctcctccagaaaggaaaggtttttaacagaatctaaggtgaatatggtagttaacatggggcaagtgtgtaatgctatagactttaagcagagaaagaagggactactcccttcgcagacgcttcttaaattcttcatatagaatacactcaaaaacttcaacattagagaagctggcctatcaggtgaattgcttccactgacaattgtttccatttcattacactctgccaatatgcatacttccaactcccataaattcctcaaatcgaaatcagagagactcttgatggtcatatgtcggtctaggtacaaggctttggagcgcccaagatgcattttcactccatttggaacattcacaccattaacaaactttatgctatagtcacagtgtttaaattttgtctccagttcaggtggtacacgcgatatcaaacgtcgcatatgttgaccaacaaccaatctgaaactgagagatttttgggctggtatgactttcaagaagtcagcctctgggacatatatactcaacctctgcaaattacataatccataacaaatttccgccaagacactaataacattcacattccatcgctcatcttcagggtcaacgttgatgcttaaatacttcaattgagtaagatttgatatcaatcctggaggaataattgttgacttggaagttccatcaaagcagaggcttaagctttgaaggttgatcaattctcggatctctattggcagatgggtgatcaaagtcccatcaagatcaagctctttgagattctttagctgtccaatctgatgtggtagttccatgaagagatcacagcctctaagataaaatttctgaagttgtattaatttagagacagaagggggtaaatcccttatactagtgtaggataagtccaagtgttgaagtaggggcatgtggttgaaaaatgagtcagggatatccatcaaatcaacattgccctgcaacaacaacactttgagtttagggcaatctggtgattgtggtaattcacatattttattgtccatcaattctatctgaataagactatgccatcgtccaatgtagggtggctctgtcaatcctaatgcaccatgccttaggatggaaggctttgaggtgtgcaatgattgtattatatcataggtttctactggcaaatagacatctccactttcatatttcaacaagacaaaacggtcttgaagctcattgatgtaatgttgtaattgccttctgtattcaccaagttcttgtgtgtatcctaatattgtcttagcccaatcagacaccaagatatcatctctcacgccatttttaatgttgtgaacaggcaaactgagttcaaggcaaagcttttgtgcatcaccaatgtcttcccaaataatatttacgaatgcattgaccatgactctactaatgccaattcgatcactatcttgataatcataggaaggattcagactgcttaatttgtcaagtgcaagttcccactgtttaaaatcttgcacatacgtaagatactttgccacaaggacaatggcaagaagatgaccgtggcattccttaactatttccactgcaattttctgaatggccattgatgaacgtaccatgctactgctgatacaactgccacatagctgcagaagactttccaaggcaatagatgatcctgggtccaaatattcaaatccattgtgcatgcaattctaaagtcaacatccttctctgcttgtgttgacggctcagttgttatcaacaccacaattccagttggaaaacgcaacttttggaggtccagcttgttgttgctatctgcatccactacaattaccaactgcccattgcttcccatgtcatcaacttccatcatcatattgacatcgatttcttcctgaactcgaacctctgcatcagtctcatatgttgaggcattgatccatagggctctaagaaaatctttgtcaattccaaacatggtgtgcttatcttcaacggctgaagctattgtgtccactacagatcctttttcagccaagtttctggttaacagtctgatatagcgtgcacagtaatccccagaaaacaaagtttgaagtagttggttaactgcgagatcaacagattgttggagaatggcttctggtattgcatcaacatcattatggctgatgatggatctctcaccactttctactttacttattatttccattggcataaatcccttcatagatcccagtgccttctcagttagtacacaccatggtttgtccatcacagtatcatcaccagtggacaataactgagctttccattcaggaaatgcactaatccaagatcttaaaatatattcatcttctaatttcacgggataagtcaacacgaggctgataaaatctcttatcctcatcaaatctgacagctcatcattgtataaaacttcatctttatctgaagatgttccctctgcttcattttgaagagttgaaaatttaggacccaatagagttattatatattgaacaaattcttcaatctctgtatattgtggcctgaaattttaaagaaaatgaagaatgcgaaatcatcacccaagagaagcaaaacaggagaagataatagaagagtagttttcaacgtttaaataccatttgcatcaaacgtcaaacatttataataaatttggacccaatttgcaagttacatctttcatgagatgagagcgggttacttacttaattgggatataccaaccagagagattggccactcgagtcagagcttttctccatgtcagcatttcctcaatcctctctttatctaccaagaatctttcttcgtgtttcgaaaaggctttctcgtaccatccagtctgttttcgcacatctgatggatcaacatcataaaaaataggcagaagacgtcttggcgaagtttcaatgcaattgaagatgtgtgctagttcacgcaaacaccaagttgaggaagcatagttctttgaaaggaccacaatgaaaaggcgggagccttgaattgcatgtaacagctcgggttcacccttttcgagaagtgtatgacctttgaaggcgacgatgccttttcttctgagagcttgaaaaagaaaacctgtgaagttggtgtagttgttgcgtgtgtcatcaccgtggaagctgagaaacacgtcatacgcagaagagctgctctggacgctggagatagaagccattggaattgcgaaagtggaagtaaacttgtttgtgaaaaaggacaagtatttctcgattgctggagttggggagcgcacggaatgcggtagttgtaaaatgggatccaatggaagaaaagctgtggcctgtggcgggaattattttaatcaattactctcaatttgatttattttaaatttttaatcttatttttgaaattttaatttcgcttagttatataattcatcttttaattatagttaataattcaactgaatccattaattattaaaaaattcaatcaaataatttattaataagaaattattaatccgaatgataccgaaattaatttctttaaaaaagattatacataaaaaatattttacataattatattcatattcaatatatatattttttattttagtcgtaaaaataatatgattataacatttttattaattagataatttaatttaacttttaataataattaaatgatcaattatataacgaaagccttctaatttttacatatgatcaacatcatcaatatcaatacaactaaagaaagcaaatctctttctaacatacttatcattacttaagaaaagaattctggcacaatatttctttctttttcttttcttttgacttaccacagctcacccactcacccccaaaatatagatcttacaataatatattcccagtgtgaagcgtctgcatacaggctagcggaaaaatcatgctacagcatattacagcgcgttctagtagcttttattactctaacttcagtatgtaaaaacttatgattcaaccctttagtaacacacttgatcattatttatgcacctcggattagttctcttttctgtttgacaataaaaacaattcaaatatagacaattacaataaaatcttaaattctaaagcaatcattaagaaacacaaaaaaaaaaaaatatatatatatatatacacatatatatatagtatatataaaccttgagactagaagtagcaccatttaaaagtagtaacttattgaaactcggacggatccaggaatgcatagcgatttttttttttacacaattatttaattatttatttcaaataaataataatttaataaataaaaaagtttcacaaaaatatttattattaattttatgtgtaaaaagatcaaatctactactaaaattaaacaaacattaactcaatactctatttttttattcattttttattaacaatattttctttttcttgtttctgaatccgtccctattgaaactgatatacaaaatgattggaatgtatgtgagggggaatcaggagcaagagttaagtaagaaagattcatgtgtacctctgctgctaactgttaagaattgagatccatctcaagtggtgagtgaggaatcagaagcaacagctaagaaagatttatgataatgactttgtacctctgcgagtgcgagcagccgtagccgacagatcttcttcaccctgattttgcaaaatgatcgatcaagtgtttgattattgcttgctctgtttgtttcacaatggactcaagtcaacgcttttatcacttgaatgtgtggtttcgtctcgataccaatataggacaaaaggtaaatataatgctattgattatttttttaaggctaatagtattgattatgattaaattaaaaaatatatgtacaattacttttacttttcaatcaaatatgattttttatcatcttattaatataaaatatctattaattttgttgataactaatctatatatatcttatttataacttagatcaaggagacttaatcaaatatgtttcattatatatatgaaatatatgattaacataaatatatttaaaaatctgaatttattttattatttaatgtgtttaaataaaattgatcttttgtttataatgtgtttaaataaaagttataattttatttttcactaaattgatctgtatacaaatacatctttttatattttgatttatcagtcaattaataacgaatttcaccaaggatctattgtcattatcaattatcaactgaaaaggctaactttttttttatatgtgtttgcttaatattttaaaaaaatattaacaatttgcttaatatttatctcttaaaatttaataattgtttctttaagttcattttatttttttgtatttgactccttctatccttcaaaaaatttgtttttgtaatgagagaaagacagaagaaaagaaaacttaaaatttgaatatgaagaaaagtcaaaagaaatttgattttttgttgtttaaaaattaactccccccccccccacaccttctttctattttttctcgttaattatctatattttgctatcttttttttttcattcaaaccaaatattaatcttatacatcataggtattttcttttctttctatctcttcgttcttatttgatcacctccttataataataaatattatttgttttatgatcacattgattacaaacttgagtacatgagattatatattgtatgcattatactactataatttataggctttctacatcggttatacaacacattcaaagacggagtgtgagagagaagaggaagttatagggtctagcgaagcaggaaaaggggtgtacaatatacatatttttacgatttctttcaaacccttttcttttttctatttttctatttcggattcgaaccattttgttgtaaatgaaagaggtggatttttgtatatattgattgatatcgatatcgatatgcactttcgtgagatcgacacagattacgagtaatctatttgcattgacaaatcgattgaaaatggaatccatgaaaaaaaaatatttttttgtttatttaaatattttccctatattttctatttatagatcttgatatgatcgagcaggacgaatattgtggtttcaagggttaatgtgagagcgaagccacatccagcaatgtgagaaaaccctaatggaggaagaagagaagaagaagaaggacgtgagtggtgagaatatggaatcgcgcccgtggagttgggaataagaagagaatgttcaagaatcacgagaaggaggaacaactgattcaaagacgatttcgtaaaagcaactttgtattctcttaatctacattggtttttaaataaaccaatgtcgtaatgagttttcaaagacgatttttattgacctatctttaaaaatttgcaattacttacaaaaatgccaccacgtcttctacgacatcaggttttgtgaaaccgtcgtaaaactgatgtcgtagaagactgcttttgtagtagtgttattttgacaccttctttttggtatgatggccatagtggatttatccttatttagccttctttcctatcttcgattatccttctaaactcgttcacacctcatcatgctttctttcattaattctcaagcttgatctcactctcactctcatattacatgatttgatgagttagaaaacatgcacgcccgcatgcaaattgtttgacaagaagaagaggcaggacaaacattaaatcccaaatactcacactggtctcataattctctctcaagaaagaaagaaagaaaatggttgtaaaatcaagaaacaaagatggtacattttgagatttgagagataattgtgaacttaagtgagcctctgagaccaattgagataactgtttgggctgtttcttcttcttaccaaacaatttgaaatttgaagaatgaatatataagagaaagaaaaaagaaggccagggagaaatacaggaagggaagttttaatttgtcaatgttcaagatgatagaaggaaaaaggttagaaaatttcctccaaatttacacgtttatttcaataaattcttttatttcatagtttagaatagaagttaagagatctcttcttaagaggaaaacttttttaatttaattttgattttgaaggaaaatacgcacgagtttttcgtgcaataacgcatgaaccggtggtctttgtcaaaattcattcagagttatttggtatgagaaaatctttacaaaaatgagtacaaagcgatagaaattcataaccacacataatgggtccctataaaaattgattttaatgtatctgcaatttaacattttgagtcaatcatattgtttggttaaactttcatgaatttggattcgtacaatatagcatttttcattcatttatatgtgtttaatttttataaaaaataaaaaaacattggtccacatcattattcatgcgttttgtgtcttatgtctttcgtaatgaataatattactgaattttgatatacttattagcgtaattttttatactaccaattaacatattaaaatcagtttaaatattattattattataaaaagtactggtttttaattatatgaaaactcattattagatttacttttgaattatagctttctcaaccttcagtatacttttatatctttcacttttcttctctttcaaataacagaaattgattactattatatatttgctaaaatatgtttgatcttataaatatttgaattttatatttatattctaataaatttttctttgtattgaatttttaataaaataacaatttttttgttctgtcactactttttaatatttgataaattaataaattttatgttttttattttattttctatacattattaatgtataaatatattttttctacgttggagccaacgaattctgacataaaatgatgaaaaacatatcaccaacttccttatatctcattttttcttgtggatttcaaactcatctctttcaattcattcattcaccggtatttttattctcttctctttttctccgtaatctatctttacacgctcaattattagtttctctctattttgttcattttcttctccttccctcacgtgaaagaagattcgtttaatgcaaacattattctttgaaatttatttttttcctaacacccagattatccaacattttctggcagtttgacaagcattttcattatcctccaattcgttgtaaccgaaatatcttaaatttaaggttggttgctgagaaaatattgtggtttcaatactttttttataatgaacattttggggggtttcatcacttggaaaatgaaaatgggaggagggggttaccccatattcttattatttatttatttattatgaacgaataatgtacgtaaattcatgcatttatctaatgctagtgtaaaaaagttcaatatttaacacacgtacaacattgcaattttgatgtctgctgataataccaaaatttgaccttttttcttaatggaaactgggtcatattaatttattcaaaacaatgtcagcaatacatcaccgaactgatagagaccagctaaagaatttgcctcctagctaaactatgaccgacagaatttgtgtgtctcataacaaagcaaacgctgaaatttggttaactatgaagcaagttatgacattgatcaattattttttaactcttattttttatgcttgatctatctatctatcttccccttaaagattaatcagactaatctgcaacggagttattgttgatcatgttaattattcaaatatatttttgtttttttggggggttgggggagagattaaggaactaattaaggattattgtagcagaaaagttttgttattatagcatttcttgagggatttgttttgttagtctataagaggatatttctttctttccaggtagtttagtttggctgctattactgaagttgcagttttgaacgattgctggcttcaagggtgccaatgaataatcaaccgttggagtttgggaggcctgtctcaagtatgctatgattcttaatttcatactctcatgtatttaactgatttccccttattaaaatcaatcatttactttcttttctactaatttactccccctcttaaataaggataagaataaataatgattaagggtaagcctaaaaaatttataatcaatacttcattggttttccgtttgttaatgtcctaaagcacattcaacccaatccatcgatagtgtgattgaactgaacgtccgtttgaagcttcttaatgaaacatcaaacatacttttaatagataaaactcggaggatttgaatccatatttttttattgaagttggaatgattgatcctgatatggtacttgaatgactgttgggtcacgtgatggcttatgcatttatacagtttttctctggtgtatttagtagttattgactaacttcatgatccctgatgagtggtttttcaccctaccagagggaatacttaaagcaagaatatttttccatctttattaggttgcatatttgttgtcaatgttgttgcctagtatttttaatattgttttattattttggtgcacgtaaggtttctgggatttcaaataatgactggatggttgtgactggaaactgtctctataccaagctttattggaatatttggtcttcttgtcaattgtttggactcagagagcttgattttaagcatagcagcttaagattctttagaaattctattacagaaataaagggatgtttcaaattgtgctggaagtggtgaacagctcatcattatacttataagtttattaattttatcaatatattacaaaaacattttcaacatattgtatctcttgaaaaccaaggcttagacctgttggcttttgtaaaagctacaatgcaaagtaagccttttaggttaggccaagcagaaaacgaatagcctatttcttataatagactggactcatactttatgtttgaaaaacaggcttaatctgtttaaggtaaatctgatgttgcttatttccatgtccaattgtcaatgtaaagttattttcacttatttttcttgagaagttgaatgattggcaggtttcttacaggtaaaagaagagtgaaggatttattgcttcaaaaagataatcgcttttgtgctgattgcaatgctccagatcctaaatgggcgtaagtgtattcaccattgtacatttttttgccgtgtgtgtgtgtggtttatggtcatggtcaccgattataatactcaaaactggagtctgagtgttgaatattttctgggaagaatttataaagcatccttgtgattaaattgtagtaaactggctacatgaattttcctaaattgataatgtggaatgcatagtacctctaagttgtgaatccatttttctaactgcttctacaggtcagccaatattggagtttttgtatgcttaaaatgctgtggtgtgcacagaagtcttggctctcgatatcaaaggtaactattcctaatccacttaagagtttagaaagaagattttcactttactaataaggaatttaaactgagttccttcttcaattgtctacaacaaattgagaaactaatatacctatagatgtggctaatcattttttgaaatgggttcaacttgatttgatgagaaaagaatcaaccactcttatatgtctatactcatgaatagtccggtgaactttgctttgtcaggggtgcattattttgtttcagttttactgccttatgttgtgggggtttgcagggcagccttattcttagattccatcccacaacatgctgtgatatgatatcttgtgaaatttagacaaaagaaacactaaaattagtgatctgagactagaagtgaaaacttttcaaataaggtttcttttcaatgtactatttatttatcctgtaatatagctgtaatcactaatctttcaggaattttcattgttaaatgaataatactggtaggaaaggaaaataatatcttatagataattattacaaggtatctcttttcatgtctaattatgaaatgtgaactttcaatttagtgttgccctctgccactggatcgtgttatttgagtttctcttggtctttattgtcaaatatgcacatttttctttacgtggtttaaaataaaaattcagaatttgtcaacttttatattagatacagggtgctagtgattttttacatcaaagcagatagaaccaacagctagacacaggttctagctgtaataagtgagaagtgagaaaggaatctctgcaactcttagctacgaagtaaacttgttattttgattaccaaggtcattgcattggacttttattaaatctatgaagtatgatccacattttaagaaagttagtcatgtcaagtaaaacttagtttaaagcttatgtagcatgaaattaggccaaataaatattcagttcttcacagataactaaatgatagatagtgtgatcattctaccagtgcattaacggccctccaaatttatcactctgcctactagttacctgtgttaggatttcgtataatgaatgtactatagccaaggtgctgaaaggcgtacctaagccactgaggcatggtgcatgaagcttttttttatttttttttatcattttatgctgctctcttttcaacgagttgtgtctatcaagttaatagtgtgctgaacttatttatttatgcttggtcttgtgtgcattaaagccttgggacattattttcttactttcaggttttgtctgtgacattggatgaatggtcaagtgatgaaatagatgcaatgattgaagttggaggaaattattctgctaattcaatttatgaggcttattttccagaaggatatacaaaacctggaccagatgccagtcatgagcagcgtgcgaaattcatccggttagatatgttttcatctaactttacactgtacatctaccattcttagcatcattttgcttgttttataaatctattatatattatatttatggtcacacaaaatgggtaaaagctgtagtcaactttatatgatatagatactaacttctgtgccctcattgcaatttttttcttctcatgttttcttttttcttttttaccattttgctttgctgagtcatttattttcaagtttctgttttttttggtactctttttcattcagtccattgtcctggttgataatggactaaccggcatggcgttgggattgctcatggtagcatcatctatgatagcaatctgaccaatgctcaagttaagagtggcattttaattgtggcaatttttactgcaggttaaagtatgagcgtcaagaatttttgaaacctagtttgcgcattgtgtcaggaaaaagcaatcccccatcaagtatatccaaagggattatggatagttttcgaattactagtgattcacagcatatggtaattatattttatactttagttcctttgatggatatgtatttgtttgttggccacatgttgagttagcatatcaaaggtaactgagttaaattgatgttgtacccagatgaaagccttctaatcgagataattatatatatacagcacttgttgcatgcatccaactttactacttggtagtaaatgaaacgaaattattttcgtgagtggtttacttggatgtttgactgatatttatggttaaaacaggaaggaatggtagaatttattggaatgttaaaggtgaaagtgatcaaaggcacagatttagctgtcagagatatgatgacaagtgatccatatgttatcttgaaacttggccaacaggttggttgttctcagttctcattagcataaattatttcatgggaaactttcatttttaattgaagagtagtagatgctgataattttctttctgaattgacttcggtgctatatgccttcagactgttaagacaactgtaataaagagtaatttgaatccagtctggaatgaggaacttatgctgtctgttcctcagcaatttggaatattgaatttggtaaggttcaatttcatcttgtcttgttaggaaatggaaacaaattctgtgatgcttatttggtggttggacatttggatcttcatacgtgatacttctatttgtctctctgtgtgtttgatacagaagatacaaaactcattctggtgtaaaaacatggaactttatcctaatgatttggttacattgcattgcagaatgtatttgattatgacttgttttcggctgatgacataatgggggaagcagatattgatcttcagccgctgataacatccgcaatagcgtacggagatgcaagaatgtttgatgatatgcagataggaaaatggctgaaatcccatgacaatgtgcttatagatgatagcacagttaatattgttgatggtaagattaaacaagacatgtcaatcaagcttcagaacgttgaatctggagaattagacttagaactcgaatggatacctcttgattattagaattgaatgaagcattcttggattgaatggggaacagtaattccaaatcaataactgcacggcacgtcagaaaaaagaatgctagaattgctttcattagaatagttttcgtgtaaatgcggtgtgaattcctacctttctcataggtattggtttgaatttctcgacattatttctctcgcttggtggaaatattaatataaattctcctccaagaaatcctctagcactaggttctgaaatttaaactattaacataaactttgaagatttatattaatgatataatatgttatactaatatttgatgtattgataatatataacaatattttatattgtcaaaatttgttaatataatatataattttgttaacataaattcataatgtctctataacagtcttacactagtttaattttcagtagaaaaaggttacactaacataacttaattcagtactaacacatttttattgaataatttaaaagaataggtaaaaaaaattatatgaagatttataaattttctcaatgaagctgtttttttttacgaagctggtgttgaaagtggtcacaatttaagttttgtgcataattgacatcaaaatataaatgccacatatacattcattatttgaacattaaaatattaatgccacatataatcatttttaactcttgtatttttatttttcatagacccacgttttgaatgtatatcccaaaatcaaatatatttttttacagaaaaataaatagattatttaatgagaataattataatcatacatctacttttcttctacttcattttcgaccttttttttcttatttatggtaattatctacttaattatcaaaataaaatgtacgtgtattgtcaaaagtaccagcaacaagagaattagtgtaatcctagtacaaatgtagggcacgcttgtaattttgactcatattttttgttaccatctttttctcatactcgcattaaaattaaaacttagttattttgtcaaaatggctaaatgaaaaactaatttgagtaaaaaataataattgtggaatgaagggaaaaaccacaaaggacactaaaaatcgcaaggacaacagtacaacataaaaaatgcgcaaacgatcatcaatagagtgagcattatttgctaattaaggtgtctgtcacctgattaacttatcgcagcgtatgactccaagagaaatcaccatttaaggtttaaattccgttaatatgtattcctaaaaaaatacattaatatggagtatgacgcagaagaactaatgaaaaagattgtctctaaaaataaaaaaaattaaaactttgacttccaaattccaatgaatcttttttttagaggaattccaatgaatttattacgtgaactcttactatatatttttatccgaccatcacatgataccatattgttaacaaaagacctttttttttatggcaacaaaagcccgtaaacaatacaatgtggacacaggcaaattttttaaaataatataaattaaataaataattgggaaaagggggtagttggaacaaaatttagcaaaatggggtgatgaaacacgcccagctggggcgtgtttaaacacgcccagatgaggcgtgtttcaccagatggcgccacgtggcaggctgaaacagtgtcctagggttttcgcgatgttttcgtaaattacggaaggtcgtaacttttgactgggacgtccgattgacgcgaaaccggtggccacacgctcgaaattgagaggagaaggcttgggcaagtccccgaagggtttatgttttagggtttcagattttggattttgggtatcgaatttagggtttaggatctagggtttagggtttagggttttcagatttaggttgatggatttcagattaggttaggggtttacgttgtgattagggttttagattttggattttgggtatcgaatttagggtttaggatctagggtttagggtttcagatttaggttgatggatttcagttgaggttaggggtttacgttgtgattagggtttcagattttggattttgggtatcgaatttagggtttaggatctagggtttatggtttcagatttaggttgatggatttcagattaggttaggggtttacgttgtgattagggtttcagatatagtgttgacgatttagggtgtagggcttattctttagggtttagggtgtagggtgtagggtgtagggtgtagggtttaggatttagggtttatggtttagggtttaggggtataggggtttagggtttagggtttaggatttagggttttggggtttagggtttatggtttagggttttgggttttggggtttaggattttggggttagggtttagggttttgggggttggggttttagggtttagggttttagggtttagggtttagggtttatggtttagggtttagtgtttagggttttggggtgtagggtttagggtttagggtttagggtttaggatttaggatttagcaccattcattactcgtaatcatggaaatcagggcccttctctgtctcctttttttcttttcaaattgatctcttctcgaactcgacgtagagactagtaagccatggtggcacggtgggcacttagaggcgcagttggcaaagtaagggttccagttcgagggtttaggcgcgtgggcaagggagatttggaatgacagtaataagaccaatgcccttgctgatcacgattgtaacaagtgctttgctgcagtagtttcgctagttctagagagcagtttgcgggcattaaaggattgctccctaaaccctaactcctaaaccctaaaccctaaaccctaaaccctaaatcctaaaccctaaaccctacaccctacaccctaaatccctaaaccctaaaccctaaaccctaaacccctaaaccctaaacaccaaaatcctaaaccctacaccctacaccctacaccctaaaccctaaaccctaaacccctaaaccctaaacaccaaaatcctaaacccctaaaccctacaccctacaccctaaaccccaaaaccctaaacccctaaaccctaaaccctaaaccctaaatcctaaaccctacatcctacaccctaaaccctaaagaataagccctacaccctaaatcgtcaacactaaatttgataccctaaatcgtaatttctcgtagcaatgtccgatgaagacgtattctatgtcagaacgctcaaaattgagaggagtaattagataaacaaagaatagcttgcaattcactgattgagtacataaaatatcagaaaataaaaaaaaatttagggcttcaaaacttaaatcacagttttgagacacttagaggcctcgtttgggaaaaaattttgggcaagtcccttcggatcttgcccaagccttctcctcttaatttcgagcgcgtggccaccggtttcgcgtcaatcggacgtcccagtcaaaagttacgaccttccgtaatttacgaaaacatcgcgaaaatcctaggacactgtttcagcctgccacgtggcgccatctggtgaaacacgcctcatctgggcgtgtttaaacacgccctaactgggcgtgtttcatcaccccattttactaaattttgttccaactaccccttttcctaattattgatttaatttgtattattttaaaaaattagcctgtgaacacattaatcccacatttttcctaaaaaacgaatatggtttctaatttttcaatcaatgcgacaattcgtagtagatatacaacaatagtgcactttatacatgaagaaactcaaaattaaggctttgttttaaatttaagatttttcttaaatgaagttgatgttaaaataataattcatgtttaaacaccaccttttaaaagtaaaatgacaggtattaatttacgttttgttcgaatggtaaagtaaaataggttttatactataaacataattattttggtcgatcattccggtcatcaaaagaagcacaagatgaacagaaaaaagtaaaataattaaataaacaaataatatcataaatctagaaccgctaccctttacatgcaacgtggaatcatatatagaacactagctagctagtgggaaacaaggaaaaatcataatcaaaatcaaaatgaagcaagaacacacaacactcactcaagggttgcgtaccaccaattgcaacttgttgttgtcttcatcatttccaccttcattctcattctcaccgcaaaacgctgcgtttaacttctgctttctgtttctgtttctgtttcggttcttgaacaaatagatcaaacccgaagccactagcagaaccgcgccggccacgccgcacgccaagctcgccaccgtaagcgccttccccaggcctttgccggagtgtcctctgacaggttgccaccactccggcggcgaggcgtctccggagtccatagcccggggaagtgccacgtcggaggaggaggaggacatcgacggcgaggagtcggcgctgttgaagaaggatcgcatctccggcgaggaatgcggccccgccggcgagaatgtctggaaggtgaggccgtggtccgacggccggagctccctggcggaggaagctccggcgagaatgagtggcacgaagacagcgagggcgaaggtgactacttccatgaagagtgaatttggagtgacggttggaagaggaagcatatatagagagaaagatggaagtgtggtggagaatacggtgtcgttttgaaatgggcaatgatgagagtgggagaggcttaaacttaaagaaagagaagaagagtgggttttgttttgtctgagtgtggaaaactgtctgttttacattgtgtcggaggaaaagcttacttcctcttccaccctcgccgctctctcctttgtctttttactaactcactttttcttttctttaagcttggttaataatgggataagtattctcctcaagtttattaattacaaatttttatgtttttattttcttctcattttatgtatataaaaaaaacaataagatctgataattaaatggacacaaacatagataaaaggaagtatatagtatgaacacatgaccatcaactttgttaagttcgttaatttaatcataaaatggatacaaacattactacagtcagtacaatattagtgaaaattctatttgttaagccaacaatttcttatcataaagagaagattttgaacacgacaagtgcgagactgcaaagtcatgtgtattataaagagttgtagaaagtgacgcaagacaatcaatctaaggtcaactctcattaatgtacgtagatttaccaagaaatctggcgagtttgtcgttgaagaaattgtaatttattcccatttcccgtattagtaattgacatgcaatatagtttgcgttgttaaattagattagtggtgcgagtgcgactatatatggagaattttaagcattaagatgataacgtaatgggttttaattttatagggatgcgactaatatatgagttccgaacgtgtgtgtctcatggaagctgtttgcgtgttcaagtttaaggacctgagatgtgtaattcgaatctgaaaattttgtttagcatgagagagacggtttgaaaaagagaaaaccaatttttaacggttaccagttatcaaaaatcatttaatatatatatatatttcaaacgagttttctaaacatttttttaaaagtttttaaatgtcaaaaataaattccattaaataattttttaaaaaaatacacatagtaacgatcatgtcatcatttaacaacaaaatctaacagttgcaaccaaacataatggaatgaaagttctagaactaaaaatttaattaactattttctttatcctaatcattaagtgagttcttaaagtttgtcgtgaaataaagtcaactttgacgcaaaaaaaagtgtgctgtgttaggattaaatccttaatttttaaattttgaaatcaattatacatattttttttattttaaatatttttatgttgactcattaccaatttttaaatatgttagtaagtcgtttcccttgtgaatgaagttttcaatactgaatcaaatatttaatttacatagaaataatttatgaattaattggaatgtacatcaatataaaagttttttaaactaatattcaactataaattgttgtgtatgatatataattacttaaatagttatataaaatagtttctaatagttgatacttttcatccacaatgcatccaaactaaactcatacttttcttggtgtagctttttcttttttatatatcgatcgaggttcttcttgttcagctgatttgtttttctatactcttgtatatgggttcttggtacccctcgtacctagcaatcaatatatttttattttctgatataaaaatatcagctttaaatatattgttttgggtaacgggtacaatttcaatactaattatacgtgcatggaaaatgttagcaaggaataatttccgccataaccagaatgtaactatgtaagtaggaaccaaccgagaagaggaaaaactaaaaaaagtaaagcaggagtgtgacaagaaattccaaggaaaattccgaagatgctgccgggtttcactcctgttatagaattgcttttgtgaagaaaagtcgtagaaggaaggaatagtataaaagataaaagaacaaacaaataaaaaagaaaaagtaacagggcaaagacatattcgaatgtgaattaaaaagatacaatccatgtatgtactgggggaaaaagagaaagaaaaaaaaaaaaaaagataaactccaagttcaacaacgcttgttttagtgtaattacaagtattttttgcagattatatgcttcatctgtaaaagatgtctagggctctattccacatggcccttgacctacgctttcattattcatcatggatgatcggtgttcatgtactccaaaaagaagtaccgaataaagaattgatccatgatgtgtctctctccattccacataagacttcctttgatgaaaagggaaagaaatacatctaatatatacacacgtacatagaaatacatctaatatacagagaaagggataagatgagtgaattttaaccatataattcatatagatagttaagatgaaaatgattaaaacaactttgatcgcgctcatgtataattatgtgttccaaagtcatcatgtattttttttaaaagaatggttatataactttaatcttaaatattcagtatagtttatacaaatagatttacttcttaacttttatatagaaataatttttctactaactatatctcatatagagatcgagatggagagaatccttttaatcaaagtatctagtataaaattcgtatgaaagatataaacattcgatataaattacaaattattaaagaatttgattatcattaccattattttagagatttaacctttttaaataagtgtcaagaaatcattaaataataatcttttttgtttctcataactattctcacttaaagacaatttattcaagacaattttatcacctcttctaaacctagttcttcatgaaattaattccttcactaaatccaacctccattgatcattaaacaataatcataaaaactatacaaacaagacatcaaaataaaaattaattaattttgtattagattagagttctttttaatcattttattagtgcaaaatatccattaacttgataacgattgttctatgcaaagaaaccttataggcttatattatcatctattttagtcaataagtatctttgaaaatttcacgattttcttgtaacgtgacattattatttttaacagacaaataagatattcaacaaaattcaccaattttttttattaatctaaacatcatagttatatgtttgatcaaaattagtagtgcatataatacttcgctgtacgtttattatattcaataatgacattgattcaaaatttatttcccctacttcgtcttctttttttgtttcttttttctcttgaaaacgtgtcaagaagaaacttgaaatttacagcacaaaaataaagcaagaacagacataagactcaaatatgcaataattattgttggttgggaaacgatcattcaacatatggagcattgcttaattggttttgttatgatgccgaagtatatacattttctcatacaagcctcgtgctgctgattatataacacatggaagggcataactaaagcttccatgcattttcgcgccaagatgatgtttccttgtttctatgcgcatggaggtatacttggggtgctgaatcaacctcttctaaagtggtagatatatgttgttgatatgagagaacacaaccccatgcagagggaatgttggtggtgtctagatattgatgttgttgcttttccatttgcagttttgcattgcacctactagtactttgaaactaacgtattctcacattcctttcgttgaaagattgttagggttgaaaggtagttgggccagaaaattttggttgttcgggatgtgtacaaaagataaattatatgtagctcaattttgaacatttatttatataaataagagcgagataaagaaaaaaaaaaaagaaaagagatagctgatagatgagtgatgtaatgagaaaaaataaagtgaaaattgaactatgagaatgttgtaagaataatatattttttgtacaatggtcacttttttgtacctatatattttgtcggcacaaccaccggggtgggttcatgggagatggattgtattccacttttgcatcattctgttcttctagtacatcagcagaacagagaacaaagtgggccctatatgttaaggccagcccaacgggaagcccacaatgtacattctttagtctttcaaaaaataatgttacttattaatttactatgttttaaagaaacaattaattgataaattatttataaaaaaaaaacacaaaacagcttaacattgtattgataaaaaattcaagggtcttgacagaaaccaggaaaactgttataagagagtattctctgtgaacaaattaattatgctattaaacactgatttcgaacaaagtttaccattaaagacaaaataaatagtcttggtaagcttcctggcgtaactctgatttctcagaaacttgggatccattctttggttgtggtggtaattctgggtttcttgatgccattttgtgggctttggtacgacaggtcgtaggcagttgcttcctgcaccctcagaggacactaatacccttcttgtaacccagcaccccattgagcggccacaattcacccagttactttatttgtggcattggagcctaacgatgtaatttgctctcttggtttaaatacttttttccgaaatttaacgttttttttataattttcgcccttttaatttttgtgttataatcttgataaaatgtatttattttatttttatttttacactattctgaacagtaaaaaaattaaacagtaaaacaaaattatctaaaagacttccaaatttaaagataaaaaaataaacacgtcttgccataactaaaacgataaaaaaaattacaaaacattaaattaccgataaaaaaagtatttaagcccttccattggtagtataaaatttgactcaattccaaattgaagatcggatgaaggggtattactaattattacacgtaggtggaatcataaaaaataatgatttttaacaatactagtagagaatattggttggcgaatatcgaaccataagagaaagagagaaaaggaaaaggaaaggaaggatctgttggaaattgggagcaaaaggaaagaaagatgcaggatctgatgtgcggataggagggtccaggtagtactacacaacacattctgctaacataacacaacataacaccgacttttctctcaaacgaacgacataattcaactgctgcactgcaaaggttcatttccaatctctaaccctaattttcctccctccaattcacctcgaggaaccacgaaacaaattcactttttctattttcgattggtttaatggaattcccttgtttaagatgctattcaaatgttccgttatctctttctctgcttgtattgaaattgggtttaactatgccctgatttttcttaatcagattgaaacttattttgaagaatgaacgtgggttttggttttgtgcttgggatgtgaattttttactctgttttatctgtatagaatgcacccgaaatacttctaaattcagttaacaatctctgttctggttccaggtttggacaatgttacgtgcttcacgaaacatgacctctgcgcaggacattactggtattttacatgaacaatatccttgatccattttattgttttactgtaacttttccatttataattagtggcttacccgcatgttttaattttagttaacaaaaaacaacacatggagcaatatcattggtgtttttgtgtctaatggaattgttacaacaacaatagccttgtccagtctaatggaattgttaatggagaaacttctattcaacacaaattagtaaagttgaagatggaaaagatgaataactactgttgtgagtgcagtaaaatcttcttttatcttgtattttgtgtgctggaattattccttagtgaaaatcataagaaatggtaaaaaaacacctttcttaaaggaaaaaaatgtttgcataaaaactcatgtttcttactgtctagtaacttttaatgtttggctacaattcataggcaactacactggatgttccttttctgtattggttgccttgtgaaaattattattttgtcataaaattattttcaccactcagtgtcatagatctatagctccctgtcttttgggtttgcctatgtatcttttaatcatttaagtcattgaacccatactcttgctcagaagctgcataaatgatttatgccttatcttcatcctcttcttttgcaattacgttgtgtgtaaaccccttcgcagtccaccctccagcaaggcagaaagaggaaaaacatgaaatagacatttaggcttcacttttaatcacgtgtttgctggttttctgagaagcatcttatttgtatgtcttgcctagggactgcaatcaatatatcctagctattttatttttcgttattacgcacagcttcaccttacactatctttaaacttaaagtatcttattttagcttcaaatttgaacttcaaaacttatttcaactttaataagtcctgtactcctctaatcctgtaactatttttgtttttaactaactcctgcactggccacccgtctgacctacaaaatatgtcaatatattgttattgctttgctgttcattagagtagaacctatccctcagcaactctagtgtactctagattctaaccttcactgtgaaaatggtgaactgtaataactaataactatgaatgtgttcatatattatattggaaaaaattcaagtcccacattggctagagatagtgtcaagacagagtatatcagtgggaggcaaccttcaccccatgagttagcttttgggattgagttaggccaaaccacattttaagatggtatcagagtctatcctagattcatcaaaaaaggtcacctaccatattatccacgcaccaaactaaaaagtgttgggcgtgaggggatgtattggaaaaaactcaagtttcacatcggctagagatagtgtcaagacagagtatataagtgggaggcaacccacatcccatgagttagcttttgaagttgaattagactcaaactcacattctaagtattatatgctatagccatactacgatactaatacctgcacaagtgaagccaaaatgtctatttcatgtttttcctctttctgcctcgctggagggtggactgcgaagggtttagactttagatagtattagtctttaggtattattcatattcatctacttattgtgattactcgcctttcttatttctgctttatctatatcagttcccccttaaagttgtctctttgaacataagactcctttgcattctgacttggtaagaaatgaagagtcttttgtatctattgcttgagaatatttatgttgctttccctctcctttgtatttctttttccacctttgtttatgattctctgtttcttgactgatctattgaattagcctcatccaggctaattttttaaaaattcataaagggattagttttagaatgcaggagtttgaagtaatatcttgttatgtagctgaggaaattattttctagcaaaaaaagtgtgcattaagttgaagataggtaaatttaagatgaaaggaatgaaattatagggctcacatgtttggtagttgagagatttgggcagaaaaattcacttcaaactaatgttttttgacaatcactgtttcttctgtatttacaaactcaacataaatctggagtttgtgttcctattgtgatatatgcttctacgttctgattgctgctcatgcattataaaacactaggttcgtttttaagatattgtgttaattttttattgagcttctttgctattatcctatgaagcatttcacttgttccttcactccatcccaagcacaaatttactgtctaaacctatgtagcaaaatgtctatccagataatgaagatgatggacagcggcagtcagaatcaccaatgcagtccccatctgcaaatggatattgatccaggtattagtacccagaatgtcaatgtacagtatgcagcacctggccagcttggaactgggcatgcaatggtatgaacttcaagctcctttgggtttcttctgattttgtcttggaagaacaaaatatgtttcttcaatgatttgacatcatcagtccaatttgaatcagctcctaatatttaattaattccagaaatactaaggaatattttgttttgcaaaggccatagccattgtatatcatccaatgtgtcttgcctgttgtaggtataagatagacacacattgccgttgttttgtcattgaagcaaattgactctgaatattagcaaatcatgatgaaaattttccccaggtttattcttcctctaattcatgaataaattggctttttttacattttcccgtgaaggtggcattcctattttgacacagcaagctaatttgaaagtagccattaaatttcttgatcttgtaatagttaaaactgaatttcttaatcagtacctactttgcatgcgaaaacttaaggcttctggtctggcaaataatgatgcaatctgaagtttttcttataaaatgttctttagaggttgtgttttggtgaattaaggttgatttttaagaaaccagagttttttgtcatggatattgaaggcaaatgataattgcccgagtgagtactggtgtcagttgttatttagatgtgatattaaagtttgttcagaatcactgtttgcactagaattgttcttggtatttgattttaaaatgtaaatttcttacgcattgtactaatttatgttactttcttatctaattgaaggcaccacctgtgtatccagatcctgaccttactatagaagcatctttgctccctatgatacacaaccttatcccccacaagcctatagtgggcagccaatggtttgctctaattctttaatgttgattctattaatattatagtggcttcttgtgtctttttccgatcctccaattattaaactttatgtccatcttcagttaatgggaattcagcaagctggtgttcctctgccaactgatgcagttgaggagcctgtgtttgtcaatgcaaaacaatatcacggtatattaagacgtagacaatcccgtgcgaaagctgaatcagaaaataaagttataaggaataggaaggtatatcattctctgcatctttatagttctttctatgaaccaaaagtagtgttgttattgttgtaagctgcttgcttctcttctctggaagtacttacttgttcttataataaatcttgcagccatacttgcatgaatctcgacacaagcatgcactgacaagaccaagaggatgtggtggtcggtttctgaattcaaagaaagacgagaatcagcatggtgatgtggcatcagctgacaaatcacaatccaatatcaatctcaattttaataaaaacgatcaaacttcatcagatagggcatcctaaactacagaaatgatgataccttagacagtggggatctattttatgtcacaagatcaataatacctgctttggatatcccacttttgcttcattctggctttgtacaacactgtagtggtgtggtaggtagcgttaggatgtcgcacgatgcaggtaaaattaaattggttattttatcaaatattgtcctttggtaggggagatttttatggtgatcattcctttgtatttggttctgtagagaggttagagattggtgttttgtttggttgaatcgtatttatttaccttgctagtgacagttgaagaagtttcaaccatgattggtgatggatattgatagttgtttttgttcagtgattaatagatagataaataaggttcacatgacttgctgatattgaatgaatcccgtctttggttagaatttgtcctaccacccttggcttgaaaaaataaatgttacatatattttatatgattcttttatatctatatatatctttttaaaaagttataactaaaaaagcattttaattttttacctgcattaacacgttaaactcaattatatcactattttataaccatattgtttatgaaaagaaaactaaatttactaatgataaatactcaattatatattttataaaaaaaacattcaaataagttaatttaatattattatataataaaaataatttatatatttattattacataaaattagacatgataatattataattctaaagacagtcaaataatgtaatgacaaaatccggaatatttctttaaaactttcataattataaaaactttaacataataagataaataaaataaagaattagtatttgttatcaataactattattttgtataaaaaataataactattattttgtataaaaaatattaataacttatttaattcattaaataattataaaattatattccaaattattatcctctaggtattaaaatactttataatcatatacgggacattttcttacttttattgctatctatatctatattattttttttttttttttttttatctatatctatatagtaatcttattttctattttaaaaaaataacaccgtaaaaagtaggagattaaattgagtaactcatttaatgttggttttaatctttatcatttatttttatgaaatttaatagttaataataattatttattataatattagatttaagaaaataaattataagataaaagagtaatatttatttatatattatatgtaaaggaagttgaacttttgtgaatagtcagatcgaaattttaatttgtcaacaatcattaattgatttgatatataaaaaaagttaaaaatttatctatcgttggatcaaattttaaattttaatggttgatttcattccaataaatatatatcatacttaatatttgtgagttattagatcaagatttgagttcacaacagtcattaatttgactacactttccttccactcaccctcccctccttaagaattacataatcttttctttcatctctccattcaatttcatcatttttgcatcctctttgtgaattctctttgcatcttatttatcttgttaaaacaattattttgttacttttgcatcttttcttgatgaattttctttatgtgaatttatatcttatttatcttacatatctttattttgtgtgcatgtacatatttttgaattagaaaaatgttctttagtttgtgaataaatttgaggaatcatccttatctttgaaattgagcaaccatgttatctctaaaattgagttataatctttatagtatattttttcttcttcaggtgttatgaaatacttgatctgaaacatagaaaaaagtaaagcaatgagcaattaattgatagttttggagattcagaaaataaaaataagcatagagaaataatttactttgatcggaagagggaaaacaaataagcactgagacacgcgaagagaaaaacttttgcattttatagacttttttattgtgttttctttttacgccttcgttcttttattaaaacttttgttatgtatttcatctcttctccttttttataacgtgtttattctttttgtgtgttattatatgtggtatcatttatgtcatgagtatgttttatttcaatgcttgtatgagtttattaggttcatttttaattgtggaagttcataattgtgatttctcattatccgtgtcttttaatcctttccatcttttgtttgtttacatttttctttttatatatatactgcatataaatattttaaaaaatatgatttaatcaaagggtttaaactctagtttttatgataagaaccttatttttttttgtacatattttgaaatattttttcatatttattttttcatctttgttattcctattttaatgttgaaattcttaggaaaaaaattgctcattcaagagagaatactgaaaaaaaaaaaaacaagttatcaaataaaatataacaaatcatcaatcctttctttatatctaatttatatattttttgacgtgatatctaattcataatatatttttcaatgattttcatgtgtttaattaaatagatttcatatagaatagatcataaattcactcctatgtctaattacgttcactaatcaattgatcatactagtagaatcggattttgtaatttaatcaaacttattttgtttttgaattggatatgcaattaatttaatcaaatttgatcgattcttaattggatcagtctgatttaattaatttttaaaaagaagttgaaaaaaattatgaaatttatatataatattaattatatatttatatagaatacatacataatttaaatttttaatataaataaattaaactagatcaattactataagacattgcttaaaccactaatccactaatccatttagttgatcacgtgaatgaccgaacccagaaagcatgattccacttctaataccaaatacatttgtgagactggacacccgaaagaaacaaagcgttttgaagagtattgttccgctctcatagggttctattctaacaaagatggcagcgatactcggtgaggacctgatagtggaaattctcacatgggttccagtgaaatctctgatgcgtttcaggtgcgtttccaaatcttggaattccctcatcttccatcccaccttcgtgaaattgcaccttcaaaatcaaagggcttccaaaacacccacctcctattaaggtgccgccgagatagcatgtttaatctctctgacgaattcatcggaccctgttctgttcgcattttacttgagaacccatcatccactgttgatgatgcttgccgccaattatagccgggtactttttcataggttcctgcaatggcttggtttccttgctttatcattctcgttctcttgttatacatggatccattgaataccgggtccggttttggaacccggccactaggatcatgtccctaaatttgtctcacttaactttccattcatcccaggatcatgatattggctttgggtttggttacgattatttgagtgacacttacaaggtggtgtttctcctttaggacattaaatcaaacaattgggaggtgagagttcactgcttgggtgacactgatacttgttggaggagaaatacgtaactgtaacttgccctgatttcccactttggggaggacgcgatggtaagcttgtgagtggcacttttaactggttagcagttcgctggcaaaccgatactgtcaatcagttggtaattttttcgtatgatctaaacaaggagacatataagtatttgttgttgcctggtggtctttctgaacatgctgataaccctagtcttggggttttgaagggttgcctgtgtctttaccatggtcaggagcaagtaagaacccgttttgttgtttggcttatgagggaatttggagttgaaaactcttggactccgtggctgaatatgagttttgagcttgttcaactcttggactccgtggctgaatatgagttttgagttgttcaactcttttcaccttggcaattattggcagcgcctttgtgtatgtttgaaaatgatgatgtcatgttgctggcaaactatccgcttcccaatacattttctataatcggagagataatagaatagtccgtactaagatttcaatgacaaagtgccgctgttctcccatgatgattatgttcaaagcttggttctaccatattaagctaccctatatttgcttgcatgaatttatgttaaattgtgtaagtgatttcagaacctcgccatttcatgtatcgacatgacagagagtgaataattttggtggttccttagtttaattactttgttggatgattctatttctattggcaattgctaattgtgtgtgtctgctttggttttgccttaatttccttttcctgattgataccttgttctcatctccagtgaggcaagggaagtatttggggttccacttgaagtgcgtttagagagtagagatactcattgacataaatccactgaaaaggccaatgtcactgacagtaacactgtattgtataactgtataagttatacatgtcatgtggctaatttgtactcaattatgattgttgcccttttgagttttgacaacaatgaaacaatgtattttcttattatggtgcaaagtactttctttgttttacaaagttaaactgcggtgcatttcattactgaaacatatttcttataatggatatccaatacaaatgtgtacatttcattacttaaactttacttttttgtttacatgggcatctatagttataggaagattaccaacccactctgatgcaaaatagcctttactgcaggtaccactgttagcacagttataacttggtctgtaaatgctatacaattcacatttcaatcataagatgttaaggtgtacatttaccaactcttgacactaaaataaatcatgtgctgtaaatttacaatttcaagccttccaccttggtctaaaattgctgtaacttacccagttacagtggagatatctgggcttggcagtaggaatagtttgtaatatgagtcattaggctaggtaagtttcaggcacattgcaagcgataataaggtttgtataaacagctgatcacatttttaagacttagtcttacatgccttacttgtagcagataagaaaaatggccaaattgtagctcatcacagcatactcaaattgatgtatttaataaatgcaacaggtgataatggaattattggtgagcagggtaaaataagagacagtattcttaatttttttaaaaaaaaattggattcaaagtacaattgtggccatgtttactccactatttttattattttttataatatttaaggggattgtagtaacttgaataattcattgacttcatatagtgagtaaacttaaagaagaaatattttagttttgttgaacagtgaaaaggcaatagtatagagtatattaaccttgagcgatattatattttattttttatgggcactgttttgatcaattgaccttgagtaatgcattacgagttaaaatactccttacctacatctttgtattttttttctctcactctccctttaccctctcaagtgttcaaccttgtagccaccgccaaagatggaagatgttgtcgaggacttgctaggtgtccatgtgtgattttagtttcgggtttctaatcttccatcatcttgtttttttacttcgcattttgtttttaatttgataccaatttctagggatccaaaaaatatcttttattgttaaacaatgtatattagacaactataatttattttaaaaaaaatgaatattcagttgaggaaataagtatccaattttgacctttcaattaagatgagaaataagaggaaggaaggagaaacacgtaccaagcagaaaacaacaacacgagcatatatacgaacaaaattcctttcataagaaaacccatccattacgttatcctttctacactacactgccaaacacaacataactacttccggtcaagggacaaatccaaggaaacactaatctagaaaaggcaataattttagcttattcacgcgtgttatattgatatttttatttgataacttttttttatatttttataaacataataattatttcggaaatggttcttggtacgaaagataatacgtattaaaagtatgaatggcatgacacacgattccctttcatattgactttctttcagcaatgagccaaatatttcttattaaaatttcaatcgaagttcaagtcttccaggccttctcttcctcccttatggtagtgataacaaataaataatgtaaagcccacttataattgcaagttttttttttcttgtatttgaaaggcatcatttttttgcttattttatatagtgtccttcttatcaatgatttagggaccttctaaaaacttcataatcgaaatgtataatctattttagaatatataccaaacataaaggacccttttgtgtcatagcacttgtgagagagcatacatgattagtgggaatctcggctagaatcagaaaaaaaaaaattaatattttatttttctaataatattttaaattattatttttaaaataattgcgttgcacatcagaaattgaaatgaacacacggctacacatcagctatttcttgcgttttggtctagtacattgctgttttttatatcataatttatgcatcaacccaatgatagaaaatgctttttcaccttagtttttgcttttcacgccccaaactttgtttgttatttctcattttttatacacctctgatggaaatgcaattttggtgtataatatacacaatgaaaatatgttttcactaaattaaggggtgcattctccatataaaatgaaaatgcattttagttatacacaatacacggcaaaaacacatttatgttgtataattaattttagatataaaataattctttttaaaaaataccttttccagttcaacagggacaaataagagaaattacattaaaataaaagcggagttgacactccactaagataagctaggagcaacaaactcaacatagaaggaagttttgattcatacttttttttattcatagacaaaaggaagttgctacatcataaaatcatcctgagcatcacatgccaagtttgccaacgcataccttttagtagtaatacaaaatctaattaattatgacataactttctccttttaatagtaatcgaatatgttacaaataattttttttcattgaaattaaattaggtatgatagaagttaacatttataataaataattgaattaactatcatacaattactttttttaatagtaaccatcgattgattaaaaatgataatttgtgtcatcattgattcaaaagtattttatatcataattatttatattactattaataacttttctgatcaattatcgttaagataatttgtatcataaagttcaccattgatgaaaagagagtattcaaacaaaattgaatgtgagggagtagagagagtgaaggcatgaaaatatatatatatatatatatgtggtgttgtggataataaacaaatatcataaaaggcacaaactctatatatttttgtttggagaagaccgcaaaatattttaatatgagtgactatattttggtttaaaatgaaattatcaaaagaaattgtattattttctattacagaggtaggacaacggataatacatctgtcatatcgtatcggcgaaaaaaaaaaaaaaaaacttataacaattgtaaaataactatcatatcttttcgtatattagccaccaaaaaaactctaaactctctttggaactcatctttatattcttgattttttttaaaaaaaagtgaacatatgattctttttaagaggaacacgaattatgtattcaggtttcttagggaaaaaaatatttatgtgattgatgagataattaagccaacagttcatatagaaataaataaatagaaataagactcgggtggtgtataaatgtactagtattttttttaatcattcggttcattcaataaattatgactaatttagagtttagttaaaaaataaataaagactaattatttttatcaatatttgaattcgagtaatatctatacattcaacattaactatttaccacttatgttgaatcacttagcataagtgtattagtgtagatacaagatgataccacaaaaataaaaaaaataaataatcaaatttgtctttgaaagtgtaatatggtacaaataaattcttgaaagatgaaaatataaatttagtctttcaatgtgtaaaaaataccataaattagtctgtagttaaatttgtgagactaatttgtcattaaattgtaatgttcaataatcagtttaataataaattgtatttatggaggaccaatttatattaagttacaaagtttaagatcaatttgtcattaaattgtgtgcatgattaatttattgtactttttacctattcaagtattaaatttaatttttcatgggaccaatttgattatttacccaaaataaaaagaaagcttaataaatttttaatacttggaaaatagatcttttcatattactatctaatatattttttccaaataagtaccttaaaaaaattatgtttcaacgcattatctgtcgttagtcccctttcattaagtgatgacgtgacagacaaaatgttaagtcattaaaccttatcactaaacacatagcagatacaaccatgtattatttattaatttattaaaaaaaaatcatccactgctgcctacccttctcattgctacttttgtcattatcgccgccattgcatctacaccaaagccgtcaacgacaggaaacctccaccatttcaagtatcctttattttcattacccttccacctccaaagaacaatcaatttagatcaaattaaacctccattctcaattggatctcgattgtgatacaccttataaacgaaagttttagatttttaaaaaaattctaaaattagaatgcaaatttgttttaaatgaagtgttcatatttagatcctagcaccaaacaacaccatgaaccaaccctgaaccgtgtgaaccaccacgaaactcatcaccaaaaatcattgcaaacccgccccaaagcacaacaaaaagactacaagccactacaaatccaccgcaaacccaccacggtggcaacaacaatgaattttcctctctttcttagatctagaaaccagagtttttcctttctcaaattaaaaacacacacagacaatctcttttatcaaatcacataagaagaaaaaagaataaaaaaacaaagtgattctgtcgtcaaactggatcccataacgggttaggttgagtttgagtcagggtctaggaggaataataaagatggcaacaccacaagtttggtggaattggtaaaagggggagaaagtgaaaaagaaacaaaaaaaataataaataatgacatggtcatttttgttatatttagtgataaaagtttcatctgttatatcatcgtttaattgaagggaactaactatatatattgcgttgaaatataattttttttccaggtatttagttaaaaaaataatgttaagtaatattgaaaatgatctgttttcaaataagaaaaacttaattaagcctaaaagaagaaaaaaataaaacaaaataaaaatgggcttgggcgaaaagcgttgctgtatggtagtagtagcggtcatcctcattgggcgatggatggatagatagatataaaagactgcctcagtccgtagcataagagagagcttaaaaccctttcgctgcgcctcacccaatcctaaaaccttatctcttcttcatcttcatcttctctcaaaattcattccaatggattcttcttcttccgacccttctcttccccaaacctctcttctcgtctctgaccaatcaccctctctccctcccggttccgactctgagaacgacgatggcttcgtaagcggtgaagagggcgatttggaggccgaacccaccaagcccgttctcgtcaagtcttctgagcccgtcgtcgattctcctcccgacgagtcccacaggcccattgcgaaggtgtccggggacgatgatgacgacggttccgttgttgaggatgcgaacgacgtcgttttggaggaaggcggcgagaaaaggaacgggggaggcagtgaaggagggggattttagcgatagtaacgaggtctttgtggaggcctctggcggtgatgatgatattaaagagattcagagtggtggtgttgctgtggagaatggagtcgaactgagtggtactgataaagggtttgaggctgctgctgctgttgaattgaatgaggaagatgcgaaagagaaggaggtggaggagaaagttaatgacggtgtgaccgataattcggattctgtggtggatgaaaaagtgagggtgttgatgttgaaaaggacgaggtggtggtgtggatgctgttgttgatagcgtcgaggttaatgtgttggggtctggggttgctgctgttggggatgaggtgggggttgatgagtctgagattaaagggctagacgagccggagagtcgtggggtgagtctggataatggttttgagcccattgagaagggtgaggaggaggttgttgataagcttgttgatgggggtgatgagtctgctgttgaccttgtacttgatgatcaatcgggtgctgaaggtgttgttgttggtggggatgatgtgtctgttgagaatggagttggtggagatgggttgacgagtgacattgttgttcctcccgaggaaggtggtggaggttcggagtttgttgagaaagatgaggtaaagatggagggtggtgttgttgacggagaaaatgggagccgtgtggaggagggtgataaggaggaggaggttggtcatcatggtgacagggagattgatgattcggcattggatgggaaaattgggagccatgtggaggaggttgaggagattggtgccaatggtgacagggagattaatggttcggtgtcggatgagaagggcgatggagtggtgtttggaagcaccgaggctgccaataagttcctggagaatttggaattacagcaatcacgtgccagcgggagttcccgggatgatgagaggattgatggccagattgttactgattcggacgaagaagaggagactgatgatgaaggagatggcaaagagctgtttgatactgctacattggcggctcttttgaaagcggcgtctggtgcggaccaggatggtggcagtatcacaataacctctcaagatgggtccaggcttttctctgttgagcgccctgctggtttgggatcatcgctctcgtcaggtaaacctgccatgaggcaaactcgtccgagtctttttactccttccattagtagagctagtgccatttctgataccaatttgagcgaagaggagaaaaagaaactggagaagttgcatgaaattagggtgaaatacttgagactgcttcataggctgggttttactacagaagagtcaatagcagctcaggtactgtaccggatgacacatgttgcagggaggcaaagtggtcaaatgtttagcgtagagtccgcaaaggagatgctttccagcttgaagctgaggcaagagataattttgatttttctgtaaatattctggttcttgggaaagcaggtgtgggcaagagtgctacgatcaattcaatttttggtgagacgaagaccagcattaatgcttgtggtcctgctactactgctgtgaccgaaattgttggggtggttgatggagtgaagataaggatttttgacacaccaggcctcaagtcctctgcatttgaacaaaatttcaatacaaaagtctgtccgcggtgaagaaattgactaaaaaatctccccctgatattgtgctctatgtggatcgcctggacctgcaaactagagatatgaatgatctgccaatgttaagacaattaccagtgcctgggttcatcaatatggcgaaatgtcatagtcactctgtcccatgctgcctctgctcctccagacgggccatctggtgccccattgagttatgatgtatttgttgctcaaagatctcatatagttcaacaaaccattggacaagctgttggggacctacgacttatgaatccgagcttaatgaatccagtttctcttgttgaaaaccatccttcttgtcggaaaaatagagatggccagaaggtgcttcctaatggtcaaacttggaggcctctcttgttgctcttatgctactcaatgaagattctttctgaagccagtaacgtttcaaaaactcaagaatcaccatttgaccagcgcaggctgtttggttttcgtcctcgctccccaccacttccatacttgttgtcttggttactgcagacacgtacctacccaaaactccctgctgatcaaggtggggctgacaatggtgattctgatattgaaatggctgatttatctgattctgatctagatgaagatgaggatgagtatgaccagctcccaccatttaagcctatgaagaaatctcaggttgctaagcttactaaagagcagcagaaagcatattttgaggagtacgattatcgggtgaaacttctacagaaaaacaatggagagaggagttgagaaggatgagagagatgaagaaaaaaggtaacactaaagaaaatgactatggttacatggaagaagatgatcaagataatggaagtccagcagcagtgccagtaccattgcctgatatggccctgccaccatcctttgacagtgacaatccagcttatagataccgtttcttagagccaacttctcagctcctcacaaggccagtcttagacaaccatgggtgggatcatgattgtggttatgatggtgtaaacattgaacagagtctagccatcatcaataaattcccagcagctgttactgttcaggtaacaaaggataagaaagacttcagcatccacttggattcctcagttgctgcaaaacttggagagaatggatctgccatggcaggctttgacattcaaaacattggaaagcagctagcttacattgttagaggagagaccaaattaaaaaatttcaaaagaaataaaacttctgctggtgtgtctgtgacatttttgggtgaaaatgtgtctactgggctgaaagttgaggatcagattgctgtggggaaacgcttggtattagtaggtagcacaggggttgtgaagtctcaaactgattctgcttatggtgccaatgttgaagtgcggcttagagaggcagattttccaattggccaggaccagtcttcactgagcctttctcttgtgaagtggagaggagacctggctttgggggctaatcttcagtcccaattttctgttggacgaggttataaggtggctgttcgggctggattgaacaacaagctcagtggacagatcactgtgagaacaagtagctcagaccagcttcagattgcccttattgctattcttccgattgccaaggctatctacaaaaacttctggcctggggctagtgagaattattctatctactagattgtgtcttttgtttgcgttgctagcaaggaaagtagactacgagtttatcatatcatgttgcttcttttcgtgactgtcttaaataatgagttttttttttttttttttttttttttttttagtttcgtctagactattgaatctcctgctatatagtgcttttatgtgcctgaaaattgtactgcaattgagatggaacctaaaaggaattgattcataaattttgttagcatctatttgaataatgttgatgtcagattatgctgttattctgatttctttgctctataacttctgtttgttggttatacattgaaacctgattgctgagcaattcctgaatatgataatgtgcctagtttgattggcccagaagtggtttgcaactcgtggtatctttatatatactattggctaaaggctttcttttttctcccattttatttctttcttttcctttgttttttttcctaatctccagcatgttgtgcattcttagagaaataattaacaatgcttgtctattgacatttattgagcatgatttagcttttcaagttctgcaaatggactgaaatgcaatgtgaggtttttgatgtcctttacggaagataattttattcgagttaaggtaagatcattaatggatgacaaagcctaacgtattacattatggagaatatgatcgaatcacataatgtcagaattattaattaataccatttttcccattaagatgaacattacgaacttgacatcatagaataagactcaaatcgataggaaggtttgggcctgcccatgtcatttatgctgagctaaatctagttcgtcgaggaaacgaggttgtaatgcttctttttattaactttctctttttatttgtgtacctagttgtgtttttggtgaaataaatttaaaaaatatcttatttcctaagattaaggtctggagtttattttggtacgagtaaatgttccaacagaaaccactctagatataattttatgtttaattgagttattgataggtaatttgttgaatgagaggttttagtcctatgatttcatttgttcaaatcaaatctccatacctttataattaattaaatctaatttaatatttaatttataatcaatttttaatgacgtgctaaagattatgtgagttgacatagtgatgtgacatttaaaaatgggatttgaaatatgcaaaaattgttttatccttgtttggttagaaaaaagaggtttttttttccaaaaattaatgagtttaacatcttcatttctttattttaatttaaatatttttctttctttattttcttttacacgatcaaactcacccttaaggttagatttgaactcactatcctttaacccacacatgagaagtattaaagacgaagaaatggataaacaaattattctttgctgtcattactaaccatattcgtcaattatttgctaaccatgagggacctcaaagttcaaaagggaactgctggcatctttttgttgcaagtatctgattgtcttactgttacaaaaaactgcgtggtttttgttttcttatttaccagaagttgttggatcaaagaaaacttcttagtcatccttgttatttgcccttgtccacctatgaatatgattctattcttatcattaataatgctgctaaaaggttacatgacatattcaacatatatatatatatatattatatatatatatatatatattctttcatcatttaattacacggaaaaacagtcaaatcattatagacttacactaagcactctaatcatagcccataacattcactacctttcagaaaataaagaagcccatagcatttaggatttaagtagagctcctttaaattgtggtataatataatataatgtaacaaaagaggcacatcatatatgaattataactaattaatcaataaagcatttccctatcatggaaatcagcacttctacaatcagcctacttgtgtttttcttttatcactcttctaaacaaaagatatagtataacaaaatttggaaattgacggagtcaaattttgtaacaattaccaaaagtgagtaccgataaatcatgtttgggaatcttattcagaaatacaatagtaatgcttttgacttcaacaacttcttaattattgcgacccagaatttgaattaccaagaacatgaaaagtttagattcataaccttttgttcacatatgaattgatactgatcgtggaatgaaccttacttacgttacctgctcaccattcttcaaatagcatcaatttattctgatgattcactattataagcgcattccaaattctgaagattatgaataattgtcttggcggcttgacttgattccagcaataattgagtagtataattatatataaaaaatacatttcagtccagaggacttgcatgatttcaatcctaagttttttttgtagacattctagttaaattatggatgatattatcaagctagtgtgtttaatattcattattcttaatcccaaacattaaatccacaaatttgaagtaaatgaatttcttattgagtatagaaatgtgtcaagtcaaattctatacccatatctatctccatgaggccttaatttcagggagttttcaacatagtcaacacccagagtaaaactattccaaacaaacatcgaactttaggcgctctgtgttgcactaccaacatcactataagacatacacatttaatatgtctagtcagaaatatggccaccaaattaatcaattttaagatacaagtctaagatcaagttgaatgaaaatagagggattctaaaacacattttacctaaaaatacaattaaatacaataaaattatctgaagaccacttttttatgtgaaaatcaattggctaagttaattttattataattattaaaaatgtaagtagttattataacagttaaattatttaattataatattaatacaattaacttggccaattggatttccaaaaaaaatatggttagttaagtagagaaatttattatttattattaaattttgggtgatatgtatttttagtcaattttatctagtatcttaaaattaatgaatttaattctcacatttttaaataactttttgatgtaacatgatagctatattatcgtaacaatcattgataacatttattgtagccacgccaataaataaatttaatgacattataagtgaaagttaattccacaagtttttagaaatgcaaggatcacttttattaattttgaaatacaaagagtatgatcaaatctgattaaaaataaaggacttaaatatatttattttttaataataaatgactaaattaaccaactattggaatgaatttgtccatctcaacataatattttttattttcatttttcctcgctaaagctcctcacatgagcttcccttcttccttctcctctctctctcctctctctctctcttatattcacgtgagcttcctttatgacccacccttggaaaatatataaataaatataggcaaatattaaagagttcttgcgatattgattaaaaatttaaaaaaatatttttattaaaatatgtaaaattatattatttatgatttcttttacactttcttacaatttctacaataaatgttttttattttattttttaattaatatcctaaaaatactgattagtaatacccataaatataaaagaatgaatcaatttatgcatgttgaattgatgatacaagacagccaagttgggaatttaattattaatcgatattatgtagggtaaataaacacatcggagtatacttgccatttaaattcacagtattttgttaaataccacaactaaccatgacaataataaatgatatcttgttacaattaattgcagaacattacataaacaacctatatataatcgatttttcagactcaaaactgtcgacatgccctttcacacttctttccatctttatatttccttccaattaagtatctcatcataggctttccaatccaagcttctaatataggtgcaatgtcacacaaaaagagagtaaaaaactctatccaatttctatgtatatcaacctagcttacatatttcttgtcgtgcatggatccctttgcgacacctcaagaacaagagtaagattcaggaaaggtgtaaaatgaaagtaaagacattctagagtgagaaagttggtgggaggggtcttgtaaagaaaatagaccatcactcatcacccaaaagtctaggacactcttttggtgcatgtcaagaaatagatcatcacccatcgtccaccaaggaacaaaaaagccttaggtccccccttgggacttgaaggggatctctaccttaatttatatttgtttttctattaagaaattaatgtattatatatcaaaaggagatttcagtggacccaacacaacccattggcctaaaactcctcctcttcaagaagttatggcacaaattgatttatccagaaggatgcaatcatgcaaagctatgcgtctatttaattacagattattacataagataattttattgatttttatataataattattcttaaaattatatttattactataatttttatttacagtgtactttttttttatcttgtcctattattctcttttgatatgaaacatgtaaacttttattgtggtccaaagtcagcaaatgagaaataaagttgagggaggagatcttccaacccatacaatgcttacatttcattcaggccaggcatccctcactcaattacgtacgtaacgtgggagtatatttcgtacgaattttcaaacaaagatgttgctagtatttcgtacgaatttgttaataccaaaatgtcacaaccaatcatgatgtgtataaatcacacgtatagatgagttaaaatgaaaaagaaattacctgtcaaattgtatgaatttaatttgtactcttttgtctagtttgttttcgtattctttatcattttccaatttcaaatcctcgtaatgccgtaatgggccaagtaaaaaggtattcattgcaatttgccttattatggatttgttttctagagaaagtaccaaaagtaaattgcattacgtgcatcgcccatttttttttttaaattatgattggatttgattgtttaaagaaaggaagacttctagttttctgctcaatgttttaattataaatcgttttaaatgttaaataaataattttaaacgttaaataaataagtagtataataattacaaggctaaattactaatttaatctctctatttatttaattactttaacttgggctatctattattaaaattgtaatttgttccttaaatttcaaaattgatgcaatgttctccattctgcaatattttttttaaagattgttatttttatgcatcagaaaattgtaacttatgtttttttatcaacttttttctttttaacttcataatagtattttttatgtaaaagttaaaaaaattattgcataaaaacaaaattaattatcttaaaatcacttttaagcaaatttatgcaaacaaaagttggtgtaattataatcgattatttaaataatctaaatttttataattattcgagacgtacccctttctcaattataccattaatcaaggaaataattttattaaaacgcgttcttttatattttttaaagacattatcatatgatttttaataaaatctttcctcttttaattatttaaccaaatatccttagaatacttgttagcaagactctaaatgaaaaatggtaaaaaaaaaaaaacttaataactaatattttatataaaaacaaaaaagattacatttgttgatttcataaaaaaaacctttaaatgacatttgtaaaagaacaaagatagtaaaaaatagagtaactaatttaacatttatatatcattaacggatactataaaagtggttgtaggattagaattcaagaccatcaagttagaattactgtgtgtttggataccaagcataaacaatctcaactccaaaaaccatagtgaaaacttgaacagttaaaagtaacaaaaaagagttgttttgttgtgattgtaaaaaataattgaggtgcgataaacacaccgtatactcaaacacgcattcaattgattcacatactcaagtgattaaaaggaagactaaaagcaaaatgtaaattcttaaacttagtcctactaatcaatatggttttgacattacaaaaaaactgtactagtatttatttgaatacatttgttgtggcagatgtacgtgcaattaggttattcccttaaccgcgagatgctgtttttaggtcaaagttagcaacctgcaacctttacaccctacaccacactctgcaacaaccagcacaccaaacgcttgtccatatcttcctgtctgctatctcccttcaagcctaacgtaccatgtctacatccccatctctctctcatctatggacatgcatcacatgccccccactcatgcatgcatcacaacccatcaacatttaatttcaaaccatttctcatgaaatgaaatggttttatcccacggattaaccctatacccaaattgttaccaccacctttttttttttttttctttttcttttaaattcacatgttgaattaactactttgcacctaacgttttgaaataacgaattagctaatttgtaccaagcgttgctttaattgatccacagacaaaatgtacttcaccaatatctttgtcttgctcaaagaggagatagattattaattaagcatttttttaagccaaaaggcttcctcattaaatagatgcgtcatatactattttttcctctctaattctgttttaattttattacaaaagtaatacagaataaatagtaataaataatcatcaagagggaggaaaacccctatcatctttaaatataatttggaaatcataatttaacttaataaaattgatttctttataaagaatctaactcagttaactaaatataaaattagtatttttattcttacaaataaaaaatatttataatttatcagaaattattagtatctcaatatcttgttattactttttacaagagcatctgagtaaatttttggctattatttttacaagactccttctatatttctattactttaattgttttatttcaaggtcaggttttacttttggtagtagttcttgatatattctaggaaaggttttaggattctggaagttttctataaatattttagaaaaagaaaataaaagaagaaaaataaaatgatttttttataagttaaaatgagtttttattactactttgtaaatgtatccatcttttgaaaagctatattggtaaacttttaaaaattagctaataaaaattatttttacttatgaaaagttcatctcatttttttttcatattttcttttttaaaatgttttaagaagtttatccaaacatatccccctatttcttttcactttatgtgttaatttggttgctttacttaatttataatgatcaaatataaggattggaatattctttgtataacaatggaattgattaagtggaagtagttattatatcacaatttagtgaaccgatgtttaaattctcaattgaggagtatttatgtttgtattccattatgtcttgaatatgattacattcaaaggaggaaatttggaaaaagaaaacattctttgtagtttcaatgtagtagtatttgctaaaaaaaacttaaagtaaattacacatgctcctttgagatttaaggattatgcatgtctttattttctttaaaaatatacgtgtcttatgagatttaaaaaaattatatatgtcctcgagatttaaggaacttacatgttttaaaaacctatacgaagtcatgtgcgttgacaatttgattaaaagaaggttaaaatatgtttttattttcataaatatgaaaatttcagaatttgtagttgcaaattttttgtctattttcgtccttgcaaaaatttagatatgatattctttttccaaagctaattcagatacattgacctatgtatatgttgttatagaaagtgtcatgttttaacttttctacatcgattatatgatctgaagctatatctgaacctacatataagttatagaaagtatcaattttttaactttttacaataatatacatataagtgacataaaaaagttgaaaatctatagtttctccgataacatatgtgtagctttgaatgtatttaattaattcatgtcaaaaagtaataaatttaaattttgtgagaacgaaaaatagataattttttataacaattttaaatatttttatattatagaacgaaaaaatattttaatctttttaataaaaattgtaacacatatgattttactatttagacgatatttaaagatttgtagtttaaaaagaataaaaatatgtaatttttaaataagatgatttagtaatttttaaaaaagaataaaaactttagtttaaaagctcgaaactgataaaatgcaaaggagaacaatcgtgtactgtttttcaaaagaaatttcgataagtaaaaaagacaaatgatgatattaaaaaaagactgataattttttatttatcaaaataaatgaaaccaaaccatataaaaatttcaccgatgtaaattaccaaattacaattaaaacgtgtaatcattagttaaaaaaacgtatatttttggttctgctgtgcttttgttggcagcgcctaaaagtaagctccatgtcctttcatttgatattctctctctttgataagaaaaaagataaataattatttttattaataaatgtataaaatattgataaattcatttcaaaaaaattaaatttaattttaatcatcaaaatgaaaaatacaacaaattcatttattagttaattttatctttatcattaataaaatagtctatgtgatataaagagatgaaaatatcataaaaatgattgtcaacctgattgtgattaaatcaaaaattggtaaacttttattaaattattctgtcatattcaaaatttgtaaaatataatttaatctcattttttatcattataagtataatattataataaatacttaaaaaaataaaaaaaatataagttataataaatataatattaattaatatacactaataattttggtaaacttataaaaaatgagaaattaagttaattgttataaaaaatgagacccaccttacatttattaattaatattatatttattattattttttctattttttaaatatttatgataatgttatatttataatgataaaaaaaaaaaataaagattaaattatattttattcttaatgaaacgaaatttaaaatctgatcaattagtctaatgaaaatttaatgacatttttagtctaatatattcaacacccaaattataattatttttatgatatttttttggtgttatataattctttcattaatattaataatcaaacttaatgaatgaataaattatcatatttttttattttcaaaattaaatttttattttttggaaatgaatctgtgaattctctcatatattttggcatcacacaatatcatataaagagatcgagacaagggttttgcaaaaaaaaaaatccaagtaaatttaaggagccaccactgttccaaccagccctttcattttacagtgcctgtttgttttttcgtgtttgcattcactgttctacagaagcaaaaaagagtgctttgttccatctctttctgtgggtgtgtctcgagattggtgtgtatgctcaagataaagctcactcactcagtcacagcagcaacaaccctttttccttaactcttgaaactgtgttcaaagtttggattttgagagagcatgatctgatgaaggaatgtggaggctctcttgggggagagggcaaggaagaagaggactactgaaaacaagtgttgcctttttgaaccccaaaaaatacgtttttttttttggttttgttgttatggcactttgtatgcagagtcagcagagagattcagcatcaaacaagcagctcatggattgtggcaagtatgtgaggtacacacctgaacaggtggaggctttggagagggtgtatgttgaatgtccaaagcctagttcttccagaaggcaacaaatcattagggagtgtccactacttgctaacattgaaacaaagcagatcaaagtgtggttccagaatcgcaggtagggaagaagagaaccaaaacatgcatatcattgtttggtttcaaccttgccacatcataaaaaaaactatttttgtcatgttttgtgttgtgtgtgtgtcctatggttgaggatgctcaagggtgtttctgagcttctttctctttgtaaagttgagttttttggtttagtatatttgttattcagtgtttttttttttgcctttttttccttttcaaaaatggaatgtcataaagtgatgtttcattatttgcattttttttaaatgtgttatttgggttcaattttagagaaaaagagtaagtcatccctcttgaaaggaagatctactgggaaagttacttaatttttgtcattttccttgtggttatccaactagttaagatcgatcgtttttatttatttatttccctcgaaaaggagtttcttttctggagttgattaaatgggagataatgacagctgactgttcatttttgttgatgagttttttactgctttcttctgaccttcatcatttttgttttagaccattttctgatgtttctgtgtaagatgctttaacagaaatgttcatatgatcatttggcttttgttttgggttggtcatagataagaggaaggataataacagctgattttaacgacttctcccactagattaatcagttttcaactttagcttctttttttctttcatttttcctctttaaagattttttttttcaggtctctaatattttctctttttgaattacggaagagaggagattatgttttgttctacactctaaacttttctcgaactaatttttcaccttgtccctgcattagtatttttttattaaatcaacatgcatatatcatgtttccaaccttttatctgcaattctgcattgactgattaaaacaagttttagtcttggtccgatagtaggtatctgaatttagtatgtaattcttgttaaggatattcacatgtataatattcttggtctgatagtgtaagggacttgtccaatagtaaagtgggaaacttcaaagagtgaaatgaataatgaatgattatcatacaatgttatggtaaattgtatgggaaagatgacctactctacctgccttacactctgccaattttcttctgtagatgtcgtgaaaagcagcggaaggaagcctctcgtctgcagacagtgaatagaaagctgtctgcaatgaacaagttgttaatggaagagaatgaccgactgcagaagcaggtctcacagttggtttatgataatggattcatgaaacaacaaatacatactgtgagtaactttatctttgagtgattgctcttctcaattatcattctgaatgttcattggtgtaccattctatctatatacaagtatatgtgtagtgtactattttattgttattgaagaatctcatttactggtttcttaacaggcatctgctactactactactactgagaatagctgtgagtctgtggtagtgagtggtcaacaccaacagcaaaaccccaaaactcagcatccccagtgggatgccaacaacccagctgggtaagtaacttcataatgcaaacaaatttgtttaattaatatatactccttcaccatcgtcacgagtctccaattctttattctgccagtcttcttgcaattgctcaggagaccctggcggagttcctttccaaagctactggaactgctgtcaactgggtccagatgattgggatgaaggtatgacttattcaaaaactcttcttcatggtcattgctgcataaatgtattggtataattatattttgcctcattttttctgtcttaatgtagcctggtccggattctattggaattgttgctgtttcccgcaactgtagtggggtagcggcaagagcctgtggccttgtgagcctagagcccacaaaggtattatgctgtaatgaagcttattcattgcagaattattttctttgctgaacaatgaaaccttgttttattgaactaattgctttccacatcatctcaggttgccgagattctcaaagatcgtccatcatggtatcgtgactgtcgatgcctcaatgtattgagtgtagtccccacagggaatgggggcacaatagagcttatgtacatgcaggtctactgattattttatgcaaaaaaagaagttgaactgttgtttaaattacttttaaattattcctctgttgtttttcttgatatttaaatttgatttttttccagacatatgcaccaacaacattggcagctgcaagagacttctggactctcagatacactactagtttggaagatggggtcttgtggtactgagtggaatcttgattgttgtgtttttcttgatttactgtggcttctttcctaggaagagtttgtctcaaagaatgactattatttttttggccttgcagatttgtgagaggtccttgacttcttcaactggtggccccacagggccagctgtttcaaacttcatacgagctgaaatgcttcccagtggctatctaattagatcctgtgagggtggtggatctattattcacattgttgatcatgttgatttagatgtaaggaagattatgctattcaaatcattttttaaatttccatatatttgaacttcttcttcctacttatataactttgtttttgatgtaggttttgagtgttcctgaagtactgagacccctctacgaatcaccaaaattcttggctcagaaattgactactgctgtgagatttcttctaacactgcattatatgtttcacatgacaaaagctgttgatttaaatttcaaatattattgtgcaggccttgcgacatgcaagacaaattgcacaggaatcaagtggagaagttcaatatggtgggggtcgtcagcctgctgtcttgaggacatttagtcaaaggctttgcaagtaaggcccttccatatttggtggttgcatagttgggcatttgattaatcactttgtcttcatcaatccttactgaccaataattttttaaaatttgatttagagggttcaatgatgctgtcaacgggtttgtggatgatggttggtcactgatgggtaatgatggggtggaagatgtgaccatagccataaactcatctccaaacaagtttttcggttcccattacaatacatcaatgcttccagcatttggaggtggggtactgtgtgccaaggcatcgatgctgctacaggtacttctcagaccaatctatgaggaaattatcattgttctctaaattaactctagtatagtagcagcaatcaattccaagaactcttgctccttgttcccccatgtcccaacctgctagaatcttctggatttttgtagtgtttatcttcattatactcaattataaaacggtgttctgcagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccaagcagccacgtcattataccacttgctcatactattgagcatgaggaggtattaatcattttcagggaatgattgatgaacttcattttataattttatttatttatatggtcattttccacccactacaatgatgcagttcttggaggtagttcgtattgagggtaatgcatttccccctgatgatgtagctttggcatgtgatatgtatctaatgcaggtaaatcatttttgtgtttgggttgtttgtctgcttatcttatttaagcaggaacttgatgttactgtgaatgatttttatgtaccttattatgcaatttgatgtggcagctgtgcagtggaatcgatgaaaatgcaattggagcgtgtgcacagcttgtgtttgcacctatcgatgaatcatttgcagatgatgctctcttactgccttctggtttccgcataataccattggatcctaaaacagttagtgacatttctcagtagcttgatagttttaagggaattggtcatgaagttattttgttaggttttttaatgtttaattgccatttcactacttcattttatctttagtttgagggtctaaaattagcatgaaccatcaggtgaattcataattgtcatatcttggtgcttcttttatacaatttatatctagactgtgattggccgactaaatttatctatcttgaagtcttagttcacatttgtttcaatgaagtaatttgggcttttagcaaaaccaagcctttcttacagatgctatgctactacatttgagcatgcattgactaacaagatttcttttttctgtatgttttgctttcaggatggtctggcttcaactaagacattggacttagcgtcaacactggaaacaggatctggtaatgcccgctcagctggtgaaagtgattgaataactacaaccttaggtcggtcctcacaattgcatttcaatttacctttgagaaccatttgctggacaatgtggctgttatggctcgccagtatgtgcgtaatgttgtgcgatctgttcagagggttgccatggcaattgctccctcaaggctcagtacacagttggggccaaagtcacttcctggtccaccagaggctcttaccttagcaagatggatctgcagaagctacaggtttacaatcttccattaatcttgtctgtaagtctatttttgtaatgattaatgtattttcctaaattatttgatatccttgtcttgagttgtcttcaaggttagttaaagtacctatagaaacttaccttgtatttgttaacttggttattcaccttgtatttgtaatttttagctgtgtcctgtaattgtctgaaaaaggctcagtttcagatacaaattgcacaaatttcaccatcttatttcttgtgtctggtatgatatagtaaagattgttttttcaggctccacacctgcacagagcttttcagcattgagtccacatctggtgatgcaatcttgaaaaaactttggcaccatccagatgcaatattgtgctgttctgtaaaaacaaatgtaaatcattgctgcatctatataatcctaatctgcctcaatttttatttttttccagaagtttcttgtttttagtccaataaactcagcaagtaagacatttgagtgccaaaattatgcaggcatctccagtgttcacctttgcaaaccaagctggacttgacatgcttgaaacactcttgttgctcttcaagacataatgctggataaagttcttgatgaagctggcaggaaggttctctgcattgagttctccaagataatgctacaggtgattcacttgtaaactaacaatgtctagtctttttagggtgtactttttttttattggcaaatgttagttgtagaatgttagttttgttagctgagggggatcaagttttgacattttctccattcccttctcccttaaccaattcaccttatatcccttttagtgtgtacttgtaagaattgtttacatctttttcaagtcttgactataattagtgctcttatcttatttgtcctttttcatatcagggatttgcatatctgccagcaggaatatgtgtatcaagtatgaatcgaccagtgtcttttgagcaggccattgcatggaaagttctggatgatgatgattccaatcactgccttgccttcgtgttcatgaactggtcttttgtctgatggggggaaccatcatttagatactttattatatctattaatttatattgagtactttactaagatattgtcacatcaacatcgaatgtaactaatgtctggatttcgtgaactcatggttgtgtgtgccattagattagctttgctctatgcttttaccaaggatgtacctttcttactatataaactccttgttgaagtatagcctacttattcgcaaaaattatcctttagtggcagtttagtttttatatttatttatgtgaactcagtcttttaatttataaatctcacatatatctttttggttttaattgaactctgcggcattgtgatttatgtagaccttcctagaataaggttttttattgtcttgatatctttgtagatattagagtgagatgcaaaagtaggattcttttcgttttaaaataagtcagatttagattgtgttacttatattaaaaaaaaagttaataaataaataaaagtgataattttacaaaattagttttagtattaatattacattgaaagactatagggatatttattgggaatattagtaaaaaaagtaattaatatcatgttaaaaagttaaatatgaatttactttggataatttttttctcaatgtgatgcttaatttggtaaattcatgaattaaatgcgaatgtcggacttgaatttgtcaaaatactgcctaaaatatgaaattacagaaggtatatcatggattgatgcttaacaagcttgatttgtaggtgtaatgtgttgaattagggtttttctttgcaccttattttagaggcgttttgattttgacaacagatccagcaggattgcattgttattgttcccggaacatgtcatgattgtgttttacttgtttgttgaaggaagcgtgtcttgatttcgacagaatcaatataatgagtgagatcttagaaggaatgttttatgaccaaatttctacctatttatcgtttgtatttctatttatggtcgaggaaattcaactttctgtctgtcacaattctttcttttcaaacaagtaatgtgaaattctgaactcctcgcagtgggttttgatgttaaacttaagattcaagtagtgcctcttccttctagagaatttaaaactaagatatatttttcttatttaaaatattacattttttaaagagactattttatatgattgagtgtgttaacaacagtgaattatgattgaatcaatataaataccacttaccagtaaccaaatagatttatttatttatacttgaccagaaaaaactatgacacaaaaattagcagtttattgatcactaatttgattaaaaatgtttgtgatgtgaagcagatttacaagtgacaatatgaatttcctagaaaagtagaaaaataagaattgtatccgaatctagccatgtaacaggtatttgtattgtacctgtgctataatatgcatctggagcagcttgaaattttgtctcagttacatatttgccataatggattctctttgagagagcctgcagtcacaagaaaacaaaagttttcatcaatgtaacagccaaaatttatgattacaatctctacttactaagagaaatttctgaagttttcaaaataaagcaagctaaatgttgactaaggaaactcgcaagttacaataatctctctatggaaaccaagcactttcatgcagaactttgcacgaggcctgatcctgttttgggagtcaccacatagtacagagtttaccttcttaggaaaaaatttccactaatatgatcctgttataataagatcactttttttgttctggcgtgaaaatgattgtttcaaaaatatcaaaccaattggtcttgacattgcacatgtaaaaagttaagttaaataccaaaatagaaataaaaaaggatatgaaatgatggtatagaatatagatagatacgtatataattgataataatactatgctttttaatatgaagtaaattaaataattcaaaaaaaaaaaaaaaaaaaaaaaaaaaaaaaaaaaaaaaaaaaataaataaattaaataattaaaacacaaggtggtacaacccctggacatcatttcaatatagaaatgaatttaactaaaaggcaactaatgtgtaccagcaagcatattaagtttacaacaaaacaacatggaatcagagttaacatcatctcccttctggctattagtcggataggaactctgaggtgaaacctccatactttatcattatattaattgaatcagcaatagggtgcaacacctattcatacacgacaaagaaattcagtatagatgcaattagcacataaaagatgaaccaacaaattcattaaatatgtagcacacacagacatttgctagatttttagcaacaatagtaaataattatttcatgtcacctgactaaatagatagcaatgaaacaaacacatgctgaactctgaatcaaaccatgcctaagctggaagatgacaattaacatgaacaacattaatattgtaaaccaataattcacacaataaaattacccatgataaagcaaagtcgaatgaaaaattgttaggccagccaattgatctcctaatattatcaagggattttatgcttatctgtttttgttattaattagacttgtctgattgttattaatttgaatttatttgctttgaattgatgataacatatcaagttgttatatacacctccaaagcaatagaaaggctgagtcattatcattcaattatgagtaatgatagacgcacaacaatttcttcaataaattgtacaacgaatgtcatgtcagccaaaaaaatcaaattttaattttaattaatgaaaaaaaaaaccatcggagaaattatatgggaccaccaaggcaactatggttctattaagtaattttgtgatacatggacaaataagatacaacaaacagaaaggtaacagtgttatcttttaacagaataatatcaaatttaaatcttccttaattaaattaacccaaatcttttacaaatcacatttatgattgatatcaaattcaaaactttcaaaagtaatactactctatcatcaagtatgtctatcttctcccacgttttgaaaatcataaagttctgtcattgttataccgtgaaacaaccacgaaagctctgccatggtttatgcatggttgcttcccagaacaacaatgatagaggtggagataagagagaccataaaacatgaaaatctgattatttgtttttggtataaaaaatgtaattagtattgaacagtgatttttttttgttaatggaaacttaattatcttttttgtttgttattaaaattaaaatttgatttttttggctgatgtaacatttgttttacaatctgttgtaaaaaaaattttcgtctatcatttctcttcaattatctactacaaaaatgtttaattaatttaaatggactaaaaaacagtacaaagggacattgataataaattattatttgcgtacacatccttactcttattatatagtcaagactgtcaagttctgaccatatccattgtactccgatgcctccaaatttcatcattttaccttattttaataattacacagagcattggtcataccgattttgtactaaagtttacacacgactagaatagagacagttaggtaatgccaatgtcacactcatcactcatgctttgtctgtttaggaactttttttttatttagatggtgaaaattggtttattttttttaatcattaaatgtgtgtttggattatcgttgatagaattgatgttagatcaacttggttttaaattaacatgattttatataattaattttgaagtaacttaattttgtttggataacatatattaaaaaattgatttttcaaaaaattaatgtttgaatagtttgagtcataattgattttaagtgtcaaattattaaaatagactttaatgtctttgaatatttatttgttattataatttgctgtttatatatatatatatatataaacaaattaaaattaaatagatatataactgacctttgagctactactcttaccattttttaagaaaatgatttttttatatttttttatatatattattaactgacctttgagttaagagagtccagtatagtatctgtaacacagcacaagattccagcacaatgttcgtactatcgttcaatgcagatcctatgaactatgaagtgaagatggtaataatctttctttaattgagagaacaagtaaatataataataaattttcaactaccaaaataaatgaaggtccaaggaaatataataaatgcaaataaaaaataaagaatgtacttgttcaattattaagtatagcatttgcaaaaagtataaaaagtacaaggattttattgtggggaatatatacataatgatattttatattttcttgaatcaaaatcactgtaatttattgtggttacatccccaaaccaaacatgctctaaatgattgctaaaacccaaccttcctcatgttcttagatggcatgtctcaattttttttttaccttaatgactcttttcttctgaataatatcaaaaataaataaaatagcagcatgtgaaaaacattttgtcatgttttaaacatttaaaaaattatatgtaaataaaaaaaatatttcatgtattaataaatcacgtgtattatattaaaatttatttatttattaaaatataatttataaaatatttcaatgtaattttttttcaaaattcataagatattctagaaaattattaatattgttttttccattttggtaacatttatgaaataataatacgtattttagacattaaatacaaattatcaatatatggctaacataactttagaaaaataaattagtattaataatataaaatattttttatattattaattaatcataaattatcatataaaatatatattattataataaatatcttaaaaattatactatcattaattttaattgattaagtaaaattattttaattattgatggatgtgattaaattctaatttttaataggataactctactgtcattgtagtaaaactttttttatttgttttcttactaataacattctaaaaacttagacccgttagtttattcagtgaatggacaaatgttttcaaacaatataaaaggtcttatttatttttatgttccacaaagcccattttcaccctatggccataaacactttctcacaccacaatgcagcacttgcgttaactgccagaaatagttaattaaatttttaatacaggaagatcttgcactggaagtgggccccactggatcttcagcgcatttaaagctagtataacattagcatccatcccatgtatgtatacgtatgaatgtttatgtatatgtcctaaacatatcatgcatcattcgatattatcatgcatgatgaattgatcacatgtcactacttttttgtgtctgtgttttcttttatttttccgaaatttggattgtccccggttaagtaaaaggacccttaattttttttttataagataacaatgatacatgaatttaaatcattttaattacaaatacaaattacaaacaattacatttaaattatttttatttgaaatattgttttcactttgttattttttattaatgctaaggctaaagttaaggaacaaatttatcaccgcattaatttcaaaacaggtaaataaatagactaacttttcaactttacaaaatcaaatattaagtatatgaatcaactcatataatattattttaatttaattaaaagttcgaattcaaattttaatacgcaacacttaagaagaattttattatacataataattttatctaattcgataaaaaaataaaaaaaaaaactccacaactcggtctccattccattttaacaagttggatccctttatttttcctctctcttatggtgcctctttatgatcgtcccaaaagtaaacacgtagatcttattagcatcaatgtgtggggaaaaagagagattcaaaataagcacaattttgcatgcagtgtttaatatggcttctgagcatgtaaaagttggaaagatatactgtagctctcaaaatccaaggaaagtgcgtatctaaattcctagctcttgtaatgtcacgttagggagtgagattccagatgcaaaaaagaaacacacatcgttgtcttgcagccttgcaggtttaaaagactaatcaaaacaacaaattaaagcactggagaagaagaaatcaaatactagtggggtaggaggatatttgtgttctgttctgtcatcatctgtgaacttttcactgttttaaacatttccttgaactcaactgggtattaatttctacctcttttgcttcaaatatgtaatatggtacataataatcttttggttctcttaattatgtaacaaccggctcgttcggtgtgtgtgtgtgtctgaataggactttttggattgttttgtttgtttcggttctagagttaataattattgttgttttattgtttttgggattttgtgttgggtcacggctactcaccctgtgaactttgggttaataacttttcttttgtcataacgacaatgaccttaagatttaagaatgctataaaacataacttattacagtagatcattttgcaattagggtttctttggtttaatttgtgatttaaccactctttgaagatcttttaactgaaaatcaaacatacacttaatctcttaaagtaggattattaattttattatgtactacctctagacttaaaatccatgtatacatatatatatatatatataatatatatatatatatatatatatatatatatatatatataaaagacaaaactaaagaacagaaggcagcccataaatttctggactagtcatgataagtgagaaaacttatagtatatatagtagataaataggtcagaaagggtggctcatgcggaatgaccgaatgatgttaatattaagcactttcatattgtccatatttagataaactccttgctaaacatttataagtaaagaaaaaaaaacttaaaggaaattgctaacatactttcacttttttcaattggaataggttaacaataccaaaagttttggacaaaaaattagttttttgttttaataaatttctttaggaatattaaagtcatttagtatttattttatttataaaaaaaaaaactctttctctctctcatctgtcatatctctcatcgatctgttaccttacctctttgcatttcaccaaaaaatttcagacttcaacatttcgttaactctcaagagtttggttctaaaggtgacaggaacaccatcatcgactttgggggcacctttccgttcattcaatccgttaagtatttggttgcccaagaatttgagaacctgttggccaattacaatagaaccaaaaaaaaaaaaatagaatgaatgttaaatgactttaatatcccttaagtaatttattaaaacaaaaaaaatactttttttttccaaattttttggtgtagataacctactccaactgaaaaagtgtgagtattagtaattctcaaatttaaaatgtccatatacttattcaaaagcaaatttagaaacagtttttaagcattttcaatagactcttgttatttacaccctcatactccctttctacctcttaactattcatcatattatttttcttaaagaattacacattttttatttttggaaatgtatttctaaaattacatataccattttgaaaatgtatcttcggaattataattcataatatcaagatatactttgaaatatgtatatatttttaataaatatcacttaagaattaagatgattgatgagaaataaaaaaaatgattaatatttatcttatatccatatttgttagttttattttcattctatcattagttatctttaaatcttatctaaaatcttatttttcatcttatctttattatcctttaaattctaattttaaattatcttcactatatattcattatataataatgcgttttcatcattactatacaatattttgtatttttcttcatgtaaaaagcatttcaaggaaagttcatcactaacttcatgtgggactgaatcattgatatagacttgaattaaatgaatgcacttaaaggaaataaactattgtcaaaagctttgctttgtaattaaggtgtataaaatataaagttaatgatgattgtaccttgaaacatagtgccacatgaagaaaaatacaaaatattgtataatgatgatgaaaacccagtattatataataaatatatggtcaagatagtttagaattagggtttcaagaataataaagataagatgaaaataagattttagataggatttgaagagtactgatgataggatgaaaataatactaacaaatatggatataagataaatatttatcatttttttatttatcatcaatcatcttaattcttaagtgatattttattaaaaatatatacatattttagagtatatttctagaactatgaattatagttctcaaatacattttcaaaatatgtatatatacttctagaaatacatttccagaaaacaaaaagggtgtatttctttaagaaaagggtataatgaataattgggaggtagaaagggagcatggggtgtacttagaaatatgaagtgtaaataataagagcctttaatattagaattttatttcatgaatcttgttaacttttaacgtgatccagatccagaagcataacaaattggacccataggctcggttggtgctaatcaaacgatgcgttttgcggtgttaacgaaagagaaagacaatgaaggaggtagagcaagtgcagttttgttttattggttgagaagagaaaagaagagaataatgtcgtcagagaaggaaacagagagtcggaagttgggttcggaagaaatttcgcgcgagttcaaaaccctagtcagctccaatgatctccactcccttaaccacatgcaacacaccatgtgcgtgtcacaatctccaattcaatttgtttgtaactttgtgtgttcgttaattgattgattgaaatgtgtttcagattgggaaggttgcaggacagcaatgcggtcttgtcgcatttcaatgacttctctcagcactgcttcgctgagatttccggcgacatcgctagaaacacgcgtgttttgaagtctgtcaagtctgaccttgattacatctttcagaaactcaggtattctttttcttttcatagccttggttactctccatgttagtaggtttgtgaaatatgggttccaacttttctatcattcttgtaaggctataaatatatatatgaccatattagttcatcaatataggccaagtttttactctttactattttgagtaactagcaagtgatattagagccccaatcaaaatggcctgattctttatagagacttggagagaatatggcaacaatagtggatttttgccaccagttattccaaagtttggtggactgattacttgagtatgctcatggagaattttctgcaatctaattgaggaaggagttcaacatagtgaagcacaaaagaaagccattgagggtgcaagagtgaaagatatgaaggcaaaaaattatctcttccgaagcaacggatcaatgctagagaccatttttgaacaatatatatctaaaagcatctaggacgcctggaagaaaaagaatcaagggacagtgcaagtatagtgttgggaatgtcaattgcaaatttccaaactttaattcaggtgagtggttttgagatataataaattgatgaggaaaaagtggtgactattttgtgtgtgtgatgataatttctaagggggttgagtattggaattgtaagaaatacttaatcggtgtttatccaaaaactcttcaaaagtcatttgccgccattataagagaaatccctgtgaagagaagagacaccaccttaagttgaagggggttcatatgaaggaccgaaaatcttaaatagaagagatgtgaagcaaagatgtgagaagatctcttgtgagtgagagtgttatcatcccttgtaactcttgagtgggagactcgcgtttgtagggtgataaactatttggggagggtattttcaaatttgccagaaaacttgtaatcttatttgagatggtgcatatttgttgagatgtttttgtggatgtaggcaggtggtgtcaaactattaaaattatgtgtctttcactatttctatcagtagtgtgttttttgtgtgtgatcctatagtcaatctttcttgctgcagtttcttgcacctgtcaaatcatttacataaggagaattttgaataattttaatcctgatcaaagtgatggcacaacaattttctatgacagttattcagcaattgagctttcaaaaagtctgtttttcatggccatagctagcacatagatgtcagatttcactttcttcgtgatctcacggggtggagttgtaaagttagtccactgtcatactcaagaacaatttgcgaatatagtgaccaagccattaaagcttgatttgcatgtaaagctttgaggtctttgaggagtatgtgttggtccaaatgtaaactgaatgatttgatattcagtttaagggaggatgttgaattgttaacatttgcattagtttgactttgaactagtctttagatattttagtgatttccttcttttagaaattagatattgacttccattttaatctcccattagtaggttttactgggctgcaactttatgttattcttgtacatctatatatatggttatattatttttatcaacatagctcaaatttatctctctcatattttgagcacctacatgtaaaaatgtcctaatttgaagatgatagttgagaagggagtaagaagcaagtggatgattttgttttatattttgaagaacttattcttatatgctatgttcaaagggtgttattgtgaagctaggttatcgatagcggccgtcgcgatcgcggatgacgtggccgcgatttggtttgtagacctaggtcgaaaatacgctcagtatttaaagggctgggttacgttcttgtgcgacttgccttgactacttttgtgcgaccttcgttcactcgacgtacctgctcggccagcagctcttccttctccggcggcactttgttctccttctccgtcgaggttttgttttcttactttctttctctccttctcatcggtgtctcacactctcaccgtctctttccttttgggttacctctgtttcttcttctttcttcttctttgtcttccttcccttgtcgttttcatgcctctgcctccgccatgctcaatcgagaaagagagaaatcgagaataagtcacgaggtctcacgggttgggagagaaagagtttttttataaataacattagtgtttttttttattgggcccccagattgcttcttgcactccctttattgcttactttactcttggttcatttttttttaattaaaaactggacttgtttttaatgccaactagggataatctattatttgttttatgattttccttttattatattttattaatatgaaatacactctatatataaaaacattagaatagcggtcatccgctatccgctatcccagtttgagggtggctgctccgctccgctatcgggattgataactatgttatgaaggagcatgtcagatataaaatcatttatgttgtgctccacctaacaacttaagcctttggttttcttgtgtttgaaaattaatagacagatattcatgtaactccttcattggtcatgctcctagggaattagcagtcattcttcttatcaacatatcacaggatgttttaatggagatgggcctgctgttccctctgtctaacagaagaagaaactggcttttcaagtcataatcaattctgcatatatttatttatttatttatcttcagttgtctgaaatgaactgtcactgtacacctatgttgattcctgctatttcctgaggttgatctacaggaaaccacgaatttctcctctaattggttctatctccatactccctgtatgggctttctctccggtctcaagcaaatcaagtttatcatatatatttgtctcacaaaaaagattagtttcttaaatttcaatgatgtcccaaataaatacattacaataatacataatttagttgaattgttatacttagtgttggaggctttggttgtgatcgcataggcataaagttttccacacttgttattgtctcctcatgtttttgttcatatggtgaatgcatttttgggtttcgacacttccatgtctctgtatctggttccacatttcgttttggacctggtctggcttgacaatagctagctgatgtattggtctaagatcaatcagcagctaggattttagacaaaaatgggtaaggctacttagtgtagagggaaatactttagtgtagtatgtacaggtgcaaagtgcaatgtgtctgcaactatgctttttatagatatctatcctgtcttcaagttcaataattaattaaatgcctgaaatataaaggttataattttaatagttctataaaatgaaaattcctaatattagtatacatatgccttattgacattatatgtacataaagactagatgattttcttttatgttttctcgctataatgcttcctataataagtgttttctctagtattgtgcacaaaaagcaatttctttttttttttctgtagtcaagccagaaacctttgagttgagcacctcgtgtctacagttggaacactttctgttctgcaggctatttagtcattattgatttgtgctcgtcttcagtaataaatagtaataaaaaaaatatcaaatgtaaaaatatagtttgggcctttggcacagtgctggggtttgtaaacaatctaaattgaagaagaggtaaaaattggaggaaaacctaggttggttattaaccatatgttgaagtattgatggcattggtaacaacaggaaatatggtgaaagagaagcaagtaaacagtaggagcgaagccaaaaaggcccaaagctcaattgtggcttcctaacaaatgaagagatggaaatgatgataactatggaattgggtcttgtgttatttgcttagatgcaccatttctctgtatgttacagcttataagtatcgagtatcctagctagattgctagtgtctacattttgacgttacaaattactaagttttaggtcttcacccgaaaaaaaaattacgaaattgaagattgccacatgtgataaacatgatagatgataaagtgaggcaacagtaaaagaaggattgaaagagcataaggtaactgtatataatgtaattaaacaaccacctatctgtgcatgctaccccccaaaccacacacacatttctattttttgtgggttcttattttcttattttatttactttacgaagtcttgcattaaaagcttggttaaccctctcttgcagaagtatgaaatcaaaaattatggcaacttatcccgacgcttttcctgaagactcaacgagcgaagtgattgataggagaccggatcttgaaatgcccaagtaactaatgttattagaacacagattagaaagagttatatgagagtttgtttttggtttttcttctactcttgtgataaacttgtcctatttgtcttaaacgttttaccagagcttcttgcccttaattaaattctctaaacttttgtctatacacttttatactgacagtaaatgcattacgcacaaatgataaaatattttcagatagaactttggttttgttatgggtgactatggaaatacgggtggcggtggtgcaactcgtgcggttcactaaaaaagatgagcaaaacgactgaaaaaagaacgagaaaccctcggtcaacattatcatttttaatctctgaaattataaaagaatctaaattttggaaattattaaattatctaaatcgcgactgtcttatggattaatatgatcaacaaattttaatttcattagttctgtatttccgagatgagaaatactagtgacagtctaacattctttcaaatactcttttataattagttaaaatttattgaaaatttaatgattatttctcctaatttatattaaataaaaaatgaaacttaccaaaattgataacttttaataaattttaaccaatcatcgagagagtcttcaaggaaaagtgtcactagcattcatcttgttgagattactattatctttgattctatatataaaaaacatcaaacaaatcattaagatcaagaaaagtaaggtcccatttaatgtcatcataaatttaaattatattacaaaaatacccttaaatttaaatgtgatattcacatttaatgccaatactcataatccaatgaataagtaactaaaaaattttaaaactaatcattatttcttataactagtaacaaaagaaaaacacaattcgtttcctaaaaagtagttatatattcacaattcagatactaaaatagtaattagtttgtgggggtcaagtgaggtggtttgataatacgtttgagtggagaattggggagggtagaaatttaagattttggaaggacacgtggtgtgagggtgggtgtctaaaaaacttgtttcctagaatctttgttaattccgaacaaggagaagctaccataaaaaaatatgaggaggttggagtatggtaggtgagggtggatcttatttggcggagggagtggtttgagtggagaaggccttggtggaagaaatgtatagattggtggatggtgtcaccatttcgggacatggagatgatgcttgaatttgggtggaagattagttcaaattcattcactgtgagatccacctatgagctttacatagattaagagattaaggttttgttggagttaggagaggaaggaaagaaagagatttaagggaagggagggaaggaaaatgagggaagttctttcctccttgtttgagagttaaaaatatattaagagagggaaatggagagttgataagatagatacttttacaattttgtccatacttcaaaaattaatacactctatatttacaaataaaacttaattttaaatttgtagctggataggatagtaatttattgcttttccttctaaaaccccaaattggggaacaacaattttaatgatttggaggattcagaggagttttaaaatcctcaaatcttttcctcaaaaattaaaactctcaaacaaggagatgtcaccacctaaacctttcccttccctccttccctctaaatctctctccaaacaacctaagagttggagccaagagaaggacatctttatgagcctatgtaagatcaaagtgccaccatagttatccttttttatttggtgggtcttcctaaataggcttccttctaaggatatctcattaagagaagcattgatcttgaggatgataatggttcctgccccctctgtcacgaattggtcaagaacatttaaatcttttattctcttgtcctgttgcatacaatatcggtacaatgtgctaggggcactctcaccaaaacagccttgatttgattggtaacaaggctagtagtgggcaacaggttggagtgtcatcgtttggaacttatggcaacaaggttatgttatgttgtttgaaggaaaaccttttgataaggagcaactatggcacaaaatcatgttttctatgtggacttggttgaagtcataccacagagattttggtgcttcattccagcagtgacagtgcaatccctcggcgtgcttgttatgaggagtgatggactttctgtatgatgtgtggctgattgatacctaaggctcgtatcttcccgtatgcaggttctgtgtaaactaagattcgacctcttttggttagataggcggcagacatcttctggtttctttacagctattgtttcataggcctcaatttttgaggatcccgatgtgtaatctttgcacactttcttgtgcagttaatgatgtcatttgcttaaaaaaaatattaaaatagtaatttactcatttaataaattaaatatattaaatacaccgagactaacgagaagtcatcaagacaagaatgaaaatgtctttatagggtagcttcctacgtctgatacaactagtcaactgttactttacagttttaccgcatgtattctagctatgcaacatttttttcgacaatggtggaaacaagccatgaatgaatttaacgcttcaggatgccacaattaatcaaaaagcttgctagattaaaaaaaaaaaaaagacggacatgtagtgtagtaacataataaggccaatcagtaacaaatgtgattgatttaattgaactgtggtgttaataaaactaaagaactaaatctgagatactagctaaaattgacggtgaaaaaaatcttaaaagagcaggaaggactactagaacaaaaacaatattgtgacctacttcatagccagaaaacaccctattacataacagattgtccacaaatataaatctttttccagtatgcccaagtcaatcatcggatagaaaataaacagagactaaattaaaacgaaaactcaaaaacttaaaagccaactatatttcagtatttcccaccttgcttctacccctgttgaaagtaacaaagtaagctgctctgcaacaaagtagatctaaatgtacaagacaggaaacgaccaaccaagtaaataaaaagaaagaaaaaaggcaaagtgaaggataaacccgaacaaaaaccaaaagatataagcatcttaggcagaaaaccctaaaaaacccaaaaaccctaggagtaaaccctgttaggagctaaccactgtaaacaaaacccaatgagaagggattggtgctagcattctatgaactaactccgcccagccaatctcaatatacagatctttatcttcactaggcaaccaatcacactatcttcagactgcaagagaaggcaagacaaatcaaatcaggcggtaccaaattgctgataaatatacttctaagaaccaatatatgccactgaagtgggttggaccgcctccttcgaacacattagagcttagacaccattagaaacaaccccattggctacaatcttactctcgggaacaactggtttagcaccctttggggcatctccagtttttgtagcagatccattctcgggaactttgtggtcatcactatccttctcagcaagggtagactccttgagcaattccgagctaacttcagatttttgagtattaacttccccatttatctcaattttctcatcagcaggtttcccttcccatacctgcatcagtagagtaaggtaacaaaaatacatcatcagcacacacaatcaattatttcacttaattagaataattgaaatgtgacttgcctgctttgggaattgttgctttgctttcttctccaaaatagttttctgacgggcctcatagaagccaaaatcatccagaatgcatgtcttgctggtatattccttgaaaattttaattaatttcagcccaggctccaacattacctgcaaacataaacttggttgatcagattaaaaacaaaactacattacaaagaactgacaactacaagtgcagaaccaaattacctcttgtgtatccctactgttagtgacaggtttgttctcattgttgtccaaggtaatgtgcctcaacaaattgttaggaacatccttaacaatgtgccacttaagaggaaagcaaccattccacttgtcttgctgccaatactcaacactcttgttaaaatcaacaggaccaaccatctcagcaagccccacaaattgcccactggtattaacctgcataggcacataacacattagctatatataaccaaaactgcaaataagagtaatgacttccatcattcacagagatacttactgagaaaaagagaaaaacaggggcgccaccaggtttctgctgtgcctcctgatatgcagcatcaagcttcttgttgccattttgtgtactagcccacacattatacttaatactcttatggatatcatcctcgctgtaagacttgatgacaaaaaatttggcatcagtatattcttctggaaaatcagctttgttatattgatcaaattccagaatggtatagtcttgtctttctcttcatctgtgcctaaacttgcaggcaaattctgcctttgactgccaaaatagttggtgcaaaacctttttggttttgccacccttggccctaggccctctgttcagttcgttcaaaccatctacgttctcattgccatagccaaagtagccaccacttcttcccctagttttgtatttactgtcaacagctaaccaagcccgtccattagtgcgagaatcatacccatgtgtaccataacccattccagatctgacgtgttcccatattgaccatatagtttgtttgggtaatcctatttatgaagctatgggtggctcccatggcaggcattggtcttgggtggtgcaacccctgacaccaaaaaaacaaattgtgaataaataatcataacagcagtctagatagaaacatgacagtatggcacactaagctctattagaacagcacagatggaccaagcaaccaattattaggactttacggccatcaaatttaacaaatagaacaaagtaaaaccagacacttcaaaataggatacataccataaactgagaattagggcggaaagtctggttccttgaggcagcgttgttgccacctgatattgaagaagtgatggttgtgctacttacaggccttggctgcccatctgaaaataatggggcatctagccaggggataggtgagcgtactccatcaaaaccaaatcttggatcctgataacctgaagttggccacgacctggcatagcaaccctttcatttgatatttggaactaaaagatgaattctgattgacctgtttaatagaagcagcagcattattacctttcgcgttgccaccatttgcaacaccattagaatttccattggctgcatcaacagggagaggcttttgatcagcagctacagaggtggaaacctcaccctgaggtaggacagcaggagtaggtgtgaatggcgcactggttggtgttaacggttggaaatatggagggtactgatagtgctgaggcccatacaactgaccatcattccccatggttggaactggagaccctgctggcgaataggggccatagggcgcatatccatatccatggtgataaagtagagacccattatccccataaactccctgcaaatgttaaaatatattaatgtaaataaaacatttgcagcagaatgaaaaagcctgcacaataattttggaaaatgagaaggaaaaaaatacttaccgaagtcatctcaactccttccgaattcacatatctagaataatcatcccactcgttaccagttccatcatatcctataataaacaaaaccatgtcagcttgaataagatttacgtgtttcgttttcagaatttttcaaaaggtatttcatgtcgtttttcagaagcacttatccataaacttaccaccgtaataataggcagtagatgggtaaccatttgggaggtaacacatagtaggatcaataaaatcctgcaacacgggggttacagaccggtcatacgactggatctggccattcgcagcatttcctgaatcaactgatccatactgattcccagtggcctgcacaattgaacaaatccactcaataccacacaattcactaaaagaacacaaaaccaggtacaaatacatctcgctgaacattccaaatttataccactaacacaacagagtgaaatcgtgaattttcaatagcagccataaaaaatacaagcttttaccttcttggtaggctctggaatctccaagggcttgggctgtgtttctaacgatagcttctgtagcaaatcagttgcttctgtgcaaacagcagtaaaggaacacaaaacatctcgaaaaattgaacttttcaacaaccagaaaacctaaaacccgcaacacacaaataaaaattcaaaaaacctaaaaaaaaccaacaccccgcaatcccaaacgagtgaatcagccataaagtcaacaccgtcaaaaactcaagcagattaacaagaacacgagaacagaaaaaacccaacacccgaacatcataaatcagcaagctacccaactaacactaaaagatcaccctaccccgaacccaaaaatcaagtttcagaaacgaaaatccaccggatccaataaacgattcaatacagcagaccaataaaagacaaacacgagagaaactgcacagcagagaaggatacgatccgcgggattagcaacggtggccatgacgaaccaaccacgagatctggtttttctttggaggaggaatagagaaacggaagccctaaatccgaatctgaatcggagagggtttaagcctcaaatcgaaaagttgagaaaaccctaaaaggagcgaagaagagagggaaagagaaaaaaaaagaaaagagagagaagagagaacacaacgggtctcgcagccgccaagggtttgggtttttggggagagagggttttgttcctccaaaagcagtgattcaaatagcaccaccacctctctttaggcactctcgctctctcactcgcgggtcactctgtgatctcattcgccttctcccattggtggatccagccacgtggcgcctctccaccggactttttctttgtaaattatttctacggttggtctgtcgtgcttgtttctttaaggtggtgggtgatgttagtgagaccccttgtgaatcttgtagatgcggggtttgggcaaaagatggaaaccctaattagaaaatgacacggatgtcctcgtccagctggacttgttgtaacccttcttcgatttttttctttgggcaccttctgtcatgtgctccaccacacacacatatcgtgttcaaattcatttccagtttatcagaagaaaaaataaacaaataataattaattatatatttaaattttatacgttattatgcgtttcaattaatatttttaataatagaattcaattattataaagataatttggattttagctttaagaatgttggcaaattttatctacgttagattaatcgttttaaatttgaaataatatataaaatgtttattattattaaataagtaccttcgatattaagatacgacattttcaaactatttgttggtcaagatggggaagataaagataggaccaccgcttacattgttttgattaaatatatctattgtttgataaatcaataagataaaaaatatttttctttgccgtaaaaaacacaaatttattttattttatttattagatcaaatgtttaaatttattgaataaaaagtttgtcttatcttaaaaatagaatagaaaaaagtttgaattacaatttcagtccctattttcacaaattggcattttgattctcttgatttttatttagacatttaatccctctaatttcataaattcacgattttgattcttctatcaattgacaccattacatgctcaccattaatccttatgttgacacgcttactctgaaacacgtttgaagtgcaagcattttctttcccatacatgtatcgatcattgcttcaatttcacttaaacataacaaacaaacttgtatgtgcgagtactcttctgattttgatagagaatctttagttttaacgaacatggtataggtataagtaacatccaatttttttaaataggattgggcatgggtatgtacctacctgtccctacccatacccatatccgacaatataattactaaattacccttaatgtagtattgtgtataatacacaattaattttattaaacttttatacttactaatcattgtctatttttttaagactaaaactaaaactcttaagcaaatataagtcataagggattacaatctctctcaagtaggcatggcatcttgacccgcatccgtggcatccatccgaatccgcctcgatgtcaacggggaaaactgagttgaccgatttcgggttcgaattcgggttcgggttcgatttttcctcacctgttgaattcggggcggggaggtttggtaatgttgataaccaccccccccgccccgccatgctatatttaattatttacaaaatacctttatatatgtggaacaccttggaataaaggcttaattttattcaagaattaggagtataactaattttattttccagcaataaacatctaatgttgaaatttattgtaattacatacaattgggacttagcgcgatcaaatttttgctatggttgttgtttaaattaattttttaatagcaatttttaagtgttcggggtggggcggggcgggggaattttttagcccatcggttttcggaggcggggcgggggtggttttgagggcggggcggggtggtataagtaaaaaccgccccgactcgctccgttgccatgcctactctcaagtctcatgtttcaagacaattttaggtgatgatgactaccaagacatgattgtttggattagatcgttttcggattgcaaacttcaagactccatggattgttgtttgaaacttaaacagaaaaatggaaaagatgaagaaatgatggtgaatgccgtcacgatccgtaacgaagcgataagtcggaggaggattgtcacaaaggaaagcttccttgataagaatcaatttggtttcattcaagaatcaacaggagactaagctctcaatgcaagcaaaatgcttaatttcattaatcaaagttgtccaaaaatagcatagtctgagtagttatatagctaagcctttaatgatcgcctaaaaacgtaagttaggcctattttggtaatattaaacccattacaaaaataaataaaattacgaaagtcctcgcagaggtggcgcgctgagcgagacaagtggcgcactaagcgagcagaggtgtgctaagcctaaaagctctcgatcaggaattgggctgagcgagccaaaggcgcgttgagcgagcagaggtggcttgctgagtgagcaaaggtggcgcgttgagcgagtagaggcgcgctaagcctaaaagctctcgatcaggaattaggtgagcgagccagtggcgcgctgagcgagcagaggtggcgtgctaagcaagaagaggcgcgctaagagagctcacccataatcttcaaggtgcttcaattcagctctttgtgtcttccttcattcttgcccttgttaactagtccagctatgattctcttggtcatcttttcttgaagaagcttggctttgaccttgtcattggacccttcaattcatggagtgcttctagaacttcataatcttggatagtcctctattaggtgataagaatatgattttcatggattttttttattgtgataggattttatattgggtgatggcaagttgattgtctaagcttgactccttgaataataatatatttagttttgtttaaaaaattaaaattatttttatgattttttgtatttttttaaattattaggtagggacggtattgggcgggtatacccaatccccaatgaagactgtgataaggaaaaaattcatacccatcgaagagggaaaggaatcacatattcatccttccccgtctcgttgccatgctaatctcaccactcaacaccaacaaaaatattaaccaaacttacccttctctttgtaacaatatcaaattctcactatatactcccattgattttctaccactttttctcctttgttaaaaaataaaacagtgtgttcccattccctaatccctacatcgtgcccatgtcccttaccataaaacataaaagaagagagcaaaatataaaaaaaaaatcattagtagatctaaaaaaaaaaaaagccatatcatatctaaaataaacaaataaaatagaaagataaattggagagagagaaaacaagaataaggtgatgcatggtcaaaatagtgtttcctatatctgtttttgtgtttcatgtatttggggagaatggggcttagaagaaaatcaagtggttgttgggatattcgcaatgagagtgaggttgaagagtgtgatgatgtgtgaggacgagttcaaaaatgttatgaggttcatcttcgcaaagtgtgcgctgacaataacgacggggagggtgaggatggttcaaaagcaaaagtaacaacaaagggtatggtgggaacattgattaagattgtggtttggttgtggtgttttgttttgtttgaattttgttgtttatgcccattcaaaaataggatttgttttgcatttctctaactcaggattgaatttggtgttgtgttcattaattcatcagtgtttttttatttgttttctgtctattgaagattgggatctaattttgtctcctgttaaaatgtaagattaggagcaaggtgaaaagaggaacacctgacattggggataggaatggttatggtaagagggatgatgttactcaacgttaaagtatagcggtcaatgactaattgacggaaaaaactaaaaaaatcatttttaaacattaagaggaccagtatataaaaatcaggaataaaattgtgaatttgggatattaagaggaccaaaattgcaatttagcttagataaaacatactttggtttggtgaccttataatacttatggttgatttgaaatttttgggtattgattacaataattatggaaaataaaagactaaattacacaaaactattatgaggtttgtaaaaaatatataacctctcttttattgttgagacattacttgtacccttttcattttaacattgtttaacctcatttacttattttctatatattcattgtgtccctttgaatcagtctatcactcttatttgtttccaagaacctcacaaactacaactattggacaacttatttagggttctaaagaaagggaaaattcatgcatttgttagtcgttgacaaaccaaatagcatggtgaacgggtgtaatgagctcgtgcacgatttgaaacaacgatgttaggttcgttcttgattttaaacaatggtgacgatatttgatcatgatttgaatcaggggtggtaaggttcgtgcataatttgaaaacaacaatggtggggttcatgcacaatttgaataatgatggtgaaaggggttgttgcggcaaagtctaagctttcaaacaacaaaaaaggtgaaaataaaacaaaaaagagtgtaaagcaaaacataaaagattagaggttgcataccgaagcaccaaaaccatgaatgttaacaaattattggttggaacgggttaaccaattatttcaacaagttcctatagtcttcatatgcagaagagtcactatcttatattgtttttttcttttttacattaagatattataggttgaagaaaagggtatttgggagatgttatttcaattaaggtcatgtgacaacaccattttctcatttactaacaacttaaatggagatagtggcttagggatcataatatacactcttaaaataactttcacatggtgcataaggaatttaacttacacatcgtagcctccatccataaaacatatttatacatgatttattggttatcatatgacacaattcaagagtgtaaattatgattgatcattcaatacattaaaagtaaatgcaagggaaaacagcggagcaaagttttggtaaaataaaataaaagtatattttcatattcaagatggttatgcttggagttttataatatcttttaagagagaactatttctcagtttttttttttcaaaaaactatttctagcatcctcttcaaaagatatgagcagaaaaaatatatatatatatcaaaaagggaaacttaattgaattgaaaatgtttttgaaaaaatataaaagggaggtatatatatcattgcatgtatagcgcaaaaatgctcaagttcaatttgggttgttaaacaagctcaaacttataaaagtacaattgttgagcttttaacgacttttgtggcttggcttgtattaagatgtgattgtctaggaataaaaggttagtgttttatttatttataagctagaaattttgggtcaaaccttagcttttcatccaccatgttcggaccgacttaattgatctaacccattccccccttttaaatatgagtatttatgaaccaacccaattcaataagaatcaagaaaattgattcaaaaaattgaaaataaaataaataaataaaacaaacgaatcaaaaaatcaaaaaatcaaaattttattggattggataaaattttagatttaatttcaaaagtcattcaattcaaaccaaatggaacttgttgtacccatatatatttattcataattgataatatcactcatgtttatattttatttttattatttgtaaaattattacataacttatacatatttataaaaaaatatttaattgaagatcactttttactaattttttgaattaagatgcttaaatatagttatataatgacatataaataaaataattaaattagaagaagccatagacgatatcaaaggaggtggggacagtgaagttgttgtggttggcgaaggtgacaaagttgatgagggaggtgaggagtgagttgacggtgtcttcgtaggcaaaatccaacgtgagctttggcggggagcagacttgggcaagagtgataggcacagttaataaatgatgattatttaggggagataaaagaaatataattttaggagggtgcaagtgtaataaacgttaaatttagggcatgagtataatttgctctttaaattaatattttctcaaaaaaataaaagtatgactaaaattgaaaatctatctgatcactccaactgtttaaattgaattggattaaagttttgaacaaaataattggataataaattaaacaaattcaaagtgactgaattgaatgatattttcgttcaaaatcatacaatccataaatagtcatacttctaaataaaaatgtggattttaatttacgaatccaattatactactcaattaatattagacagccttaacttaacagggacagttttcttaaattcactaaatcattagaagttccgatcgaacatctaattcttattgcaaataataatataacatatacacatacaaaatctcaaactttagtttcaccaaggtgaaggtgaaaaggaggagggggaggttacaaacactccaaacctgttgatcagtccgataaatttgggtttgttcctccacagtaacacttggatcctccattaaaccgtaatttgtcatggcaccatggcaatctttaccaacatcgcgcacaaggttgcggcaacaattttgctcttttccggtgttagagaatatcttctggagcatttggtcgccacagtttgaacgtaacttgtgcgtgcaattgatcatatgatccgcataaggttggagacttggagtattggaaatcctccttcatgtccagcgcagatgtctttcaagatatctggctaataaagtggcaattaccgcaaacagaaccattattaggcaaaacttgttaagggtccacgccgtgaccactgtttatttagatgaaatctgattattgtggggtgtgatgaaaagctttgttggtataggagctgaatatgtagtaagacctatttacagttacaaaaaatgaagtttaatttcaagattcgtattaatggatttttgctcaagtctaatgaaacaaacaaaataatttgatcattaattactgttatagttaagttaataaatggaaacctttgctttagcattcattacgtgctttttattcccccagtaacgaaggacttgtttagagtggcagttaagtttatttttttttaaaacaaaacattttggttgagtcgaaaaaattgagacatcaaagttatatataatttaaatcactagtaacttaagtccttagtttttaaataactttattttatttttataatttgattataatagaaatatagtcaatataaaagtttagattgaattaaaaacggtcttaattaaaataaattatttctgtaaattgcaggcacatttattataattcaatagttatacatagttaagttatgcatgattattcctcaacaaacagtcccacctcaagatcttgaatttgctcaatacgtgggtcctcaaacttaaaccttcgaaccaccattctctctcgatcttcctgcttgcaagaaaatccagatgacagtccaaccacatatttataagattttaaacaacgtttggtatactccagttcagccaacaataccttatttgaatccttgatatttaacaaggcttgagactggagattcagacttggcaccctctgttgccacaactctcttttgagatgatgaaacaaatagttagaaatcaaaacaaatgtaaaagaacttaaccaaagaaaaatcaacatgcagaagatacagctctatttccatgttttgaaacaccattggcagttgatttcccagccttagctttcgatgttgcaccctttgaaactgctctaccataaattcctcaagtggtcacttcatccatagaaaaagacattgaactcttgcaatttatacaccaatgcaaaaacactacccaattcaacaaaataacacagatgtacttttttttttaacaagtttcgttttcaaagatatatatcactaggcacaagtatttttcaagcacattggaaaccagaaagatggagttctacagtgtatggcattactagaatcttataaccagtagctagtgtatttaatgcagctttcctagtttcaccatccagttctgcagtcaaatttgcaacaatttgcaatgactttagctgccactaatctgtccacataatgcaaggagtaactattcaaggaaaatactgaataggaaaaagaaatcattaaaaagcattagtaacattacctctgcaccatgatgatcaataataaatccaacaagatcggcacattcaattcgagttcggttattctttgagcgcaaaccctgtaatatataagggaaacatttagacgcagaatatatggcaacaaattgttttgtcagctccagcattttttctcgtacttctcaatgttatgccctaactgcaacattaaaataagaaatgaattgtgacttactcatctgtaacaccctaggaagtacactagtcaaacctagtatctatgtaaaccaaaaatttgctgaaatcaactataccatcagaaagattcactggaataacaacatcctcaggtgtcacaaatactaaagttgctaatataaaccttctctactaagcacggaagaaacactaccccttcagaatcggtcaaagagtacccctcgtccttcaaagtgtcaagcagttcaggaagaaattccagcacctaagcaattaagaaaagataagactctatcgagtaagtatactcctataaattaaattgaataaagttaagactaacagccgacatctccatgacaaggaaggaaaggaaaagaagaaaactgaaatcacaacaaaaccaaaaataaattgaaccttcaatagacatgttgtgtttgatttgcagaactgcaacacaaagcacctcagaagaatgtccaatacttctacaacttccttagcaatggatggaagtgcctgaaatgtgcaatagcagtttgtataagttctagtgcactcaacacttcaaaagaatgtaattcacaaggttaaaagaacaccttcaaaagttctagccgatgtagacagcgtactgatgatttgaaggttaaatcctccaccagcctacctatcacctcatttacctacatgctcccccccaaatgtaaattaaaaaagtcacaacagacagaagactaccaaccttctagacgctccttccacacagcactttttaagagtgatagtatccgactgtataagagaacctattcggctttcaatctctttaagactcatctcagtaggctgcataatgttagataaacaaaaattgtatgataagttattacagaaactgtgtcggaagattcagatcagggagaagacaaacagatatcaatttaactcaacatccttaggtggttcaactgattttgaagccttcacttgtggaactccacctgttttttttgtttgtccctgactttacaatccccccttttcttagcaacaggcttgaatgtgcaaattattgagcatatctactcgcatgcatataaaataataccatgttaattttacaagcaagaagatgcaatcttacaactgactgaacaggtctctttccactatgcatgcctgctgctgaccttttgacaagtacactttcagaggtctgtatgcaaatcaagttaaaagtaaatgccagtctccaatatatgctttcaactttaaaattaaaacattcataaattttattatatccatctttaacatggttctcaaattcctgtctaaaatccattagcaatttagcattcatattcccatttgatattaaagcaaagcttgggctcacattttcttttcataccaagagttctgtctctattgctcacaatcctgtgttccatagctgcaccaagcatatggaaataaatgttctttgttcgggagaaaattctggccaagcagctatccattgtgcatattcctgccctggatcaatggactgatgttctcaccaaacctctctctactaccagatttaactttctcaaaagcaaactcaatgtaaaaagtttttcttctgaaaacttttccccttgagtttgaggggggatattagaatatgtaagcgctgttagcagatagtattttgctaactgtacctctctttgtataagtgttagtttctgttattgacagttagtttttattctgtcagtatcagatcaagaggttataaataactcagttttactaagcttcaattaacttttcataataagagaacaatattcagagttactttctgttttctcttttctcttcttttcattctgttcaacaggaaaggaagaccaaagaaagaaaggaaaacttgggagagaacttccaaactacatatagtccaacaaaaataaccagtcaactctaggtgcaacacataaagaaatgaaactgaagattagtcaaactaaactaaagaaaagaaaattaaacccacctctgcagaagatgcacttacacgtgtattttacacagaagctggaacatcattatcaagtgtcagcataaaagaatcaaatttacacatttaaaattaataaaatcactatatagagagccaatcaaactaggaattttgaaacataagcaagatttgggaaatttcaaacagtgtaactgaccatttgagtgttgcccagcatatttatagaaatttaatgtctggttgaggcataactcgaaaagcaattatcagcatggcagtaggaatttattatgtgattatcatggtcacttttaatgggtcatatccaaatcaatggaattcttttaccaataattattataatcaatggtcaatctgatccaattttaaataggttggtgccaaaatagagaaacagcatatgttcaaagacattggcacatacactagtaaacccaactttgaaaagcatataaggttgttaacatttaagaaggcaggtgaagttcaacccaactgcaaaagtcaaccccctaatttgagaaaggaatcagccacgtgcatcacagattgaaatagttaaagatgttcaaagacatgggcacatacactagtaaccctaaatttgaaaagcatatacggttgtaaaaggtttcagaattgaaaaagagaaaaaatcttcaacttcagaaatgaaatatttttgtattaactatcccaactgaaaagtagttacacctgtagtatttatactagagctacgtgtgctgtttacaactgtcataactgacagagcagctgtcaactaacctaaggttgttttttttatcagcaaaaataattatattaataaaaatatagtagcatcagtacaagtagtactactaagattacattttcagaatgcaaacctgcagaagaagcaccaggcacagcatcttcagatcctgaaatcatttccgaaagctcatttcttctaacatcatcaagtttctccaactacctctccagaggtctcatgccaactgactataacagagtgaacaatatgatgctcaaaatctcaaacagcaaaagcacattcacaagcacgcaaacagatgtagttgtaacaagttttaccttagctattcctgccaatactgaaaaggcagcatccctgacttcaggaataccgtcatttaggcactgcaatatccaaattttagcattttaaaaaggtgaataaataagtacaaatcaaacatcgacagtgtactttaaaaaaaaacaattgaaataaattgaatcctataataaactacagctcagaacttgaagactatacatgaaacaaataaacacgactgtaaccgaacagtttattacatcaagttcagagtagtcctactcctacaccaaggatagaagggggtcaaactgatatttaaataaaaagagctaaagctgctgaaccaaataaaagccagagattctaaatcacttttaaattccagcaggaaaataagagcattttactaaacaaattaaacggcaagaacaaactgacctacatacagattggcacatattccttgtgcaccttcgtaataaaacccttgttacttgtttgaatacaaaaagtcacccaggtcaaggttaacgatcgcacaagatggactttgtttttggtggctgtcttaacatctgcaacagattaaatgtaatacactcaacaagaagcaaacataaaaaactattgagaaagaatgataccttaaatagtgaggttaaaagaacaacaccttctgcagcatttcaagtccatcaacttgcttcttaaaatctgcacttaagagtcgcctatgtaaatcctctctgaaatacttcatcctatcattctgcaaattgcaggcacatttattataattcattagttatacatagttcaagttatgcatgattattcctcaacaaacagtcccacctcaagatcttgaatttgctcaatgcgtgggtcctcaaacttaaaccttcaaaccaccattctctctcgaccttcctgcttgttagaaaatccaaatgacagtccaaccacatatttataagattttaaacaatgcttggtataattgcgaggacgataactggacagcaactaatcctccaatgctctgcaacgacaattctgtagtttgaaagcgataatagctctcgattgattattatacatattctcatctaaacccacctgtatcgaaaattatatgaccgccacgtgctgtatgccacggcatcatgggaataatgtcttcaaaatctgactttatcaaggaattttttctctttacctttacagaggttcaagagacccacttttcaatctttccatccacgtttgaagcccggacaatgttttctcatccataggaagtacctcaccgtgcattgtattctcagtaccaacatgctctgatgcatgaggaatctgactaggaggaggaagtccctgattgaagttgtcatttgcacttgttaagtgcctgccaccagatactgtactaccagcagcagctgctaattgcatgcctcttcatcctctctctgtttgcatccaatgttccactggtagttcatatgcaacttctccaagtcaacattctttcttttaaaattaaaaatagattcaaaacaaatagaattatgttaccgtacctcctgtcataaatctatcatttctttggtcacctattgtgtagtcagaatttaatgctctagaagtaatgacaatcacagccctattctcctcattgtatgaggatgggggttaaaatttgttggctcaggtttgacatttaatttagcatcaccgaatggatttgcgtttacaggtgagaggtgaaaaatcaggggaagatatatttaaagatgctggtggaggggttggcatcggtaaactcaaaggggttcttccagctgcagcattcttctccatctgccaaaatgttaatatcaattgccaattgtcaaatactcaattctactactctaaatcgctggtacaaatacaaaatgcaaattcaattaagaacatgtggtaatacaagtaaattaactaaacctgatctctaatgtaggtgcgaaatgcctcactagcattttgaagctgagcaaatatgtcaacctgagataaagcaccagaaccttaatcaattgagcaaaaatgatataggcttaaggttttattaaaatcataacattacatcttatccaaatattaacatgaaacttgaaataggtgtgtttgtgtttggtacggtggaactcaaggaaggagagaaaattttgaaaataaaattttgatttctgtttctagtagtcaaattttctctcccttttcctttcactttcttaccaacgaaacaagaaaatgcatagcaatgtgtttcctttcttctttattttcttttcccccaatcgaatataccattaatacttatctttgggtacaattgggtaatctgatatagttcatatagatcaattgtgcaagtttgcttctcccgaatcttcttaaatatagcagccagctctggctgcaatttaattttaaggataggaacagagtcaagggtaaatagcctttgaatttgcagtaaaataggatattagggaagaataacacaaataaaaacataatataaattagaaatattgacatatatatcaattgttattaggatcgcaaatcaaatcgtaggatcgtaagatcctaagtttagccacttctgcgctgactgctcatgggatcattggtgagtgagattagcgtatagttaatgggatcatctgcaacccaaagttcagtctagtgatgccaactgcaaccaacccacctccagcctgcgccccaccaactgcgtctcttctttggctcaacgaagtgcaaactgcaaacaactggctctacttatgtttttttgaaaatgttatgaacttaagttgagtagtgtgttttcgaaatactgtatttggatcttatgacttattgtgatttgatttttcaataagtttgtttaacgttgtgaattagaggttattttctttcttgtgttgtttttttatgcatgtgtgtatataattttgaattttaggtagtaggatcttacgatctaagtcatgaccctttgtagaaacttgagtttaacaacaattgatatatctttagtgcccaccaaaatactgagaaatagagcataatgattgagcatcagccgaaagggtgccccaggctgaattattggttgctgaatctccccattggttttgtctcccaggtccagatgcagtcaacattcttgcagcagccaaagtctaaaatacaaaagtgagaataaatacagtataaataagtctactcctacctcaaaataagttaatttgtttgaatttatacctcaagattaagttcaatgtaggcaaggatgatgggttgaggtttagcatcgataggaaccattgaaagatgaccctttattgctgcaccacaaagcttgacaagttcatgcagaacagtttttaccattcgtaaaggtttgtcatcagcaccagccctatacaacattagaaaataaaaagtggttctggctttattttataaggaaaaaaaagaagaagaaaaaagtagtaactctacccaacaaagttatataccttctcctaatttcctccattcccaagtcttgcaggtacaaatggatgctttgaagcatgcgatcaaggtcaacatcatagatagtactctaaagaacctgcagcacaaacaaatacatgttaataagattacaatgaataaaaggtatcaagacagaatttggcaattttaactctgcttcttcaccatgaaaaatagatcataatggatttgtatcttgaatatctaatagatatcagttatacattctggcccattatataatcatccactaaccaaaaataatataattcatcaaatccattaaatatttcagcaattgtgcaaacggtgagcaaatatgaaaaagtgtgcaagccatgaacagtggccttgaatttgagaatggaattcaatcaaaaagggagaggggagtgggatgagtaataagagagcagtttgttgcattgattgtgaactgaacaatcatccattcaataagcataaatcatacaaaaaatgaccaaaaggccacccatacctaaacacaattagatacataaattttagagtccagcacaaataatcaattagccctgtgatccagcaactattggtttatgggctatattacatccagaccgataatatttataaaaaaataatagttaagtttatctttatctcatatccctctagattttactgatgactgcacaagttacctttgtaagcgtgataaggcatttcacaactagatcggagaacttctgatttcttgaagcaagatttatgggctatattacgtccagtccaataatatttaaaaattaataaaatagttaattttatctttatcttatatctttcaagattttactgatggctgcacgagttacctttgtagcaatttcacaactagatcagagaacttctgatttctggaagcaagtgactcatttgatgctggtgaaggccacctggataaatctagtggccgcaaaagattgatcaagacaacaaaggatgaattcctatctgcattatcctgaattgacaaacactagttactaaaataggcccaaaattaatgaatttcacaataaaactttaaccatacctcaatattggaccagcaagagatctagtcatttctccactttgttttgtgacatcatacctgataatggaagcaataacataataacatattcactgttatctatattaaactttttatatttgataatctacacaaaaaacaaactcttcacctaagcaaaaagattttggaaaaaactattgtacaattcataagggaataatgcacaataaagattggtattataggttggcactaatgacaaatgtgtaactccaattttgattagtgaatagtactaaaacacctaaagaaatgcaccatagtattatgtatggattttggaggttcaacctccaggcttaatgacatcccataatatggccatcaaaacaagagaaattatagaggggaagaaagagaaggaaccaaaaaattattttcaacttatctgcaacaagtcactcaagtgacagattcgtcaagggattattaattaagaattgtaaaccacaaattgaacaatttattatatgcgtttaattctccaaattcgcacatccagacatctactaactggctcagcctttttttcaaaaattactttctttaactctattttcattacccctaaaaaattccatactataattcttaaatctcgacaatcacagcatagcttcccacaaaaccattcatgctcccatcatacttatttaaaaggcaaaattagcaaatatgctcacagtaaacaaatgcctaaaaaagggactcccgtcttgtttgttttcattttatagatgatgatcaggatcaaaagatcagagcacaaattagaaggaaatttttaaggcattaactgaaaagcataaaatacagaacaaattggaaagaaaagacacacccattttccctgaccgagcgccttaaaatgcccttgcttcaccaggctttccttgcttcttcttttccatctcccggacctagtaaattacacaaccaacatctcaagaattcagtatagcaaaaggagaaataaacaagtaaagtatgtactgaccttccacttgaatctatcatctaacatgctcttttaagcatcagttagcttcccaacatatttccatatgtcctcacctgcatagcaagtttatagaaggaaaataactatgccaggccaagaggtatgaagaaaagtaaccataatttagcacataaactcctcaagtggtcacttcatccatagaaaaggacattgaactcttgcaatttacacaccaatgcaaaaacactacccaattcaacaaaataacacagatgtacttttttttaaacaagtttccttttcaaagatatatatatatatatatatatatatatatatatcactaggcacaagtattttttcaagcacattgggtgtagtgtgtgtttttggggggtggaaaaaataattgtcttgagtgggaattactgtaggagacagtggtctcttgggaattaggaattcatctctcctaattctttctactgaattgtaaaagctattcttggaaggaataaagattcagcgtattattcagaactttctgtgtttgtttgaagattcaagaacttctatttcttggttcataccaaaccacatattcataagattttaaacaacttttggtatactccagttcagccaaccataccttatttgaatccttgatatttaacaaggcttgagactgatcttgaaaatatattgattcagacttggcaccctctgttgccacaactctcttttgagatgatgaaacaaatagttagaaatcaaaacaaatttaaatgtacttaaaagtacttaatcaaagaaacatcaacatacagcagatatagctctatttccatggtttaaaacaccattggcagttgatttaccagcctttgcttttgatgttgcacccactgaaactgctctacctgactcaaatgactctaaagaccgaaaaaaggaggagtaagggaagatatataagcaccaattcaccaacattcgcaaagaagaatgaaccaaagaacgtgccttgaaaagctccgtatgggtttaacttctcaacaattagtgtcggtgctggtccatgaatgtctttaatcatctttttaatctaaaaataagtaaacaatgaagatgcttgatattacaagaatattaaggaaacaagggaagaaagcagcattcttcttatacacataccatttcatgtctactagctctcagtatctcattaatacaagctctgatgccttgcgaacatcggaatatttatcctaagaagaactcatcatacattttgttccaagaatatggaacattagaactaattcgataaatggtataaaaaatgaaaaagcagaatgcagagtaaccagatcatactgtcattgcagaagaggaaggcttcagcagttgtgcagcttcagcaaaactacttaacccagaaagttgcctcgataaccaataaaaatttttttacgtccttctgcaccaagtttagagtccatcaaagcaattgcaatatatggaacctacaggaaaaccatgcaaaggacacagataccaagacaaaagaatgaaagaacacaggaccagcacagaacacagaccatttcaaccagatggacagcagccagccaagcgtctaatgtattcagcacacgttctctcatgtgcttcttgttgtcaccaagacatttcaatatatcaaacagaataccctgcaacaaaccatttccagaaatgttcaaacagaaaacaacaccaaatggggggggggggaatacgaaaacagaacagaatccacttaccttgcttgccttctctacagcttgacccattgctgatgcaacattgccaattgctgtcaaggaagccatgacaatgtttttgttgctattaacaagtcgtcccctaagaccctaaacaacttacctggtaataaaacagttaggaaaaattaacaaaataatcagctagaaatctagaataattaccaaaagataccaagcaacttatccatttggggaggaagttgatgaaagaggagagtaaagagaaagagagagagcataaggttaaaaaaattataaaaaaaatgctaatggagtgccatttccagttgcttgaatgcgcttattagcctcttccaatattttgtttacagcatcaacagactccatacgaacctataataagtaatgcacggcaacattagaagcaatagcacaataatacacttcttcaaatactgaaagctaaaagcaaccttaaaatacaaaattaaaagcaaattgctcgctcttatcaaccaaaccttccaatcagggccatgaaactagcctatctgcatctttcacaagttcattcatagcacttccttcaggatcactagtggcctgagctaactcatgacaaacaactttcattccatcaacagactgcacccaacaaaataaattttgaaattcagagttcaacctccatttttgaaaaccaaaaagagaatagggggaatatctcaaacataatatttaaaaccctgcatagaactaccctcatcaaacataatatacctaaaatggattcttctcatactctgtatccggggcactgagcagtgcaggctttaccatcagtaagaagaaaccctttaatgtctgcaaggagaaaaaccttagagccttgaaaacaaaattgagagaaatcaaaatttgaaagttaacgcaaagtgaccttgaccaacaaatctatgtagaacacccaagaacttaattgatgcatttctagtagcagcattacttgactgcagcccaatttctttaagaaaattaattaaatcctgaaataggatttacaataaaccatacaaacttccaacaaaaaacaaaatatccaaaaaaattgtaaattcagataatgcaccttcagctttatatgtgagacaccaaaatcttcaacagcagaaaccatccacaaaattccctcactaagaaccttggggttcttatgctccttcatgatcttgtaaagctacagtaaaattcacagtttttcaaacattatttgataatacttagataaacataaataatgtgatatacggccaaaagttacaacctgcattttatatgaattcccacatatatcttagattcttaaaatgtgagtttaagccttactcataaggtgagggttgtcccccacttatattctctatcttggtactatctttagccgatgtgagatttgggttttctccaataaactttttgtcaagtttcataaaaagaatttttttcccttactaaaatttggtaagaaattatgagactacaatgaaatatacaattttacctgattatctaaatagtcaaaaacttattaaagaaaaatgtatatgctacaatatgtttctcatcaaagccgcacagatttgaggtatgttcccacctcataatcttcagataataagcaatggataatcaaaaacagtgcaaaacaatggcattaaactgcagaaaggcaattcaattatttaaaacagtgacaacaaaaaatgagtagctaaataatcataattttaccaaatgactcttccaacaaaaataaaatatcaagcatgtccttcccagggcatagatttttacgattcacaacacaagctaggatgcactgaggtggttatcccttataattagacaatatgattataaagcgcaaccatgcttactctttcaaaatgaatcctggacaaactgcttcagacaaggtactcagacatttcatagcatgtgcacgtgtcttaatatctgctacacgttcacttagtactaccaatgaaaaacaagatacaaatcagaatagtcattcacaaagtaaacatatcactgatacaagattgcattttacaatagtgcgtattattaccaatagctaaattacccacctgaaaggcaaagtactacgtagtactttggaaatttagttgcagttgaacctatatgagtgataacttcaataacctgctgctgaacctgcacaaggaaattacaagcattaggtcccatttataatatcattcctacatttgactacaaatcattaaaataaataattttaaaatacaaaagaaaatatttttgaacctgaacatttttctcgccccatccaggtaaactgcagactaaacgaatcaaaatttctactgattggtcaaggtcctgtaagccctctacttgctgtttcagtgaagaaatggctgcaaaagtctaacttcagcaaccttacttgtcaagcatgtccaaagacaccacaggaaaatcagaaattaaacagactacatcaagtcatccgtgaatatggcaggaccaatttgaatttactgacccaaaaatgcaacaactataatttacaccaaaatatgaaaattcaatttacaatacaaggaaaaataagagcattttactaaacaaattaaacggcaagaacaaactgacctccatatagattggcacatattccttgtgcaccttcgtaataaaacccttgttacttgtttcagtacaaaaagtcacccaggtcaaggttaacgatcgcacaagatgggactttgtttttggcggctgtcttaacatctgcaacagatccaatgtaatacactcaacaagaagcaaacataaaaaaactaatgagaaacagtgataccttaagtagtgaggttaaaagaacaacaccttcagtagcatttcaagtccatcaacttgcttcttaacatctgtacttaagagtctcccatgtaaatcctctctcaaatacttcatcctatcattctgcaaattgcaggcacatttattataattcaatagttatacatagttcaagttatgcatgattattcctcaacaaacagtcccacctcaagaacttgaattttctcaatgcgtgggtcctcaaacttaaaccttcaaaccaccattctctctcgatcttcatgcttgcaagaaaatccatgacagtccaaccacatatttataagattttaaacaacgtttggtatactccagttcagccaacaataagttttttgaatccttgatatttaacaaggcttgagactggagcgctatatcttgaaaatatattgattcagacttggcaccctctgttgccacaactctcttttgagataatgaaacaaatagttagaaatcaaaacaaatcgaaagtacttaaccaaataaaagtcaacatacagaagatatagctcaatttccatggtttaaaacaccattggcagttgatttaccagcctttgcttttgatgttgcacccactgaaactgctctaccataagttcctcaagtggtcatccattgaaaggggcattgaaatcttgcaatttacacactgatgcaaaaacactaccccattcaacaaaataacacagatttacttttgttttaacaagtttccttttcaaagatgtatatatatatatatatatatatcactaggcacaagtatttttcaagcacattggaaaccagaaagatggagttctacagtgtatggcatacctagaatcttaaaaccagtagctagtgtatttaatgcagcattcctagtttcaccatcccgttctgtagtcaaacttgcaacaatttgcaacgactttagctgcccactaatctgtccacataatgcaaggagtaactatcaaggaaaatactgaataggaaaaagaattcattaaaaagcactagtaacaatacctctgcaccatgatgatcaataataaatccaacaagagtggcacattcaattcgagttcggttattctctgagcaaaaaccctctaatatataagggaaacatttagacacagaatatatggcaacaaattgttttgttagctcccgcatttttcttgtactttttcaatgttatgccctaactgcaacattaaaataagaaatgaattgtgacttcctcatctgtaacacccaaggaagtacactagtcaaactagtatctatgtataccaaaaatttgctgaaatcaaccataccatcagaaagattcactggaataacaacatccttaggtgccacaaatattaaagttgctaatataaaccttctctactaggcacagaagaaacactgccccttcagattcggtcaaagagtacccctgtccttcaaagtgtcaagcagttcaggaagaaattccagcacctaagcaattaagaaaagataagactctatcaactaagtatactcctataaattaaattgaataaagttaagactaacagcagacatctccatgacaaggaaggaaaggaaaagaagaaaactgaaatcacaacaaaaacaaaaataaattgaaatttcaagaatatttatcctaagaagaaatcatcatacattttgttccaagaatattgagccttagaactaattcgataaatggtataaaaaatgaaaaagcagaatgcagagtaaccagatcatactgtcattgcagaagaggcaggcttcagcagttgtgttgcctcgataaccaataaaaaaaaatttacatccttctgcaccaagtttagagtccatcaaagcaattgcaatatatggaacctacaggaaaaccatgcaaaggacacagataccaagacaaaagaatgaaataacacaggaccagcacagaacacagaccatttcaaccagatggacagcaaccagccaagcgtctaatgtattcagcacacattctctcatgtgcttcttgttgtcaccaagacatttcaatatatcagacaaaataccctgcaacaaaccatttccagaaatgttcaaacagaaaacagcaaaacagcaccaaatggggggcaaaatacgaaaacagaacagaatcctcttaccttgcttgccttctctgtatccggggcactgagcagtgcaggctttacatcagtaagaagaaaccctttaatctctgcaaggaggaaaaccttagagccttgaaaacaaaattgagagaacaaatcaacgcagaacacccaagaacttaattgatgcatttctagtagcagcattacttgactgcagcccaatttctttaagaaaatcaatttaagtcctgcaaaataggatttacaataaaccatacaaacttccaagttccaacaacaaataaaatatctaaaaattttgtaaattcagataatgcaccttaagctttatatgtgagaaaccaaaatcttcaacagcagaaaccataagcaaaattccctcactaagaaccttggggttcttatgctccttcattatcttgtaaagctacagtaaaattcacagtttttcaaacattatttgataatacaaaattcccacctcaagatcttgaatttactcaatacgtggttcctcaaacttaaaccttcaaaccaccattcgctctcaatcttcctgcttccaagaaaatccagatgacagtccaaccacatatttataagattttaagcaacgtttggtatactccagttcaacgtttggtacttaacaaggcttgagactggaccgctatatcttgaacagatattgatcagacttggcaccctctgttgccacaactctcttttgagatgatgaaacaaatagttagaaatcaaaacaaatttaaaagtacttaaccaaagaaaaatcaacatgcagaagatacagctctatttccatgttttgaaacaccattggcagttgatttcccagcctttgctttcgatgttgcacccactgaaactgttctacctgactcaaatgactctaaagacaaacaaaaaaaaataatatgtaagcacaaattcaccaacattcgcaaagaagaatgaaccaaagaacgtgccttgaaaagctccatatggtttcaacttctcaacaattagcgtcagtgctggtccatgaatgtctttaaccatcttttcaatctaaaaataagtaaacaattccaagattattgatatttcaagaatattaaggaaacaaggaagaaagcagcatttttgtcatacacataccgttgcatatccactaactctcagtatctcatcaatacaaacctgaaagagtgataggtggtgcccgtggtgggtttcaggggaagaatccaacacctctggagcaattaacacgacaataggggtagaaagaaaacaatacttccttcttgaaaaacaatactttagaacaagtcaccttggtcattttctttaataatttcctgcaatatatcttatcaatgcaatcaagaactctgccataaaagatgaatacataatagataaaaccttaccttcaatatcggtccaagcaattatctaaagagtgcgagaaagaagagaaaacataagagaagaaggaagacgcagagaacatgctttctccatgcatgcatgtcaaaagaaaaatcattattctctcatcttcttccctctattagattttttctcttccttcttgaatagaaatcctgaaccataaagcaatgcagaagtgttttgatgaaagtaggactgtggaagaaccagacacaatagcaatgtatttatagattaataaattgaagcgttgttggaaagaaggaaacggtcatatcaaagatctaagaaagaagcactaaacgtgatatttattttgataataatatgatcattaacagataaaaagaaaattgacaaaattaaatattattcttatgactctattatacatcatgttaaaattgtaattaaaaaaattaattttttatctaaatattagcataaatgtagattacatatcatgaatcattttgtaaaataattaaattaaatttatttgataatatatcatgttatatattatatataataaatttgattgtcgtaatgtaataaaaaaatatgaaaaaacaaagaaccacgctcagataacaattctaatttttaaatttatttgtttaagaaattgaagcgtcataacaaaatgacaccaagataacaatagtaaaagaatgtctctagtaagaataagatagtgtcaattaccttccttaattcatgaatcatattcataatgaattataattaacaacatatgaattgttacaaacttaaacatgatattttgataatttacaactttaacactagctcttataaatagaaaagtctttcctagttaaacttttttaacacttaaatactaatatagtaattcgaagatttaattgacatttagttttgtaaatattgaaagacataaaataaccaaatcacacaaattgatagtgttgtttggttgagaggttcgaggaggaggaggtaaaagaggcaatatgacaatgtggaagtgctaaaagtccaaatgaatctagctttaaattcattaaggctttttggcatatcttgaaggaggacatcatgaggtttatggaagaatttcatagagtttgggtttttccaagaggctcaaattcatcattcataggtctaatccctaaggttgacgacccacaaggccttggggagtttagacctatctccctagtaggatgtatgtacaagatcatggcaaaagtgttacctagaccttgaagaaagtacttaatgatgttattgatcaaatgcaaaagtgtcttctttgacaaagatttcttctacatagtgttttggtggctattgaggtggtgggagaagctaaaaggaaaaacaaaagttgtttggtcttcaaggtggattatcaaaaaacctatgattcagtgaattgggatttcttgctttacatgcttcaaagattgggttttaatgaaaagcggattaggtgttgtttgcaatcttctataatgtcggtattagtgaatgatagcccttcaagagagtttgggatgcaaaggggattgagacaaggcgatccattgacaccatttcttttcacaattgtggcggaaggtcttagtggtcttataagtgaggcggttgcataaaagttctattctagttataaggtgggggtcaattttctacaatatgtggatgatactattttcttaggagaaacatctatgaaaaatatcttgatcataaaaagcattatgagatgctttgaattggtttcgggactcaaagtgaaattccataagagcagttttggagccattagagtggaggagaggatgggattgagatttgctcaaatcttgatttgtagattactatctctaccattcacttatctaggggtacctaatgggggggcaaccctagaagattggagacatggagattggtcatcaacaaattcaaaaagaagttagcctcttggaaacataaggtcctctcttttgcaagaaggttgtgcttactcaatttggtattgacttcattacccttattctttttttaaaaaaataattccaaaggtggtgttacataagttaatttgcttaaaaaaacattctctgggtggagtggatgggagaaaaaaaaatggctttcttgggataaagtgtgttgtcctaagagtgagggagggctaggagttaaaatattgtcatattaacttactttattgaaaaatggagatggaatttatttcataaccaagattcactatggggaagggtggtgttatcaaaatatagggattggagagggttgttaagtgatgtgagtgacaagttggaatctatatggtggagagatctaaaaaaattgtgtggggttgagtgatttaagatggtttgatgaaggagtagattggaaaatggaaaaaagggataaaataaatttttggtgtgatgcataagagggagagcaaaactttgccaatttatatcccaaactattcctcattttattgcaaaaatttgacaaaattggcaatatgggaaggtgggaaggagagacgtggagatggaaatttagttgatgtaggaattgttttgtctaggaagaggacttgctaagaaagtttcaccaacttgtatcaagtatgggcattgatagcgagcagttggatggttggaggtggaaacgaaatgtggattagtcttattcagtaaagacaacatataatctcattattgggaatgacgggaaccaacagacaaacaaaattgttggtgctatatgaaagtaaatattcctccaaaagtgatcttttttttttggagattatttttgaacaggttggccactttggacaacttaaaaagaaaaatgtgagggtagccatgaataattggttatgcctgatatgcactttggaggaggagacaacactcacattcttttctctttcaaattagcagatttggaaaatggtaaattcatgaggaagctatactacctaccattatcacccgaggagaacttttgacaaaaacacgggtctgcaattctgaatgaaatttatgtatgctattatttttggatgtgtaatttttgatttggaaatttaaaataatttaaaccaaataatcaaacaaatgacgttaacataatcaatacagtatgtaacaaaatggataaaaggttttaatgatcaatgatttaacaattgaattgcttaatagagttttaattagcccaaagatatcaaatggtggattttgctatgaccttggtgcttttccggaaaagtagtcaagtcctctagtccaatcagttttgacaatatcagtttttttttttttacagaacaataatactactagttaatgatgtcattattcaaaaatataaagttctaatcagtccaaagatatctattcgtggattttgtatgaagttaataagtacactcctgacatgatttaactctaaaaataagaaaaagtctaagtgagtggttaaatatttttttctttctaaatgacatatattttgagttgaataaaattattatcaacaataaaacaaatttagtaaatatttaacaaaattatatacgaagactcaaacctaaaattactgattaaattatgataattacattttagttcatcaatgcgtttaattagtgataattaatttattttacattattcaagagattctcgaaaatatttttagagttatccctttacgagctacatatgaatagattatatagattacaaattcattattattgtttataatgtcattgagtgcatgttattgcatttaattattgtcattttaataaccatctcaattacatcaataacacaagggcacaattggctgctaacggatactttccttcattgtgtatttatatacagattaaggtgtaccttttaagagaaacattttaattaaacgattaaggcaaaaaatatattatcaccataattattagtagcatgttttttttttcttcctggatttaataaaagctatgatactaatagttattctaatatttctttttaaccaaaaaaactcacttattggtcataacccttttcattggtttacacaaaagaagaaagaaatattttatggaagaaaccaaaaggttaagaatgaaaaaaagggtgattagggtggtggttgcaaagtttgtgtgttggatatgaaaaaatatctctctcccaatggatgaaaggattaattggagagaagtgagaacaaagacagagaagaaaagggtttagtaaacgaaagcgtgagagtgttgtgcgctggaataggtagagagtgatggaaaaagattggtgggtatgcattataaaaaacatgcaccttctatattgcccgcactaacacattaaatgcaccaaagccacattttggatcactacactacaccccagtcgatgtgggacctttccatcttctccccatagccaagccaacacccaactcatcaacatcattgccttctctgaattatctcccactcttcccttttctgtcaccaaaagccatgtccccgttcacatttgataatcataatacttaaccactagattggactcaaaccatgttattttttttcctcctttgcacaacttcttgtttgattttgttgtgtgtatcccttcctcgctcctaaatctaagccatgtttcttgaggagtgagataacaaacacaaaaaatagtaaaagaaaaaaaaaagttttggcttttgtgatggggtgttgatagaggagctagctggtgctgcagggtgtgtttggattttgtataatgggtaattgctggtgtaggtggaatcatcagagtatagagtctcatccaatgtaaagtcaggttggtttactaacaaaaaacttgcctttctctgttttggatgtttttcaattatttatcattgcctggaacgagtaagtgtttttggtttgtgatttgttgagagttttgattagactccttgttttcctccttctggattctgttttcagctcttgaaaatggtttattcatctccttcttttctttttcaatattttgtctttgatgggtgttattctcaaggatttcatgttttggagctttccaatgttccctccttaattgctttcttaatcaccctttcatctggttctttttcattgaagattttctgtttgtgatattatatcatttgaatctagctactggaactttgatatgtaatattattagcttcaaatagctcatccttgtaggcaagttgatattctgcaaatcattgaaagacaaagagaacaaaaaaaacagaaatcttcatataggagttacatgttgtcttcaatcaaatattttttttataacttttctaaagttacttcattgtagaatctgttaatatgacccctaatcaccttttccttatgtgtctgcttcaaaagtgggtcggcttgtaattctcacgtggatagtggaaagcctcttcacaataatgcgttgagtattatcttaactaaatttctaagaaaattagtggtgggtttttaaatataataatccgctgcttcacgattataatatattcccaccatcttatgctttggaaagtgtactatctttcttctctttatccaatacgagagaagaagtttatgtataaatttttttatttatagatagtgaacttattgataattttgtgtataacattccaataaattaactgattaatgcaacatctggttagtttttctgaaaaattggatgaatatatatgaatgggaataattattctcataactttcagagtttcattaaatgtgcatatcatttgttctcatttctcttattgattcaccaaaagaacaaaaccagggaaccaaacaaaggcatgatgatagtaagttaccatcgaatcctgaagaagtagaagatctacggcgtgactcagctgcaaatcctttgatagcattcacttatgatgagttaaagataatcacagcaaattttaggccagatcgtgtgttggggggaggaggattcggaagtgtttacaaagggtttatttctgaggagttaaggcaagggcttcctacccttgctgtagctgttaaagttcatgatggtgacaacagtcatcaagggcacagagaatggctggtacactttttgttgcctttctgtacattttttttatagatgataagtctttctatggaagcgtgctaaatctgcaagacttgagagtgtgtattggatactcttaatttacaaggagatatacaaaaagtatctttttggatggggggaatacccatgtcgcttcaacttctggactgtgaagttccccctccattgtctttctgaacattgtttcgtatgaagttgtctaactgtaaagtcatgatgttgcttcacatgctatgtttattctactatttggcacacataagttaatgtgacaacaaaaatatatcgttggtttaaaaattgttgtaagattaataaaattaaggttttggttgcttcataggcagaagtcatatttttggggcagctttctcatccaaatctagtcaagttaattggatattgctgtgaagacgaacatagggtgctaatatatgagtacatgtcccgaggaagtgtggaacacaacttgttctcaagtaagtatatcttgccacttgttcttgatattgaaattaaagcttaggacaattgctaatgcatgtatccatggctagctaggaatctatttaaagatctcatagcaaaaaatgttaactgttttgctttagtagatgcatatgcatctatatttactttttacttaattacccctttatgttgtctccgacaatgctgacacttaaaagaaaggaatttaagataaagtgattttggttccattttgtagcttcgtggaaaaataccgagttaggaagttttgggcttaagacgttggttctttgtcacttcctaagacatgtgctttagatggatttgataaggacataagtttgacagtaacattacataaggagataacatgtttttgctatactacatacaacctttagtgatcatacttgatgtcaatgttaaaaaagactatgactattaaccctcaacattcctttcacttttgcgatttaatccgtaaaaacgaagaaattacaccggcaactctatgattttttcatattgcatatggtatttttattttttttaatgtttacagcgattttaataaagacacacgatgtaatattttaaaataattatgaaagttagtataatatattgaaaatgtcagtgtgatactttctaaacataagatattagtgtagagattagaaaaaaaatgagacatcaagtgtaatatgaaaatatctcaagaatacacacttttgtggaagatcttggggaaggatctttataagaagatctctttttttcagatccatcattaaaaaaaaaacttatcttcacgtggagatccaggtcttccctaaaaattctagagatctacactaagttcaaaaaaaataattttttatgtgacagggtgaaaaaaataaaataaaatgaaattaaaattaaaataattacttaaaattaattatatgttttattaatattcatatatttttttcttatttattaattaaaattaattatttaattaatattttaaatatttaaaatgtgatccatgtgagattcattaaaattatctaaaattcaatttagaatctatcaataaagaaaaaaaaaatataatctttaatcctaaataacattatagaatctaataaaaaatgatctaaataaaatttcaatttaagataggtcgtgagcaattgagagatttctgaatgtaaattcttggtaggtcctacaccattgtccaatgcaatgagccgaggagtatttttgttctcggaagaccacttactgttttaattttaagccagctactaacttttccagttctagttttaccatgttttccgaactttttcactgtagattaattaatgtttgggttaccattttttgggttactgaggttgacctttaaaacaagggtattcgtgtgggctggaatcccttattttgtataagcccatttagacataaaagtcatgaacttttttgttttgtttttgagaataacaaccatcatcaacttaatattgcccggtgttgaaaaaaaaaacttgctacttatcacatgagtcacctcttatgactagaggatttatatatatatatatatatatatatataattttattttattagagctgctagggcctaacaggtcccactaatcaagtggtgtctaaagaattccaaccagccatgggagaggaaaagatgaatgagaaaaggtttatttacattaaaaaagaatatttctttcatccctcttgtgaagtatgaaatgaattgaatagagatagaaagaaaaacaaggtagaaaaagtaagagatatgcgatatattgaatactgtaataaagaaattaaaagaggaataaaaaattaaaaaataaaatgaaagaaatagtgaaaaaaaaggtttgctaaacccactttatgtgataggttgtcgtatttgcttcacattaattagaccatttttcatgggaatgaaacgcgcttgctggattgatgggtcatttaggagaattcgttaaagcatcattggtaattcctgtaattataatgcatattataaataatttatatctttttatacattactgagttttgtagccaatagttatttccattggaagtttctatagttagtagggtcatgccattaaacatcaaaccagatcaatctcatccacaatatattaaaataccttgagaagaataaaaaaaaaatgattgaggaattactttggacatagcatagtgctagtgtgtgccacacgagttcataaattatcataggttttttcctcacataagttactattccaaatacctaggtgccggggctccacaaggccagccactctatgtcttatacgtgaggagacaagtcagctagacatgtgactaacaatattagttttagctatgttcaaacacaagaacttcttaatcatgcacggttcatcacattatcttttaaataattaaattattatttgatattataaaaccatattttaaaaaaagtgcattttgttataattcttgcaaactaaaatttgcacaagtcaaataacaaataaagtaattacaataaaccgtgtctaataattaaaagttgttctttaataaatggtaagataatattttacattgaacaacacaatgtatgtcatgtcaattatatggatcaccaacctatttaacttccatcttaacctttaaatttcatgttgaatatatttaatatatattaaatattaatatattacgtacaatctaataaattattatataattaatggactcatatagattattaggatttttcctaaattggacataactctattgaacattgcatatttgatacctcatgatgtaatacttaaacatccaacattaaactctttctctctcaaaccccttatctcaacattccaaaagattagcatgagttatgtttaattagtaaatgaaattatgtaaaaatattgtcttctagcaaaaaaaatgtctatctagtttctctgaatcacacccctccactatgaatacactttagtacttcacttttcagtttcacactcacattctctcagaaatttatggatcatctcatctttcacacgtggaacatcactcaatcagaacgaattctaggtagttgaaaaagggagactccttaacccaacaagataaactattttcaggatttgaatccatgacttcagagtcacatagctgcaaccttattattaatatattaagactcactcttaagtctctaattaaataatgaaagttctagatctttgcaaagaatcacagtgaaaatctcccttaatagctaatggaaaaagcattacacgctttatggattctccaaatattaaatgtttttgttttgcatttgatatttttttttaaagtaattgagatattttaagccgattgtttaagagggttcaacaatattagacttggattctttttgtgtcagaggattattctgttggagaaatatagacgcagagttaatgttgcaaggatcctaccacgattaatcataaagtccactagttatattcaaaactgtttgtatttattcaacaaaagaagagactttaatgtttattattgtctttttggttgtatatctaatgtgtctttcttgaatattgcagaaattttgcttcccatgccatggtccataagaatgaagattgcgtttggcgccgcgaagggacttgcatttcttcatgaagcagagaaacctgtcatctatcgagattttaagacatcaaatattttattggaccaggtcagcacacttaaatatgcaactgaaaatgaaaaaaaaaaaaaatgatatatataacgaaaatgtgtagacactagacagatgaggaattaaatttaaccatttaagcatatatagggaggtgaaaaaaaagtgctttccataatttatttgtttagggtctaatttggatgtaggcagattgttggaatcaaacaatcacacaataatcgagatatgagaaaaaaagaaaaaaattatacagagtttacccacacactcataaaatgcactcagtttacaagaaaatatataagtttaaaaattctaagcacaatagttattcatgagtccaagcccaaattacaaaaataataaaatacgagatcaataatagtactgggcctcgaaaaaaattccgagggcctgccccctagcccccgttgaggagactcctgcatatcttgctgacggcacaatataagccatacccaaaacagtatgattctttggagttacacgctgaaagtaaaggacacaaagctattgatgtttgatgctcaatgctcacaagaaatttagctattaaatattgttgttgaggtcatgttgattattgtgttcttcaatttaaaatatttagactttcataacctttggtgtttatgatttattttatactaaacttattgcaaactatagatactgcttgcagttatgttgtcaaattttttatcatagcaaaacgcacatatgctgctgtttaagacacaagactctcgccagctaactatagatatagataagctttactaacaaattgtagttatgttgacaaatactgtttttttcaaagatgaatgtactattaataattggcattgttttagttatttcgtggttcgcttaagcaatcatgcacaacgaaacagtatttgtcacaagaccaaagcacacaaactagtattttgtgatatctctggttagatttcaggtgttgaagcaaacagcaaaatgtaatttttgcattagtttctactcttgtacagcaaagaccacaatgtttccaaaataagccagctttcaactaaccatcttggccttttatgtttcaaaaacaggactacaatgcaaaactttctgactttggcctcgctaaggatggaccagttggagacaatctcatgtttctactcgagtaatgggaacatatggttatgccgcacctgaatacataatgacaggtaaagtatattctgaagctggagttctgtactcatttgtgaatcaaagttcatattttcactaggcataaattaaggccaatgtagagaaattatggttgccccagatttttgatagagtttaatttttatgcatagtctgtgttaagattctttatattatcaactaataaaaaatcacatgaggtataatttttaaggtaacttatataaaagaataaatctatgattggatgatagacgataatataaaaaccctttaaattaaactcttagtatactacaatttgacatcataattatatgttgtgcaggtcatctgactcctagaagtgatgtttacagttttggtgttgttcttcttgaacttctcactggaagaaaatctttagacaagttaagacctgctagagagcagaaccttgcagaatgggctcttcctttgctgaaggaaaagaagaaatttctaaacattatagatccaaggctggacggtgattatccaattaaagcagttcacaaggctgcaatgcttgcatatcattgcttgaaccgcaacccaaaagcaaggcctctaatgcgagatattgtagactcgttggagcctttgcaggcacacacagaggtccctattggaaaaacattgaccataatcagtgaggttcctgaatctggtttgaaaatgaaagatgatgcaaaatgacttaaagagggtgttgttgtaggttatcagtttcacttctcatgttcactgggggagaggttttgccttaacttcttgtgtttattaacatgacatataggcaatttctttctattttatccccttctttgcttttcaacatggttgtcatatatgtacagctggattattgtataaaccgatatcaagttaaacagaaacaaacaagcaatagcagcaatacaggatatgattagacgttcttctgtttcagaaaaaatattttatgcctgagattgtttaagagtttcacactgtttctgaaattgttatgtatggtaaatttattaatttttatataatttaattgaaagtcctatttttttataatttcttatttgacaaagtaatttcttttacagtgcatagaaatgaaactctttctttatttgaatctaatatctttccaatataatgagataaaacagttaatttttttctagccaaaaccttttgaaaatgtccgttatcccaatagttcttgcataaatcagtgaagaacacatgaggctacctagacccgaccagtagaggctaaggaacatgaactgaaacacattttcactgaaatattataaattaaattttgtgtacttttcccactgatatacacttcctaccattttagtttgctgggtaaatttaatcttgaacaatttcttatttttattgttatctgaccaggaatccttgcaaattagactgagtttaacccttaggtcaagtgtgattgtttctgagattaacctcttaattgcggatattgttagcaaaagtcctgtctaaagttgtgttttgggcctatgtctgtggcccatactcaataacaaacatcttggcctagatgggctttgttattcttacccgttcttcgctaacttcacactcttatttacaaatggtgtgacttaacctattttttttttatctttactggaaaaaaaaaagttcatcaatagtaattttgaacaattgctaaaaacatttgttcatgaaattagtaattaaaataatttgttgaattgatattatatttaacaattaattaaaatatcattggttttccaaaacaattttattactattatataaaacaccttttgtcattatttataacatatatagtcaataacttttttgactcttattataagacttgagaagtgttagtaaaacaactttctaacactcatttcatccattatgacttaaaatttattgaaaactataaatgtagagagaaagttattaaataaattgtgagatccatcaaaatttataatttttaataaattttaactaataataaaaatatgctgttagtatttctttataagatttcattttatctctcttatacattaataatttgttgactaaaatatttttatttattttaatctataattaaatgttcatttgaatttttactttctcttttctataaagattaaagaagatgaatagattctgattaatgttaacaataaattttaaaaaatattacagttaaagataaatttaatactaatatctaaattaattaatttttaataaacataatttagacaattatgtagaataaaaagaataagttttattccaatcaagattcttaattattattttttaaaaattttcatctccttaatgaaattgttgatgacttggagttggattgtcatagaggtagtacagccacgtctcaaactcaaactttgcaaaatcgaaaaagtacacgtggcatgatactagtgaactgaatggatgttgcttcttaaatcttaaccacttcagcaatctacgttcacaacctctcatccatgtctttgtggccctaacaaactgttaactatgcacaagcacaacttcaagcaccaaccaagggatgctccactcatagaactcaatatagaaactggaactagaagtagcagtccctaagttttgtgcataaccttaaaccatgtcattgcctaccaccactagtggtcactcatctatttactctgcacttacattgccaagaaccacccaaattcaaccaaccttgttttctcccaccaccaagttcttttcttccagaagcccctcatattcaggtgtttcctattgtttctcaaacacccttttgtcaagacctttgctttttgctgtcaaggcttcatctggggttggctcagaagcatccaaacaggatagtgacaagagtgaagaggaagaggaggaaccgtatgaagagtatgaggtggaaattgagcagccttttggactcaaatttgcaaagggtagagatgggggaacttatattgatgctattgcaccaggaggatcagctgataaggctggagtcttcactgttggggataaagtaattgccaccaggtgtgctattcttgtttttttaatttttctctttctgcaagtttcttatttggagaattagatagaaggtttatagatgtggtataactttgatattcgtggttggatagcatattatgttcaagagagtttattggaggtcttatactcttatttattcttggttggtttatggttgtgaattttgatgagtttaacttttatgcacagttagtgtaaaaattttacaatgttactaattagaaattaagtatgacttttataatatttatcataaaagtcaacaaacttatcatatatatgaatatatcagtttgtgattggatgacccttttcaatatgactttatttagtaacaacaagaagaaaagtctaatcccattaggtgagtgatccatgttttggtatatcaacatgttttacattggctcccaagggcctaacacaaccttcttcctttacttggtcttgggacttgttatgaaaccattagcgtcatttcatactttcagtttaactttggtccttaaaaataattttgacatgtcatagaatcaaggtttctgaatggtctataaattatcctatgtatattatatttggggtggtggtgatggttgggggggggggggggggtcggtctttttatatgtatgaagtgaacttcaaaatccttttgagaagtaaacttgtatactttatgtttgattcataatgtctgagatatgtccaatatcttcaatatctgcagtgcggtttttgggaccgaaatttggccagcagctgaatatggaaggacaatgtacacaattcgccaaagaattggcccattactcatgaaaatgcagaagagatatggtcagttcaatatgtatgcatttttgctatgtttcgagtgctactctagtaagtagtcacttgtgacctttgctcattgatctcagagtcatggttccttattttgacaggaaagagcattgattctggtggtgagttaactgaaaaggaaattatcagagctgagaggaactctgggtttatcagtaacagagtgagagaaattcaagtaagtttcatcatgatgataaaactgcaaaattgtagtccatacattcattctcaaaccattttgtatataatattttctctactatagaaagatgtcactgctgtacttccatgtggggtacaaacatccattatcaattctcaaacttgcaaaattttcagatgctaaatgctttgaggaaaagggaacagaaagagaacagggaaaaggatttgagggaaggattacaactatataagtaagacttagcaactcaaaatcattttctttttgaccctctatgatgtgcccagtattcatttcattgtccaactttgcaattatattcttccgaagggagtagtaggtgaggtatgagaagagttaatcttgattcttgaccatggaactatatttagctataatcagatataagtaaaaccaatatttgatcagcaacgcatgattggttatatggtcaagattagcttcttttacctttcacactctcacttgatacaccttatatatatatatatatatatatatatatatataatcttcaaggttgtgctagatttattaaatttttcctttaggctaattactcacgtggtttcttaattttattttaggttgcgatttggtcccttatttactaaaactaacactagtcgtttttcaattttggggcatcattttgtagttttttttattgattcaagacgtgaaacttatctcattagattcacttacgtgaaaactatgggtcattcagaccaaaaaggacataaataagatgaaattgcatgaaaagtgtgtcttatgaggatctggaaaactgaaaatctccaaagatcaaccagaagattgctcatgagacataaacataatgaaaatcacatgaaaaaatttcaaaatcgtgtcccaaaattgaaaatgataagtgtgctacaacattatttgaaaaggataaatgttgatccctccattatttgaaaaggagggatcaacttactccaagagtaactctttccttatcctcaccattcattttcagtcatttgtctaactgattgaaaccatccatgcttatggccaaaaactggttaaagaaaatacttgcttcactttccaagcatccaatttgcatcatatctaaattaaaagactgactagaattgatgctatctcactactgataagtgataatactactgtgcactctgttcctggattaaatgctgaaggaatggcaaatatgatgaagcactagagaaatttgagtctattttaggatcaaagccagaacctgaggaagcagcagttgcaagttacaatgttgcttgttgttactctaagctaaaccaggtatttgtttccttccgttcgctacttggaacatgtaatttgatcttggattagttccttattatccttgcggaatagatataatccctttacatctgaatgtaactaatttagtccagtaaataaataaaaggtttattagtccttattagaactagctaaatttttcctataacatccaatatctagttttacacctgctaggttaggtgatacaccgaagtcctatagcattgaccaatcccaaacaaaacctgtgaaaattaagtctcctgtttatcttacatttccccatgtagagattagtagctttcttgtagtcattggattttcaacaacaagcatctgattcctcaattttattttttgattcaaagggaggagtggaactctggtaccaagagatttataataactcacacacattgctcaaccaataagctaaaccaccattggttatttttattaattttaaagcattgaaattggtatgagtattatatgcccatatttatattaataaggacaatatacttcttaattaatccattagtcttgccaacaaatgattctataatttatctatctattaatatactaatagagtaataaatatctcttaacagattcaagctgcactttcttcactagaagaagctctgaatgctggttttgaagacttcacggtaatcaacctacttcaagttattccattatcatattggctaagcatctaacattcttgcaattttaacagagaataagaactgatcctgacctggctaacgcaagggcgtcagaggaatttgatcctttattgaaaagatttgatgaatctttcatcaatgagaatgccatcaatgccattaaatctctttttggatttggtaagaaataacccattgtgtggacaaaagcatacagtttggctgactaaggagttggttgagcaatatgataattatttcccatgtataactttatagtttaactacacagtccctcattttttgtcccttaagcgggatcttgttttatgtactagtataatcaagcaaaattataagaaacttatttatgatcaataaaattgtccatttccatcacctcctactttgttgcatgttgtttcccacaaatggccccctaaagaacctgatttgttttgaagcaaccaggtatatatgagaggcttgaatcaagaggatttgcttgttacatgtcatggacattgtcctcttagttcatatagttgcgatttacgaagcaatcctgggcatgacttgagttaaagataatgcagcttgtgattctcaaaatctttaacatctatcttgatgaaatggcactaactccctctttcttttgatgaaactactcatttttttatgatgtttcatgtagctgtttttcaaccatcaatagatacctttctataaattgcaattttttatatttttttactgttttcaacttttaattcgttcacaaaatttcctttgtttctaaaattttacataaacattttcatattttataaatggattgcaattaaatctctatagtgcaaaaatttaaaattattaaatatttatactacaaatttttttgaaataatatgggagtaacaccaaagataaactaacataacaaagttgtaggttttaccaattggattattttctcttatttgattttggacttgaatttcaatgtctcgtttctctatcgcaatgacgattagctccataacagtgattattgaaaccaatacttcgttgaactcatggaagcagatacaaaaagctggggctaatcaatggagcataaagtttattttctaatgctaatatagtaatataagatgactacttagaaaacttctaaacaatatattatgcgtatgaaggtatttgactagaaatgggaaggatgaagtcgaattcaagtccttttactggttctagcaagggatcatacttaaacttctcatcaggaatcaccaaatcccacttgaaccgtttcacgatattatgcatgaacacaagaatctctagttagcaaactcttgccccaaacacattcgggggccacctccaaatggaacatatgaaaatggtgtaggccctgccccttcaaaccttgaagcatcaaaagtttcgggatttgagaagagtgtcatatcctcgtgtgaagaaccggtgttccaatgcaactgcgagaacagatcaacatgagacaaggttctctccttgtagcgaacatgcacttgttttactggtcttatatttgtaaaaagagaaattatcaccaacaattagtattgttgagtctcaaaaaaacaaggaagttttggtctatttaacaaagaaacctcgagtagttcatggaaacaagaacagcaaaaaaagatataaaaaagatttcaaagattgaaataaggttaaattaaacatcaactgaattagtggcctaatttaaaaatattgttggctgatgtaagaaaagaatattaataattgacagcaagaagacaagttttaaaagtacactatagactgtaactagtctctttagctttgatgttccattgtgtgacagtaatatcttaatggtacatatgaaaatacaaatttgaagcgtgagtatgaagtaaagttaaagatggggtagcatttggctatctgcaatcataaacgagatattcccaagtccaaggtatgatatgaaaacacttcatgaccaaggtgtgatttcaatgaatgcagagtgaagaaagcatgataatagtataaaagcattacaaaagaaatgaaacataccttccaccctttagggatgttataatcagcatatgtgaaatcctttgtagcttctctgtaagcaccactaacaggtggggacagcctcatgcttcagatgcaacattccaagagtatttcatttctgaacatcttcccattgcaacaattgctctgcctctttcccttgactaatttcaagttgttctgtcataaagataacttcaacatttaccctgatcaagttttaggtaagagcatatggctgaaaattaaaggatttattactaacctttcaagacatgttcataaacttgaggtaatgtccaagatacttcatgaccaatgataacactgatctagaactatcgtggccggcaaaaagtagaagaagtatgttatcaataacctccatttcggtcataaaccttccattgggatcagatgtaacaagcatgtgtgatagaaggtcttgagtaggtgatgccctcttctcctccaaatccactttccttttctttaaaatcattttaatttccttccttattacatctgcagctttcattgcacgatgaaaccttgtccaggaatgttgaggggcaggccaatgatccctttcagaaattcatcaaattttaacgaaagctttgatatatggtcagagtcttcaatgcttaaaaataagcaacaagccaattcaaacgtgtatagctgtacgacgggatagacaaacacctgctcctttccttcaaaattgcaaagtaagaaaatagtattcaactttgagaaaataggctatgcattgacattgtaaagtaatcacaatccatcatatatgacaagtttgtgatttttataataactaccttaaaatcataccaacagtgatttcatattggttgatcatgctatttttttttcatttctgatgaataaccagttttattagtcaaaacaaaataatatactcaatcaacactgtttaatcatcagaaaacatgtaaaacaggtgtccctcttaggactacttctgatctaagaggttataaatctaataatttatttctttatttcaggatgaatatgaaaagcagaattgagtataaggcccttctgtaactatttgctaatgctaaatcattatgtacctaccgactaacccttaatcatatatacagttgcaagtgttggatttaacccaaatttcattgaagattgttattgatagttttctataatatcgatacatatgtaagatttgtgtaacagataaatatatgtgagatttgatagatatgtaaaaggtatgggatatattagaaagatatgagagatttgaaaaatatgtaagagtctattagagatttattttaataggaaattgggtaagttttgataataaatttgactcttctcatctatggcaataggcaagttgggcttgaccactataaattgtttatgatttgtttgtgatgcttttacccactcactagtagttatgtaagcatatgaaaagaggatatgatatttcccaaggatatggtattccccaccaccaaggatggaagaagggccacaaagaacaaggtattatttaagtaccattagtaaatagaatttagctgttatataacatttcttaccttcccaatatgtgtctatatgacgctgagcaatgctatccatttttggcaagtagtttctgagtgtttctgcattaagaaagctcatgagcaaccttctcaccatctttgcctcatcaccaaccttattaaccaaggacaaccttcacaacctcctcaccgaactaggccaccacacttggacattcttgttctcattgctgaataggaacttgttcccagctggcccgcaaaacacaacaacaggatctccaaacattgaagtcttgaacaccctggagtcatatttcttcactctttcttgtatgaaccttaacacgtttccctcattcattgtacgcagaaactccaaggtttctccaacaacaggccatcctaatcttccaggaggaagattgaggtttggatgtttcctgagtctgtcagctttagtgatgaaatgaagagaaaggacaaagaatgccgaaactgctggcaagactacaaggttggtcacctccataagatttagtgcccttaagaccttaactattgatgaaggacacaagacaacggagagtatgaaagactattctgggaaccagggaaactaaggtgtaagatggatgacagagagattgctctttggggactgaatgaaccagataagatatataaatggaatttaattttcatatagtatctatgtaaaattgtaaatgtaacactggaataaatagaaatcatttttaattgtttgagtaattataataaaagttaataaacttttttttcttggaaaaaagtttcacatatccgaaagttataacactaataccagaaaagtagaatattagttaagaaataatttttctctccacaaatattactctatttacattgtaaaatataagtcaataaatttactaacttagcatacatatgactttgtcataagaatctatatagtgatgatatttgtctcctgtttttataatttgacccacctcaattttaagttgtcataattttttttatcttttattgactagtttcttttttatattttgtttcttttatgctttatttgattgaacattttattttatagaatgagatatgttttttgttctttaaaattttagaaattcaattttaatcttttaaaaaaaatatccattttgcattcttttaattttgaaatacatcactatttttctttaaactggtttagatatatagcgctttgaagataaaaaatattttaaaatagaaagacgagacaaattcttttagaaaatctaaaatagaacttttagacaaattataagaaacttatttatgataaataaaattctgcatatccatcactttctactttgttgcgtattgtttccttcagatggccccaagaagatcgaacctgatttgtttttcgatgaaggggattgtccttattgcatgtcatggactattgtccttagtccccatcgttacgaagcaatcctgggcatgacttgagttatatttatgcagcttgtatttattatttctaggttgtgattcccaaaatctttacttatcttgatgaaatcgctctagcttcccctttcttttgatgaaactaaatttttttattatgtttttcacgtagctgtttttcaaccatcaacagttacctttttataaatttgtcaaaaatatttttttattgaatacaacttttaattcgtcatacaaaattccctttgtttctaataaaaaacattttcatattttgaatggatttcaattaaatctctattagagcaaaaatttaaaattataaaatatttagactacaatttttttaaaataatattggagtaacaccaaaaaaatagcataacaaagttataacttttattaattggattatttcaaattagggctctcttagcattcaacttgagcacaatttggatttgaaagcaagaccaacagtaactcctgttttaaaaaaaaaaaaatcccatgacaaacaagaaaatatatttgtctcctttgcgtaaaactcttctatacttggttctaagattcaattgtgtgaattggtttgtctaggttgtgcaacgtgcaattttggtcttttatcagtttttcgttaactatttaatgtttttttttttttgttgaggactgatatagcagatgatatcacatgtgaaaggaaaataatttgtcaaagcactaaagtagagatggagttttacaataaaaatagacatgaagaggggggaaataacataaaaaagcattacgttttcctggtgtagttttgcagacaaaagtattgcctcatattctttaggaattcatctgattttcttattgattttgtacttgaattttaatatctcgtctcgcaaccacgattaactccaaaaaactagcatcaagaaagcatagacatttgttcaaaaaaaaaaaaagaaaaaagaaagaaagcatagacatgaactatgtaagctgtacataacagaataatcaaaggtttattgaaaccaacacatatcatagaattcatggaagcagttacaaaatgctgctaatcgatgtagcagaaagttttattcaaatactaataatattgcaatataagatgactacttagaaagcttctaatcaaatgttatataagataactacttagaaaacttctaatctatgtattatgcgtatgatgaaggtgtttgactagaaatgggaaggatgaagtcgaattgcaagtccttttactggttctagcatgggatcatacttgaacttctcatcaggaataaccaaatcccacttgaaccgtttcacgatattatgcatgaacacaagtatctctagtctagcaaactcttgccccaaacacattcgggggccacctccaaatggaacatatgaaaagggtgtaggccctgccccttcaaaccttgaagaatcaaaagtttcgggattcgagaagagtgttgggtccttgtgtgatgaaccagtgttccaatgcagctgtcaaaaaagatcatatatgacatgatcaactcgagacaaggttctctcctaggatactagcacctcttttacccttttactgtatattatatttgtaaagaagcaatgcttttcagaattttgtcaccaacaatcgttacttacttcagtattttttagcctcaaaagaatgaaggctggtttcggtctagtgtaacataagaaacatcaaatagttcatagaaacaacaactgaaaaagaagaaaaaaaagataacagagacttaaaagattgaaacaacagttaaattaaacatcaactgaatttgttgcttgatttaaaatattgttggtcgatataagaacagaatactaacaatcgaaagtaatatgacaagttttaaaagtatagactgtaatgtaactagtccctttagccttgatgttgttacagtaagatcttaacgatacatgaaaatacaaatttgaagcgtgtgtatgaagttaaaaaggggtagcatttggctatttgaaatcataaacgagatattttcctaagtccaaggtgtgatatgaaaatacttcatgaccatggtgtgattccaatgaatgcagagtgaaaaaagcaagatagtagtaaaaaagcataacaaaagatatgaaacataccttccaccctttagggatgttataatcagcatagttgaaatcctttatagcttctctgtaagcaccactcacaggtggggacagcctcatgacttcagatgcaacattccaagagtatttcattttctgaacatcttcccattgcaacaattgccctgcctctttcccttgactaatttcaagttgttctgtcataaagataacttcaacatttatcctgatctagttttaggtaagagtatattgctgaaaattaaaggcgtgaaaatagttgtcagcaatagcttgctacaacaattttctttatactacaacaaagtaaacaaacatgttcaaggattttattactaaccttccaagacatgttcataaacttgaggcaattgtccaagatattcatgaccaatgataacactgatctagaagtatcgtgaccggcaaaaagtagaagaagaatgttatcaacaatctccatttcagtcataaaccttccactggggtcagatgtaacaatcatatgtgatagaaggtcctgagtaggtgtaccctcttctcctccaaatccactttccttttctttagaatagttttaatttctttccttattacatctgcagctttcattgcccgataaaaccttgttccaggaacgttgaggggaaaaccaatgatccctttcagaaattcatcaaattttaacgaaagctttgatatatggtcagagtcttcaatgcttaaaaataagcaacaagccaattcaaacgtgtatagttgtactattggataacaaacacctgctcctgtccttcaaaattgcaaagtaacaaaagtattaattattaaactattgatcacaagtattctttttctttttcatttctaatttataaccagtgctattaatcaaaacaaaataatatagttaatcaacaatgtttaatcatcagaaaacttgtcaaacaggtggccctcttaattctttaagactattctgagctcagagaacataaatttaatgattttttatttcaggatgaatgtgaaacaaaagtttctagttgtataagaaccttatgtacctgcccgctagtattggatttaacccaaatttcgttgaagattgttattgatagtttgctatactatcgatacatatgtaagatttgtttcacagactgaatatatgtgagatttgagagatatgaaaaagtatgggagatatttgaaatatatgagagatttgaaaatatgcaggagtcctattagatgagagcagttgggaaaaagatatcaatttcccttccagacctgttatgaatggtcttgtacaagcaaaatgctttatacacaaacagtaattatgcaagcaacacaacacaattttaacgtggaaaaccttctccatgtgagaaataaaaatcacgggaccgatctcggtgtccacccaaattcttcactatcaataaagtgagattacaaaatggttccaacaaccattacaatcaacagacaacttcaacaaaagttgtaccaaaccgtcacaagaggcaaacatacaaaataggcttttgtacgaaattaatttctcctaccagaacaacaacaaacaaatcccaacggtcaaactgacatattgcaagagaggaacacactgatcaaatttgaggacaatccaacggttaatgtgagagaaatgtcccttacaataaaactgcccgcttcagaaaacggtttcataaccgcttcggtttgggaatttccggttatactacaagcctttattcacgaaaccaaccgttagatgttaatattggtgagtcacgaacctgtttaaaaaatttcaccaagatccaacggttaaccaaggagatagagaagattgaaggatgacagtttctacccttctccatatgcgaatttggtggtttctttctcctctcttttctctctttggtttcaaattaactgtcaacatttgaaagaagtaactgttgacctattaaataaggaactccaatctttccttattggctggacttgattgcaacaaatttctttgaagattgttattgatagtttgctatactatcatacatatgtaagatttgtttcacagatgaatatatgtgagatttgagagatatgaaaaaggtatgagagatatttgaaatatatgagagatttgaaaaatatgcaggagtcctattagagatttgttttaataggaaattaggcaagttttgtaaggatgggtcatgagaatgaaaataagagtgagggagagattgcattgcaataaattctacaagctagatttgtttggattatagcagttttctgctccacacttgactacccagcgtttaccgtgggcaccataagtggcaaaccagaggtgtgtccttccctgtcctctcaatgctctaatgcccacaccagatatggacctgactcaatttgattcttctcatctatggaagtaggcaagttgggctggagcactataaattgtttatgatttgtttgtgatgcttttacccacccactagtagttatgtaaccatgtgaagcaaggataaaatatttcccaataatgttgaagaggatgtggtattccccaccaagattgaagaagggccacttagagtaagttacctctatctctatcaatcttttgcttgatcattgattcataaatttaatcaacaaggtgttatttaaccatcatttagtattgatctaattggaagtcgttggtagcacaattctcatatgacctacccaacacagtttagctgttatgtaacatttcttaccttcccaatatgtatctatatggcgctgagcaatgctatccatttttggcaaatagtttctgagtgtttctgcattaagaaagctcatgagcaaccttctcaccatctttgcctcatcaccaaccttattaaccagggacaaccttaatagcttccttactgaattaggccaccagacttgaacattcttgttctcattgctaaatagaaacttgttcccaactggcccgcaaaacacaacaacaggatctccaaacattgaagttttgaacaccctggagtcatatttctcctttctctcttgtatgaaccttaacacgttgccctcattcattgtacgcagaaactccaaggtttctccaacaacaggccatcctaatcttccaggaggaagattgaggtttggatgtttcctgagtctgaaaactttagtgatgaaatacagacaaaggacaaagaatgccaaaactgctggcaagactacaaggttggtcccctccataagatttagtgtccttaagaccttaactattgatgaagagcacaagacaccagagagtatgaaagacaactctgggaaccaggaaaactgtggtgtaagatggatgaaagacagaaagagtttgctctttggaataggactgaaccagagaagttcaagttatataacttaaaagcacttgaactgtgaactacaattcagtttatgttcatctggtttttgttttaaagcaaaatagttggtcctccaattacaaaacatgaaagtgacacttcaatattaatgtatctttccctgttgctccaatgaaaattagtccttgatggcatcactataacgaccattaaggactaaattgaatatttacttaacattttgtatcgtacccttttgctccaatgaaaatcaatcaagaggaataaagcttaagaaagtaaacattgtattaccgaagttgtacatatggatacaactagtgaaccgacgaatggaagcactaaaataaatgggaggaaaggcttagtgggatacatgataaaccatggcatcgtcaaagatactaatctctttgttgggacgatatttagccttgtaccataacatttgtgacctgcggcattgccattattagacacttggtcagatgaaagctatgccataagtccataacaaaccttgtggctgttaaatagccacttcagtgtttgtggccttttgagattattttctcgttttgaaatgacaaaatgataatgtttttgtctatcacttcccctctcttctgttccgctgatgaagttctgtcatgtcatgtggaatggttaacttctatctatactgatgataagataatatttttgtgattaaaaagaaaagtaaaaaataaaatcagagagtttttattaaatagtaaatgaaggcttagaaacaagaaattattaggtggttcataccatcacctcatccatgatttcaaccaataatcatgtgacactagataattgattaagattctttaaattaagggatagtacaattaattcttgttaggtaattaatgagtatatctttaatttatttaatatattttttattgtccatatgtcacatgattattaattagaaccatggacgacatgatggtcctgaaccacttaataatttttcgaaactagaatacatcttgagtatattgacgataataacctaacttgtcttgtcatgctagtatttgcaagttacatacgtagaataaatattgcaagatgataattgtcgaaaaaggacacatgacattgctggattggtttctttattttttttgtcataactcttcgatttactagggaaaatggatcccgactattccagtcagtcaataattattttcgccaaaaattgaattcgaatactacttgaaagattcaaccttaactttaccacattaaccacttatgtttaatcacttcattaattgatttctttgtttgataaaaaataaagaaatagaatggatgaaaataaaaagggaaaaaaaaggtgaaatataaagtaaatttgattaaacaaaaataaagaaaagatcgagataaacatgagtatatatatatattagattatgtcttacaaggtacaacaatgataattttaataaatagatgataataatattattttaaatttaacttaagtttgtatacattgaaccctaaaaaagttatgttgtgtgttcaaaattttaaacaaattcataattatgtttttaaatatgttaaattttaaatcttaagtgtacaaacttagagattatgaattatttatatttttaatacggataatgagaatcaactagtgatttatgagtcagtttttaacccgttaatttagaaatctcatcaaatcaaatgattcattcgagtctcataacattgacagtaattatacatggtatgtttataggtgcgtgctataacatgtaaatgagtgcacaacaacgtacccttgagctgaatatcctttaattttacgtggtgacccaagatgaatgccttaatcgcatgaaagtgcataacccacccacacgtacagaaaatgggaaggagattttgtgattcatgataaccccacccacgtgtcccatttattaaaggaaatatccttgtccatactgaacctatggaagcgtaagtgacgaacccaggtcagattgattggtagagtaaagatacgttggctagattgtgttggctctatcctcgtttggctagaattttaattcaatcatccatcatggttgtttaatacgataaatgaagtggatgacaaatgtttcaatccacaaattattttatgatctcgttttttctcgaacgcattgatcgagttacaacatactagtacttacattttagtctctagtgtcacgttcaatctcatctacttctattaattcaaagtccatttaactaataagtcactacataaatgttatttcacgttcccttatgactttatagttgtcaaatatcttataaaaccatcagcgtgaattcaagtctggcataaaaaaactatatataaatattaatgtttgcttttagtcgttcatgatcatttttgcttgtctttattcgagtatctttatattttcaaattgaaatattccatctctttgaagatattgaaattgctctaaatagagctatttttattttaataatcaaattagagtctttggactttttagtaatattctaaaatatttctacaaaattctattgtttagattaattatgcgactaattttcaaaactttgttatgcttaaaacttttaatgatatcttacatgaaaattgaatctaaatctctttcataaaactcagcttatattattaacggagtcatattcatttggtagtgttattatagttttagtatataaatatgagacagacaaatacatgtacaccttaacaagtgaagttttctacaacgtgaatttaatttaattctgaaacaacggattcttatcaataaaatgtttgcccaataaaatcatattcccagaagttatggacctcagcctcatacagttggctctgataagagattagtggaaggactaatggacgaatcaagtggtgacaaagttgatggtttcgttttgaaaacatgtactgttgaacatttgaaacttctgtggttgagattatccaagacaaattgtatcgcatttgtctactcctacatcatcattgtgaggacacatgacgttcacaattggagaagctttagtgaactctctctaatttagaaatatgccatttttagcaacaattctgtgcagactcactattcaaggcctccatcgtttgagttttatttcttgccaaaacactaattttataaccaatgtatttaaaaataattattgtttgagttttataaccaaaacactattcaaggcctcgatcgtttgagttttattttgttaaagtattctagagtgagaggtcatggaaaataaattatttaagagggagtaaattggtatacaagctcctacaagattacttcaaaagaagaaaacctgggaacaagatctaaaaaaatcttataatttgtgtatacatataaatggatttgaagataaccaacgaaagttttcacaagcagccataattttttataacaaaaaaatgctgggcagagatgtttatgagtttctttgggtatgcataattaagcatgattcaattaacacaagcgggaatcaattgttctgcctctcactatatataaagcgtgcaaatggaattatttaaaatttcaggaaatttaaaatttagaaaattaaaatgcatcaattaaaattttttattttcaaattctgtgtttggataaaaattaaatttcttcatttcaaaattttgtttgcataaagaaattgatttttttcgttttaaattttgaatctcattcacgaaaaacacgtaaaatagtgtcatgagagtagagaggtcggagtattcgtccgagatcaagatgaacaaaagtggtgcagttagagctttagagaattcaatttctcacctttagaaggaaattcaaatttcacattttagttgtttaaaattctatttaaaattccaaaaatttaaattctcgtataaaatattaaacaatgaatttatattaaaaatttcaaattccctgataaattactttttccaattaaattctctatccaaacatactgtaagaaaagaagtaaatcattttgaatcgaggattgtgtcaatgattaaaaagatgcaacaacaaaaatccataatattcaagattgcaaacacaatatcatataaggaaattcaaatagaagcaatacatgttaatcggggagctatatatatctatgaatgattagtactattcaatttgtttttgaggtctatagaatatggaacctttgccttgcaattgtttgcatcccatacggcatgcattttggcactctgaatctgctgcaaatttaatcttcatgcatatcttcatgcatttaccgaaacatgtcgttacgggtatcttgccacgttcaacttcgtgacctgttgctgaatctactaccaccaccaccaatggcatgtatagaaccaagataaccgccaaacctaaggatttgtaaaccattgtattgtatttgcggtgtgccaaagaaatgcaaatgtatcgaaatgtatgtaaaatggaaatttccttggaatgttgcgtgtgtgtggtgaaaaatcgatcaattggttgactttgttctaaattgggtttaggaatttgttttccaaaattaaaaattataggaatttggaatcacgagcacggtaaagaagttgtatagtactcaaagaagattaatcatcgccactccaaataataataataatttattattattataagaagataaaccattaacttggtaaaaaaaacaaataatatagaattcaatacaataatttatttaattacatatgagagaatatattgaacgacatacagttgttaaacataaccaccacatagcaatgaaacagttaaataaaaaaactcgtcattctaaaaggttctattttaattaacaattaaaacaatggataaataattaaatttttctaagcagcactcataaattaattcctgaaaaaatgacaaattcaaagttagtattcgaacatataaaaaatacaataaattagttttgcagataatctaataataaagtggtttctaaaattataacttaatatcaaattaatcctcaaaaaatataattatttatcaaattgatcgttaaacattataatctaataaaaaattgtttcacaaatttaacaatagaactaatttatcacattttttcacattcagggactaaatttgtatttttatcttgcagtaaccaatttatcattacatcacactttgagaactaatttcaacatttacccttaaaacattcataatattcttattgattaattatataagtatttaatagcatcaaatttggaatcaaggaaaagaagattataagtgacatttattgggatgaataatagggtgctcatgaattgaattgaatcgattttaaagagaaaaatcattcaatttaaataatttagttttgttaatttatcatttaattagtttaatttaaacttttaattagatctaatttaaagcaatttggattagaacaattttttattttaatcctttttctaattttttcagaaagtactaaataaaatgtgagatatatatttaaaatggcaaatattttatgtaactaataataaagtatttatgtattttaactcaaataattagtaaaaaaatctttaattaaatacattttttataaatagatataaattatataataattttataaatttatgagatataaaaataagtgatattataaatttacgaataaaaacatataaattttaattaattgcggtgaacgtggatgaaacacgtgaccttcagatcttcagtctcaaactatcccaactgagctatacccacttttaaaatattatttggttaagagttaatataactataataattcataaatcatcttacaaccataaagattatccaaaaatataaaaaaataacataaacaaaaacgtaagttgcgagattcatttcgtccacgggagaagtaagtggagttatccaccctttcatttctctctttacaatatattgacccttttttagttttagttacttatatataataatagtataaacagtaaaacttaaatgggtacgcctttaaaatttgaaaaagtcttgctttgacatattaaaacaaactattatgtataatcatttttttataataattatattaaaatttatacctgtgttgattttttattagtgtatagtggtcaatttcaaaataaaaaattgttacgtaagtattagagtgttcataaaacattcaaattaacacattgttagtttgagtataactgaatttaatttttttaaatgagattttaagtttaagtcttatgaactaaataaaaaattgatttaaagaaggatgttgctaaggatggttactcaagttttctgataaaaattagttatcaattttaatttgaattgacttggatgaaatttaaatgttaaattaaacaaattagataatgaattaaagaaaattgatatgactatataattggtttattttcttagaaaaattgattctatctatttcagagacttccctatcggtaaatcctatccataacaagagaattggagtgaaaagagaaaataataattatgacaagtgatgcgatgaaaattgaagagataaaaaaaaatgaatttgggtagaatgagatggaagaaaaatatgttgatttacgctattaaaatatacatgcaagtaaaagatttaaattaataatttttatagttattaaaaaattcaaatatacatactcatacattttgtttatctcatgttatattaaagaggttttttattttatttttgttacaatatttgataattatttatgactatttttacatttagacaaatcataccaaacaaataacataaattaaatagtacacttcaattttattatgtataaatcatgttgtaattgtgtatatttcattattaataaatattacacaaatgttcatttccattaaataaagacaacaacattcaatataaaattgtgacattagatggacactaaaaaaaattcaagtaaaatttgttactttttgtaattgtttatatctattttctcacatggacaaatcacaagttaaatattatgcttgatatattaattttgttataattttacatatttcaaatgcattctaagtaaatattgttcaatagttcattttcattaaataaaaacaacctcatttgtgataaaattgtgtcattaattgatattaaaaaaaagtgaaatttttcactctttaacaattgtttatatttattttcacacttaggttaatcattttaagtgaataacacaggtaaaataaacagttcgattttattatgaatgtttatgcacttaaatattatatttaatgtattaattctattatgattttgcatatttcaaatatgtttttagtaaatattatccaattttattaaataaataaatatatttaaaataaaattattacattagttaaataaataaaaagtataagttgttatattatttgacagacgtctatatttattttacagtttaatgaaaaataaaattcaaataaaaaggcacaaatcatatgattaaaaaatctatttattgaattgtttgagagataattataatcacttcatcaaaactaaatcatcaatcatcaattgttttccaacccctagagatgttgaagccaggccatcctcaatgtcatcctttgaccgcagaacctacaaatcacaaatatcatcagagaacaggattgtatagtctttatagataattttaactcttatattatagatagttttattttcgtgtaattatgaataaatatagtcaacaattctcttcttttaccgattctgaaataaattttatcaagaaataaactaatcttataactcataacttaacaatcaagattttactctttttattacatctcatacattatttcaaaaaaattgaatgaaatatataattatgttttctttaaaaaaatatatagttattaatcaacaattatatgtacatttttaaccctaacgtgcggccattgagactggtcaagtccatggagaagaaagaaatgcgaagagtaaacccggaggaggagataagaagtgagtaggtaggtcaaattttgcacatgttgagatgatagagagaagggaaagaggaataatcgagaatcgagatggtgttgagagtggcacgtgtctctgctcaagcgtggcagtgccttgcggagcctgagcctctgagcagtgagcagatattggatctgctttgctgtttccctctccatcaactcgctttctctctctactcctttttctgcgctcctcactccaattattcctatttcccttctcactccgactccgactctcaccgcgatcattcttccgatttcgattactattaccaatcctattcagactgaaaccaaaccatattaggtactattgcccattcaaatttctccaacaatgcttttattcaaattccatccttattgttaaattatgttgaaactcttttctaagcctgatcttcttgtcatttatgatttatgctgtaagaggaatcattttactagagaggaaggaacatctacatatttatgacttttatttttgctggagtgagttacaaatgtttctattaataattacggaaacgaattgctcattgtcttgagagtatcattcctcatctcagaataagggaataccaaacataataagaggagtgagactttcattcatttttccattactattcccatcaagcaaagccattccaatgaaccaaaagttagctaattggttcgtacagaaattcacagaatgccatttccacactagtgttgtcatcacaagagttgctatggttcgaaatgttatccaataacctgcattatgtattcaccttgattcattactcaatagatctaagttcttgtgactactcctgcagttaaacaaattttgacaagttgccagaaattttgagtttatatattaggaaatcctgcttaaatttcttcaatgaaatgttgtgttcttttgggaatttagattataagaaggattttttgctttgtatttgtccaaattctgggataatttgctgcgagttattgtcgttagactctttattatgtctctgctgactatgctttatgcccttttgacaggaatttgcctgctgaagtgatgtattgatagactttgggtggtaagaacgagatcctcaattgcagtctctggtttctcagtcagttccttatctgaggatgaaagcttttttcttttttttttcgaggactttagtagtgttcaagctgcctccattgtataaaagcatcttttatacttagattttgtggttgattgattgatctcttcacattttatacccttgtaaagagtgatttgtgagtggtaatatataattttaaactgcccttgaaagggagttttgtgatataagttacttcaaaactgaactttgtatagtatatagtatataccttcaatcatcacatatttctgaaatttttttttatacttttttctttcctttaacatgaggtcgttggagctcatttgctcatgaaggtaaataatcaatggtagcagtaccagaattcaaaactaggatgtgcagtattcctctcaagtgtttttggtccgaagaaagatgactattattctcaagattttgaatggaaggaaaaatgagagggcaagattttcttcctttcatttttgtctcctctccaatattagtatcaggataatctggaggatgttgacaaaattattctcaagattttagtaaaaaattatgtcttttaagattttagtaaaaaaattattctcctacttacatacaatattgtggtcatataacgtaagatctccatatataccagatcggggaaatgagatagtaaatgatgtgaattttattaatcacatcaccacttatgagaaattgaacaattttttttagaaagaacaaaacaaaatagatactatattatatagggataaaaaaaacttattaagagtattgaatttgactatgtaaaaagttattgactttgtcttataaataagattagtgtaaataattttttgtctagaccacaagtatttttcgttagagacaatgctatttaagtcaggtgtttaatatggacgtaaaattttctctctaattatttaacacaactgcattcctttcattagataaattaatttatttaatgaaattatttttgatacatatagttatatatctaaatctgaatagttaaaatatatggaatttgtattgattaattataatgataagttatttagatgatatgaaaatattttttttatcggtttgagtcttttagaagatgtaaaattggaaagtggaagatttaggatacaaatatttaattttatgttctgattttttggttgaatattaaatatattataaagattatatcttttggtaaaagtatattataatcatgaaatttccttcaaacaatatatattaatatgacatataatcagttttatttggtaacgtcaaatcatgatgaattggtaagtcataacatcgagaaaactcaaatggttgaaatacatatcttaatataataatgaggacataaattattggctaaattactgtccataatctgcaaattccagggcccaaaaggataaattaatgttgttcttgattgaggctcttactactatttgatttagtcattaatatcattattatttctgattacatttttcctccaatagtgcatgtactcttatagaatatataaattctcatcctttgtccacttttcacttcacaagcaccttctagctagctccatttagattatttgataactaaagtatagtagtatcatttttttttttttatctcaaagatgaaggtcatacttgccgtccttctaaactttgttattacttcatctaacttgtgtactagagtaaggcctgaggcaagtcccagcttcaatgttgttagctacggtgccaagggggatggcaaaagtgatgattcacaggtatatttttcctagtttcatataattgtctttataaatgaggctatatatatatatatatatatatatatatatatatatgatgctacattaaacctatttggcaatacttgtaaaggcttttgtgaaagcatggcaagacgtgtgtggtgcaactcaggagactgcaacacttgacataccgggggaaaaacattcatgttgcaacctgtgttgtttcagggtccttgcaaaccagcaaccattaacattgaggtaaatcatagtaaatgaattacttacagtacatataaatctgtgaatatatgcatatgccttaattcagccatatatatgcttattaaagtttttaattagcacatcttcaatggtgcaattatggtaaaattgcttaattcacttttaatgtgtcttacaatgttaggccttaattgatcagccaatatatatatgcttattaaagtcattaattagcacatcttcagacttcaatggtgcaattatggtaaaattaattgcttatctcatgcactcttagtgtgtcttacaatgttatttaagagctttcaacatccaatggtacaagaacataaaatgaattctacagttattaatttcacagttgtttgtataagaacttttacatcaatgttacttaaattctattggaaacggtttcataatatatatatatatatatatatgtatatgaatatatgatattctttattaattaatcctcatttgaatcgcagcttgaggggactatcattgccccagaaagcgttggcgcttggaaatggccaaatggcgataggaaatggatccaattctcgaacataaatggccttgtaatcaatggaggacaaggaggacaatttgatggccaaggtgatgcatggtggaatgatgtctctaataggcccactgtacgttgaaaattagtaaaatcatgacttaattactcttcttcaaattcttcataccccaaaatcgaatattaatttcattcattcaaatacatatgtgcatgcaggctcttcaattccataactgtggaaatctaagtcttagcgccacgactcacatcaacagcccaagaaatcatataagcttagatatgtgcaatggcgtaatcatttccaatattcgtatcattgcaccaatgcagagtccaaacaccgacgggatagatatctcagcatcatccaacatcttaatacagaattccaccattaaaaccggtgatgactgcattgccattatttccggttcgtccttgatcaacataagtcgtattttttgtggacctggtcatggcataaggtgggtttagttcaagtcaatttccagcttattatcaagtatatataacatgaattaagaaatttagtttaattgattaaatagagtatgtgagtgttatattctttgatatttcctttaatgataaatccaacagatttttttttcaataggggcaaaaaaaattataatttttacaaaatacataatatgataacaaaaaaatctaaaatatcaatatttttacaaattataattattctttaatattttcatattttaaaatttttgtatgattttttattgataatactataaaaaatagaaacataaaatataaaattaacaccaatttatctcttataaatatttacgttcatcttaaaaatatcttatgggggtaacttcaattttttatgagggcaaaataaaatttattatacatagacaaataaaaaaaattattatgcgtgggaataattgcccgaataaactactatatggatccgtggttcagtatcttctgttccttcttataagaaaaaaaaaagcgtatatagcatgacctttaactcgtggttaatttggtgaatcctagtgttgggagcctcggacgtaatggagattatgctagagttgaagaggtacgtgtgagtaattgcaccttcagaggaactgaaaatggagtcagaatcaagacatggacggtaacgatatgattgattaattggctctctatctctctctctagctaattgatactactattaatcacaattaatgcatattatgtgttatgtgttagggaggatccggttatgctaggaatatcacatttgaagatattgtagttgtaggggttaagaaccctctgattattaaccaaaattattttgggcttgaagcagaaagtagtggagaaggaaaagcagtgcaaataagccatgttacttaccgaaatgtgaagggaacttctagtgtgaaggatgcagttgtactgaattgtgatcccactgtagggtgcaccgacattgtattggatgatatttgcataaccactgaagatggcatgaaaacacaaggatcatgcaccaatgcacaagggatgtgctctgactgtgatccaattgtctcatgtctttccaacaaagattaatttgtaataaacttccactagtgtcacgtggagatcatccaaatttcttgtctttcaaactattgaaatggcatactgaattttgttgttttttaaaaatttaaaaggctatattataaattaagttcttcctttcttttgaatatataatattcttttctttagttgttgattttttttattcatttatttttataactactataaaagtaatgaaatatatatatatatatatacacacacctgattccatcttttaagaattagaccaaaggttccttatgtaactggtggcatcctccttgggttgcatggatgtatataacagtatgaaaagattgcgtttgttttcttttgttttttttttttttttggaaatcttatactttgcaaatatttgttgctcacttcgtacatcgcaaggaagtgttattctattgtacacggaaaaataatttcatgaaaaaggtatgattggaaattagtaaaaaatcactcacatggatggtgaaaatagcaattgctgatataagaatagcagcgcattagttgggctacttctgtaagtactaataagtccatttatggatgtgactggactcagtccaaccaatgagtaatatttgttttcattgtaggttttttttttttttttttgttctattttagaagttatgtatcttaatttcattttatgaattcatcttcttacttttttatataatgacaaaataaatattactgtaaaattttgtaattttatatttcactattgagcttattttaagttgagagctagtcaggaaaactaaaagaaaaatattaatcgtcctaggaaatgacatacaacgttattcgataatcaacatttaataatattagggcgatgtagagaaccagtgcatgcttcactaaatctaaactaaaccttattaccttcgagttagacagcaaacagataccactaatggcaatggcatgattttaatttttaaataatctaatgaattctgagtttggtttcattctgaggcaatgcaaggaaaggctacgttggattcaaaactctactaggaaatttgttggacaacttgcctattctttcgttagggtgtccagattatatgttggtcaacattgttttcagtttattctaaattgtatttgtgtcattattatgattggaatgataattttgcagtaaaaagaaaatttaaataatatttattcgttatatttatatagacgacagatatttaaataatactactttgttgctgtggatttcctctattttttaagtctactctcttcttcctaactatgagttgtttatttttttacttatttattaaatatatatttctctttaaaaaattaaatatttttctggcaatcatttttacttttaatgtttatgttcaaattttatccaaattacaaaataccttaataatgtttgatatatctaccagtgttattgaaataattttactttatattgaagtttttttttttgcaatgataacaataaagataaaatctaatatttcatgcatattacttaaacttcttttcactaggctggctcactaaaaaatttaaaaaccaataaatcgaaaataggttattattggttcaacacaaaatgtaccatcaaagataaaataaagtattaaccaaaatgattaaaatctaattgaaatttatataatcgatacccaaaacagaacatggaacatgtatgcctgtattcaatgttcatttcgttctctctctttttcatttatattttgtctttttcaactgtttaaactccttttttttgtttacttttatatatgctcttctctttgtaaattttgtttatttgttatttttcagaatttaaaaatgaattggggcaaaatatggaatttagcaaacgctaccatttttcaaagctccattgaccttgattctaaagcagggataatctttgcctgtgatatgggtgagtgatgcaaacgtttccaagggtttagaaccagatccacactcatatagttttatattcttgattaactttatgttggtgatcaagtcgtctatacaaccatatttcgtcaatttgttcacatgaaaagactgatgaaaattgaaaaatgctaatatatatcagtagcgttttgagtgggtaatcttttaaaaatgaagtgatgaaaacgctaatagtattaacgtttttatacacgtagtgtacattgttaatctctgaaatccacgtgttgtccatttgagatatcacaaattaacaatatcctacgtgaacaacatatggtgcagtttatatttagaaaaaaggaaatagataatttctggaaacactccattgactagcgtattctaccgttaatttccaacgtactttaataatacgtttcaaaaaacaatcctaatctgattaaatgtttgtaaagtgaaactataccttactatgatgaaatgatcaatcaaccaaaaacaaaagaaatggaacatactaaaaataaaggcccaattataatagtaatatcacatcccaatgatgcacctcattttctttgttttagttgctattttcagaaattgggtgcgtatttaattcagaatatctttaatttttagaacttcaaagaaaaacatttcagactttatttttttaattacctacatgcttggagagcttttctttgtttttgctctggagtaagaattttttgcgttggtggagtgtgttgtcccaatgtgtgtggatgtgagctaccacaaaaactcccttaaattacggtccaatatccaaattgattcagagaagaaagtaatcctagccaccgcagaaccttcaaaaagcatttggtatcttctatgccttttcaaattcaatgatacaccattaggggaaaaaagtaacgtttaagtcaatcaatcataaaatttatgagtaaatagtttattgtaaaaaaataatattatcattcaattgttaattgtcatatagaattaatggtagtgtatttggtttgcggtttagacgtccatatgagttttacttctcataaaaatcattttatagttgaattaaaatcttaaacgtaatttctattcaaattgaagttaagtttaagttattcttctattattttttcattaaacgtaaaagtttcaaacataaatcaagttatattaaacttttttttactaaattttacaaagttggatcaatcaaatttgggtttctcaattataatccaaacacatactattttaacttttgtgccttgtaatgcatgttttttcaattagttgcactcaactcaactggcgttgaaaaaactattactctcacattgctttggtttttgtgccataaaatgtgttttttcattgaatatgaatttaaacaattaactaaacacacactaagttattgatcttaatcgaaatgagttggaatgcttaagtaaaatttaaatttgagtatagtaaataaaaaaatatggttgaaaagttcaaatttttttaataattttggttatgaaagcaataataatttatcgcaaaacaaaaaagttcatgactttttaacaagtaattcaaataactcataagaaaaatcctacggcaattcaagacatatatatcttcaattaattagaatgtcactctttcaatcattgaagtaactgtgagcataagatttccctcttatccatgataacccgaacatatatctatcgaagtacacattaaaaaatattacaaaattaccaacttatgatagctaatagcttacttatttaatagtacgatagatatatgtcatataaaattattccattgtgcaaagtactgctttaaataacattaacgcaaatagcatatgaggaataaattgtcaacatccaatgtcaagactcaagaacaagaatattgttttcattctctttcgttatgttttcgatagttcattcatttccaaccaaacctaccatatttgctaataatcaagtgatatcccaccttgttgaaatgctttgctactttctcagatctatctaatctatagtacatataaaagaagacaatgcattttgtagtcatcatatagagctgacccattaagcactatgatcacgattccttataaacttttttttttcgacgggtaaaagtaaaacaatagtttgcaaacttaaaaagatgaaaatatgtagaccccaaagaattgttttgatcaaaatttccagcttgtattccttcccttttttcatatggaacatatatactatattcttctctaatactataagttatttcatcctacctttaagctttctaggaccatttgcaaaagtctctcacttgcccaccattataggatcctaaaagcgcaataattcgataaaaaaaaagtcgattttctatcaaaacctttacggccttgctttagtttttatttatttataacatttgtttttgtggttcacattaatattgggatatttgaacgagacataattcatatgaatctgattttactatggagttgtgcaatggaaatgcgtccttcagaagaagaacacgacactgacacgagaacatgctctgtttgcacattctagatgatgctggaaaatcaacgctgcaaatatagttggctatgcataattttaggtttattcattgaaaggcctatctttatatgtgcaataacaaataaagcagatttatatatagaggaatggtgtaaaggaaaatgatgagagttattttaagatagaaataaaaaagagaaaaaagcttaaagaagaaaaggagaaagatagagaaggaaaaatgagcaatcttttgtgtcatagttgtaagaatcaaatccaaccaagattgcatccttattaagtgtgttttgatggtgtagaagaaaaaataataaagaaataaagaaaaaatatttaaattaaaatagaaagaggtgaagaattcacgctatttttaaaaattattcttaaataataattttctcttttcaaccaaatcattcctaaatgaataattcattcgacagcagcataatttaactgatttgtaaggttaggtcagttttaattgttgctagcaaattagtactttatactaaaacaaattagtactactttttatttttaaaaatagcaaaatactacttttcataataagacattcttatgtttgtttgtttttacatgctaaaattatctatagaaaagataatcttatttaagttgaatatcataattataattagtaaatatctctttttaaatgttgctctaaatattttttaattcttgtaatttagttttttttatttttagttcttgtaatattttttttttaattctcataaattatgtttttttcatcattattacattttagataatatgttttcagtgtttaaagcattacttaaaaagaggactaaaaataaaataatataatttataaaaacaaaaaattacaaaaacaaaaaataaaaaacactaaataacaatgaacaaaaatatatttaaatcttaaatattgattaatgtatttgtatattcaggaatcaagcttaaaattatattgactaaaatagaatcattcatgttaattaatttacacgttagatggcaagaattctatttcagatataatttttccaaaaaaacttttaaacattatttactcttaaataggatgagtttactatgacactttctacgacagcaatgaaaatttgttaccagaagttaaaaaaatgttgcctagaatacaacaccgatttttccacatatataaagtgacaatgtggatgtatcaagagaagatatgaataacacttattgaaatttaaataacagtaagtttaagcaacgagtttataacatagacttccatccaatttaataaataacaagttcaagtttgtttcgccagaggattcaagtttttcttcatgtatttcaacaaacaataaaaataaaaatactaagttgctaacccgtcagagttccaataataagatgttttctgttttttataaatagaaatatctagctgaatatttagtatgttaattttgaatcaataactttttttaaggtaattatgaaagaaatatatttagattaaacaaaagagaaaataaatatatatatatgagtatatctcttatttacaataatattacctttagattaatctttaattgttggactaggatatttatttatttagatctcgttaattattatgcacgtggttgagattttctcaattaaaattctaaattaataaatctttaataaaatattttattagattcatatattaggtcaaatatattattaatatatgaaatatgtatcttacaattcaaacgaatgtaatgaaaaacaatatatatatatatgcattatttatctttaattcattcttatttatagctattgtaattttgtaatattaattgattacatctttacatcatattaataattatgccatggacaattttaagccatatgctatattttaacatatagttaaagtgtctcattttttattttatattaatagaggtagtaaaatgaaagtatgtaaaataaataacatgaaagaaaatttcattatcattaaattaataaattaatattttattcataaatttcatacgatataaaaaaattataataattcacccaattaacaaaaattagaacttgttagttcataaaataaatttgatgtattatgctatttttttatatcagagaatggacgttaaggatatttaaaaataaagttctcaatggtggaaaaaatgttctaaataaaatattaaacacgcataacactaatgtttttatcttcccaggacaatcctgtgtcaggtcaaagaccaacattggattccttttaaagattcgaagatccaaccgttgcgtaattcccatttttggattatttttaaaaatttaccattcaataccgtacagaaatggattcagttctgtgatggtcacgggcgcgcctctgagtgtgatgatgagtcgctgtacacgtgtagggtcagtgatgcactttgggtgaatgtgaatgggtctaatcaccctggacatgacgaaatctctctcacttacccttgctactacttctgcactggattatcatatctcaaattttccatgatcttatgttaaattcactttactttttttggattaaaacttcattgactatgattcattcatatcaatattattacattgttctagaccaaattgatcttaaactcattaaataagatcatgagttcaaatttaataaacgttattataaaaatagtcttcattataattagtaagaaaaattctctaactgttattaatattttttatcctatatcaatgatagcggaagtttcttaattcattaaattagagatctatttcaatctagatacataatttttgttgggccaacactttttgtacacataaaaatcaaacataatctgctaaataaatcatttactaattgtggtggaagtgtgtaaccttacaccactaccgaagctctatgggttttaaaatattagtataatgtataataaaaaaatgagaatgacttaataaaaattagtataagttaaaaaaataattgatatttgattaattaattatgttataacatataatatgtttatgtatagttagatgtcaactataaatatttattaataactaatatataaaaaaattaatgtacaattatagataatatatataatagttaaattatattcataaaaaaattgtagatgtctacaagtctttatatacggttatgactatatataaaaagatatgccataaagtttatgtgggttttatcttgttgtctggttctctctctcgagttctgttctgcttattgtgagaaatgttactgttagtgaataagagaaaaatgtttttgtttacaattaaaatagggaaattttaatgttctctttcattttgaaagagattttttttagaagtgtatataaaagaaataaaaggtaaaaataattatatataatgttaaacgtcatataattaattgattttgaaataatagaattattacttggcatgctaaatattcgaggagatttgttcttttatgtttttcctcttaaaaaaataataaaatataatatttttatcctatcatttatatctccttccttctctcttctttttaaaacaacaaagggattagtccttgtcatttttttttacaaaatagattaataacgttttttttccaaaaaatataaaaagattaaaatttcatatatatatatatattataaacataaaaagagatatattgttgtgtatatatatgcatgagggatatgtgccaaaaaaaaatatataaataaatgatcaaattatatcattattattttgactaactattatatcattcattaatttttaattaatatattttagattaaaagttttctatagatcatatatgtaaatttatgtattaatccaaattatttactattttattatgtagattaaaataatttaatatatttttttaaatatattaaaatataataatttgattattttattgattttttttataaattattatgtttaatttaaataaaatttgaacaaaataatatataaatataattcaataattgaatgaataaaatttatattttatatcaagttataaaataatgtaataattatttaagttatattaatataatttaattttttctctcgtgttgtatagtaatatattagtttttaatactcactcttcaaataatataacactgtattgtttactttttgtgtgtttatttttttctttttcccttctcccaaaattttcctacccaaacatagctaaggcatctattatgtcattgaaatagattttgtcgaaacaagcttaaacaaagctgaggcatttattatgtcaatgaaatggattttgtcaaaacaaactaaagtcaattctcgatgctttaatgccagctaaagctgtagtacacacaggacatcgttagtcagttgataaagagcgatgaattcgcgagtgtttggtatatataacttatttttacaaatttatcgacattgttttaaacaatgattgtttcccaaaacaaattaaaaaaatgtgtttttttcagatcattttttttttttctttttaaatttttagataaaatatgttttttgtttattaaatatttcaaaattcaacttaatcatataaaaaattaatgtttcttcagctttacatttcagttcccaataaagtacatggttttagtttatgataagagactaaaactacaccacattttataaatgtagaagttaaaaacttatgaccttaaaattggaatttttttagggataacaacatatttgatcatatttcctaaacaataaaaatatttaacataacaaattactcaaatgagtaatctatagcatttcgtgtttactaattgaagctatatttactattatacttgtgaaggtgtaccggatttcaaaactgaaagaaaaaaaatgttaaatgaaaatgaacccgagtcatattctattcataaagctagtaagtactcagtactcaccacataggttgttagaaagaaattgtgctaaagttatttgagattatgaaactgatttactttattacaagctttaattttattttaacatattttttaatgaaaaatattaaatttataaacaaagtttcatataaccaggggcaaaattagaagaaaaatgttagggggccaaaaaaattaccataggccaaagactaacgaacttaatgcttagggtcaaggtttgtggggacgaatttttattttaattaactataaatgttggaggctttttgatatttgaagaacgactgtccctgtacccttaccctagttctatccctcaatatacagttttttttttttcatttttttttatggaattggtgtttacttaaatagttaatcaaagtgtagaataagtgtggaaatggatcttttacatttcaaaaattaactacacctaatggtattcttatcctattgttttctttatacttataactttttatgatagctgattttgatgattgtagttatttgtagtttaaattttgggatatacatgttataatatgaagtattaataactttaccagtaactaatttttattaaaaaaattgattgattatttttagtaatttttttttcatctttgattatgggattttaattaaatgatatgaacttagtttcatttgaactcatgacatgtttggtttgaaattttgaataattataaaactgcagttgtctgctacaaaattaagttccttcaatagacagatatttaatatttttttaataagtactttcaaaagttcctttaaagattattattttatttaatattataatttaagcacgcgtcaagcctcgattattaatacagtaaatttatatcaatttaaagttaacaatacagtaaataaataaataaaaactttatttataaacctacattctataggacagtggtctgcggatctagaaactagtgctttcgtttgcatagaatatattatcacctgtttaattgtgatcgacttctaagctgaatgaaaatgtaacaaaaattaattaaaaatatttattatataaaaatatataataattatattttttaattatttaaaatcaaccctaaaaactgatgtgtattcctatcatcgcaactattttcttgagatgttatgtctattgggtgatggagaattgcatacaattccttaaaaaatcgaatacgattcaaaaggaaatcatattttagaattggaataaaggaatcattgtctttagattaacactaagataaataaatgaaacacatggccgtggatgcgacgccaagttacacgtgattgtctcagagaattgtgtaattaatatgtgcatacaatatctgcaaaatatttttccatcggattcccttgtgaatgattaaatataacactttttttttttgctgagaaatggacccacttattcatttatcaaatgatgaattgttgattgacattatcctttttgttagagtggaagaataagagtgggtactaattgcagtaatgagccaaaaatataaaatactaattattattttctttaaaactgagcacagcgagaattaagtgacctaaggtgataaaatactgtgataaattaagtcatttaactcattaatttattttaagttttcaacccaccaatttattggattgaaggtgggacaagacgagttattctattcagcctattaacattaataacatattaaaataactttataattttatataattaaaaaagaatgaattataccctaaaaataatggtaatatcatgaaaatgtataaataacatctattgtcttattttcctcataaaaataattgatttagtatcatcataaattaacataaattcactctctattaatccactcttcactaatgggttaacccacctcgcacttatgataagttgaatgtgagtttttttttttttaggaataaataggcttgtgttattcagaacaaataacagaacagtgtacatcttgcactaaacctcttcaagccaataattatctctgggagttttttatagttgtgaatttaagcttaatttaattaaaattggtttataaactaaaattgttttttatttatatattttatcttgatgttattctataatgattttgatatcattttagaattataaattttatttaactcaattttataaaattattttttaaataaaatttattctaacttatatattctattttgattttcagtgtggttaacgtgggatttgagttttatttcactaggttaatttgttttgccaatcataagataatcggacatgtaaataataaaaatagcaattaaatttttaataagtgattttttttcaatgaatgaatctaataataatggaagagtaacggatagtcacggtcagaacttgggacaaaagttgctcctccttttacgcataaaaaggaaatttccagtccttttgttgctaaagaagggaaaaaaaaaaaaagaaaaaatttcatctcaggttgcctgaaaagtgaaacccgtttaaagcaacaagaagtatactgaaaaaaaactcttcggttaaattttataaattaaaaaatcaattaaaaatttaagttaaatattacattatcttattttttattatcaacattttcattatttttatatattcacgcattttaaaagccttttcctttttatttttatttttgaaatgcataggataaaacggtaaaagcggattgggtctggcacagtgccacggacacaaacactgaaacacgattcacagttcacaaattcgcatcagtatctatgtaaacgacaaaattaacacaaatataatatgataggaatgttagataaatcttattttttaagtatgtgattataaatttaattaaattatgtatataaaaatatttattaaaatagattaattttgaatatattattatctccaagattaattcttaatttttggacaatgatatcattcaaaagaaaaaaaataaattaagtatgattattgcttaaaaataacaagaagagtgttcactgtattcatgaaaattataaagcatattcacactcaatctgtctaattttttttttatttttttttttttttttttttttttttattttttttttttttattattataaaaaattacaaaaaataacatttaaaaaaaaaggaaagaagaaggagatgatgatattgttaatttgaaagtgagaggaaaatgacaagaaagagggagctagaaagtgacggtttttgtttaattatttaatgaatcaattattcaatataatatgatgatggaaagtggaagggcgagagagaaaaaaaaagtttttttttaagaaagagggaataaaacaaaagagggttagcttagtatgactgtttggtgtttagtggctgcccttgctttcataggaagtgagaaactaggctagttagtcccattggattttttttttgtggctgaagaaggtgaaaggggggcaagtttcactcttcaagggttttgaaggtgtcaacttgcgttttgagactctgaggttgttgaggttgaggttcaagctgcattttttttgaagggtggggatgggctctagttgtggttgtggtgtgactcttgttcttgttttctgcttatggggcatgttgatctccctctcttctgctgctaggctcagtgctacaaggcagaagcttgaggttgctaagcatttgaatcgcttgaacaagcctcctgttaagaccattcaggtctctctctctctcgttctttctctctctttacttttaactttatgtttgtatgtgtgttttggggtgttcttcatccacccctattttggtgtttcttcttgttttaatctgtttggcacccaatgaaatggtctagttttgtgaagaaaaaaaaagattactttttttttgttttgcccttgtttgctggatgggagatgctactgaaatggttatgtacctttcaaacattttcacttaaaataatccatcttgcaagctgctgctaccgattttttttttttgtaagtattaggtgatttcttttcttctctttgttttataaaatgtagatcttttatgtggatgtgctgatttctcaagccaactaaaatttccctttaattttttttctcctacttacacccctataaaaaaaatatatagcccatttgatgggaactattgattgaattttgaagcagtaagtcagtaactagaaatactgtaagaaagaagtaggcaatgatttgccttttttgtttatttattttccctttctaatcagctactgggttttgagtaatagaaagatattggtttcaatttggtacatagtatttcaaatgttaacaatattatgatgtgattttgtcaatgttgcagagtccagatggggatacaatagactgtgtgcctgtttcgaagcagccagcatttgaccatcctttcctcaaagatcacaagattcaggtccattttcctcactcaagatctatttttctgttctttgtttttcttcatttttatgtaattttttactaacaccatgctttgatttaatagacaaggcctagtttccaccctgaagggctttttgaagagaacaagttatctgaaaagcctaagcaaaaactcatacccccatcactcagctgtggcatgcgaatggtagatgtcctgaggacacaatacccgtcaggagaaccaaggaagaggatgttctgagagcaagttcagtcaaaaggtatggtaggaagaagcacagagcaatccctaagcctaggtcagctgagcctgatctaattaaccaaagtggtcatcaggtaagaactgttttgagtgccttgtattttattaggttttcttgtttcctcttttaagtagtaaccttggtctaatctcctgatggtgtttttgtggggggttgtaatcatcagcatgcaatagcgtatgttgaaggggacaagtattatggagcaaaagccactataaatgtgtgggaacccaagattctgcagcctaatgagttcagcttgtctcagctttggatattaggaggctcatttggtcaagatcttaacagcattgaagctggctggcaggttctaagaaataagaatcactattcatttataccaagtgtgcaatctaagtactgcccttgactctgaattataatgtaaattgtaatgactgttgtgcatgataacaggttagtccagatttatatggtgataacaatacgcggctattcacctactggacggtaagcttgatgtatttttttatgcatggctttgattttttattttaatgtttgtgttatccaatttattattattattttttttatcaaactcacttgctgcattttgcagagtgatgcatatcaagctactggctgctacaatcttctttgctccggatttattcaagttaacagtgaaatagcaatgggtgcaaccatttccccagtttctgcataccgaaactcccagttcgatatcagtatacttatctggaaggtaaaatcccaggaatttcctggtttttaatctgcaaatggaaaccacccgttaagcatcttggggtctcatctcattaatcttccaactaggtgtttggcatgtggaccatggtaatgtcccccctagtgtttggattcttggacacctctatcatctttcaagcatttgtatgaaacatgatatgtggagatccaagcctatgtttgctaattcatagctaatatgggaatcttgagtttttaccgtgttcacttattaactggccagtaaaagctttttttttacctagtatcaatagcattcttcgtggtagtggcaccctagttagaatcatctttatagcacagatccctggtatctcctcccagtttcttttgatcaggatatggaccccaattttaattgatgatggggacactgttaacaattcagccatcaggaactttgaaaagtcatgaattgcttatactcattctataaatgcacagaacacatgttgtattttcaaccttcataccctttttaatttacacacaatgctcttttctgttggtgagctaaacaatatacttttaagtcattaactttgttactggtactaattagttatcttttttctatttttcctccttgtaggatcctaaagagggacactggtggatgcaatttgggaatgaccatgtattgggatattggccttctttcctgttctcatatttggctgacagtgcttccatgatcgagtggggaggtgaagttgtaaattctgagcctgatggtcagcacacatcaactcaaatgggaagtggtcatttccctgaagagggttttggcaaagcaagctacttcaagaacattcaagtggttgatagctccaataatctcaaggctcccaaaggcattggcaccttcactgagcaatcaaactgctatgatgtccaaacaggcagtaatggggattggggccattacttttactatggaggccctggtaaaaatcctaattgtcaatgagtaatgatgagaggaaagttaaaaaaaaaaaaaaaaaaaaatgcaacctctcttgtatcattgaatgctagtgttaaagcccttccttctcttccatcttgtatacccttttttctgtagtggaaagttttgactttttttcttctaatattgaaagattctccatgtaagctagtggagaagtgtggccaagtttctcaaaagcctaaagaccttttataacatctttgtattttatttgtttgtccactcctcctccctctataagagtgtttgtcaatggcaatggagctggtcttttgtgattaccaaaactagaacttattacttactctcaaaatgagtcactaatgttgttccattaattttaactgattattatatggtacctatggctatggccatgctttgaatgaaaaatgagtcaaataaaaaagtgaaaagtactgtgagaccagtgaaagaaaaaatgaaattgtattattattaaactttggacttaaagatgcttgaaaagggttgcatgtcagtggctgacagtatatttgtttgcatttcaacttttttcgtgaaaagtgggcccacttcttccaccctatattttcaatcgctttctccattctgcaaaccatcgttgtattaccattaaagcttgtgaacaagcggtgctaaaagtcgtaggtccagctcctttatatggatttagttttcttgctcgataacaaaaattataattattaattaagagtcactaatattatgtcttaaactaaaaatagaaattttaaactctgaaggattggtttagcagtaaactgatactagcaagttatgcaatggattatgtggagacactttttaaagcttttagttatgtaagttagttggtgttaaattgatactaggtgggtgttaaattgggtattcctgcctcctattttttttttttttgtaaatgttaaattttattaatctaatcagattattacacttactaacttatataaagtgtaatatttataacttgtaaagaattaattactaagttataacaaaaaattatagaagtatgttatgaaaataattaaatatttttttccatgaaacttagtatttttttttttttgtttgttttacaaaatatttttttatttttcgttcttaaacgttttagataatgttttgaataataaaaaaattttaaacagtaaaaaatgttatgtaaaaaatttaagaacaaaaataaaacaaaatattttgtaatgataaaatgaaaaaaattacaatatgaaaatgaaaaaaaatgctaaattgcatagatgaaaaatatacttaaaccaaaaatataatacaaaaaaagtttaatttctagacaatctttgtcattaattttttacataaaattatttaaaaattgaatatgataaatcatcatgttattttttttgaaatagcaggcaattcacatttgtgtcatcatgtatcatgtataggttaaaatataagtatggtccttaattttttttcttcaattgttccttaactttcaaaagttctaaatggtcgtaacttatttaatgaagactctttagtcattctattccttacttctcattttttattttcaaacatgttttgaatcctttattaatttgattcaaaatgtgaatttgttccattagattcatctgcacgaaaactataaaattaactaatgtttaaaaaaagaatcataaacatagtgaaaatcatatgaaaagtgagtcttgtgaacaataaaaaaagaatatgatattaaatttcttctgtttgatacttatgaaactcacttttcatgcaatctttaccttgtttatgtcccttttggttcgcacatgaattgattctcatagttttcatgttaataaataatgaggcaaactttatgccttgaatcaatcaaaaaaaggttcaaaattgtgtccaaaaattgaaaatggtaaattttaaaaagactaacatgtcattaattaaataagtaaggtgatatttttaaaaatttaaaagtttggaaactaatttagcaaaataaataaattaagggagcatttgtatattttatcctcaagtatattaaacaataggttctcagtgactcattggattttcaggtgagttagctctcttttgaagataccaatctgtctcacactcttacatagacttaatacattggttctctccatcttacggccaaatgaactagtatgcgggcttagtttttaaaaaaattacaatctcaaaataaatatttttttctctttaaaaattaattacactcaattatatatatatatattttttttaaaactctcaataaatctttaataaattctaattataaagttttaacacaaccaataaattttcaacataaatgtaaagaaattttgaattgagtttttaggattaattgggtttgattcaacttggtggctgcaagtttgcagtccaactcgcggatcttatggtccaaattcttaaagttcgtgaattatgaaggacggatctaaaattctgcataaccattaattttttaaaaaaatggtccatgactcatgcataccctgagctccacaaaccgattcatagacttgaacctgtttacccatccgcaatggtaacatgcaagctgtagggcgttggcagtaatgagcatggctgcgacccatatcgttcctggcatatatgcttcgctaatctatagaaacacgttgattggacaatgttctgatttctgaccaaagctagtccccaaatctgcacgagacaatgagttaggttacgacctaatctactactcttcaaataataattgatgtaccatatcaagaatgtacccactactagtattaatttgtgaggtattgtatgacttctttgtaaatattcaataaatttgattatgaaatttattttactccacactgttttataagaatccaaaagaattgtcttaactatttgatcgagcgttgcattgagtcaattacatttaattatgagtcaatccttgcaacatgcaaaattttgatcttaactttttcacttttttcgttgtcattttttaatccgtatacatcaaagacatctactagtgattagttaatcaagtgagatactccccaaataaaattagctactttatctctttaaatcttgtacacttttgaggatttgttgcttatttgatatgttttatagagatttgtttaatagtttaacactttgaattagaacatattatacaaattatattaacttatatatatatatatatatatatatattataacatgttatttccatacccatgtaaccggagcagagcctagcctggcagtgacagtggtaggtttacatgtcggtgatggcaagcacaaaactcattgcaaacccagtgatttgtcagcggctcaatttggtgtatggtttaggcattgtttagtgttattggttaatattctgcacaaattttggaaaggggcactgcaatattttctcaatgtgtcaaacaaatgcaatgaaattgaatacgatcagaatcaacattaaaaaaacgtaggatataatttcaaaaacgaaattgctttccagttctgtgttttttttttttttttcctgttacatatgtgcacacagcatgtattggagtgccattaaaacgtatatagatctatagagtatatacaatcttctatcattttccatattttgatgaatagtatggttctgagatggaacctatgtttggaacttgagaaagagagtggaaagaaaaaaaaattaaattgaaatgaaagaaaaaaaattggattcttatttctataagttaactttctttttctttttaatttttcttaattaaaaaaattatatcattattcatgtttttttctctattttttttcttcttatcaaacatattaatagattttctaatatttctaataattaaatttaacagattttgagcgggaatgaaaggttgaagattggacaaaaagttaacaataataaactttaacattgtgactacaaggattaagagtgttcacgggtatggtcaccgtgaatctgaactaatctgaatcgattcgaacagtttgagttggtcatttatgtatttgagtcaaaatcgaatcgagccgaccaaaatcattcatgtacgagttgggtcatggatttagatttatagatcgtgaatccgtaataaaaatataaattttattatatatatatattaaaatttaaaagctaaaattattttgacaataaaaaaaaagtgtggtactgtaaatgtctaggtcgaatgaagggctacccataatctctcatctcatctcatctttactgtgaaggtgtggtactataaatgtgacatgtttaggtttttttttcttttgcgcttatgtgttctgtctcatctcatctcttctttgcagttctgcaccagctccttctctattatctctcatctcatctccttctctattatctctcatctcatctcatcagattgatcaaacatcaagttttattctacgctttctttttcttttctaagctctttaacttctcgtgatttttctggtttgtattcattgagattttgatggaaacagggatgagaagaaaataaataacttcattgttgaatgttgactcgaatttttggttatagcaaagtttattacaagaaattaatttgtaagaaatagttgtgattcagactattataataaattttgttcaaaaatcttttgttttaatttatattataagtctattttagaacattatgttgattgtattaaatgaatcatttttactattttcatacatttgataatattgtgttaattgtattggatatttgaaaaatcatgatataaaataatagtttaaaggaaaaatttaaatgcataacccgttgacccgaaccgttcatgaatgggttggattgaatttaaaaaaaatcctgaaaatcgaatagatcaaatttaattagattagatcttaaatttaactaaaactaatctgaactaatccgcagacaccctatgaatgtttagcctaatctttgtgacaagggaatattctagccgaacacgagaaatttaggtaatgtttacgtaaagattttaatattcaactcagtgcatacattacatgatacaagagataaaagttagacaacacctccattcctatggaatctatttatattatttctccttcgcctattgtggcatttcctcatcaataatggtgtgacaattgcctcactaagcaaatagtacaaagatttattaattggatttggatcatgataaattatttacattatattgtaattcgtccatgatccaaaaggttcttaatgaggtgcataggaggtttgattatcaatcctagtttattgggtcaactaaaaaaaaacaattatcatttgtcaataattaaaacaatcctaaatttattggatcaactcattggctcattttttgtatgtgatgtgtccacctcttcaaatagggatcaagaacaattatccccaaatcaatgggcttggttataatcgttcttctaataagtttaaggttttttcttagatttcatcttattttagataagatagactcttctgttttttcgactctagacttctaaaagtttttttgtttttttgtttgttttaggatttgacagtgtgaatgtgcatttgttttgatggttgctttctcttaacgtttttggtttttgtccaggtttcttctttttatattgcctatctttctttctatcattcttgttttcaattttttttagttgagctgggttttgatcatccttttcattttgctagcttttactctgcttctatgtttggttaataaaagaaagtgaaaggaaataaaatgagaagagaagagagtgaaaaaaaaagatatttacccattcaacatctttagttataacttaaatttagattttttttcaaatcaaactatcattaattaaaaataacaatctattaaaacataaattattcatcataaatctagaatataatttacgtgttaaaatatttatttactataaaattaattataatgtaatttatatatttagaaatatttatttattataaattaaaaaattcatttcataaattaaatatttattatgttattctgtgctctggttgcttataaacaacatgtggtgagacccatgaacctagctatatctcagctcattgttcaaatttcatttctacttgcatattttggatcaaaagtactacaaccatatttcactaacttagtctcaacttcaaggctacctccttgtggtttaaagtttccttgaactcacgtttcttatttacaatacgacatcattgtattgactaggacttttccatgctctttttgggtaaatttaatgattttaaacgtttttgtatttaattgtgtatatgattaaaattaaaactattttgaataacttctcatcaaatcattaattttactttaaatgtattttttttttctgattgatggtaaacaaaccaaagtaaatcagtaagtaagaacccaaaatgactcgagaaaaaaaaatatatcgacaaaaagtataaaaaaaagtcataaaaaatgtaaaaacaaaatgatcataataaaataaaacttattttcgaatttcgacagcaatgtaaagcagcatagtactccattattagaaccttgtaaagcaccaactatagagactcttcatcagtaaacatcaaaatgagtttctaataaatttccgacaggactcgtattgagaatcaatagtagtatttttcttctttttttttttttttgctgaatagaagtcaattagttgttgtaaaaaggaaaagaaaaacgaaaagagaaaaaaaaaaaccatgaagtagatgtacaaaatgctacacattaacaagtaaaaaaactgtacaaaaagcaaaaatcttagaaagaatgtaatgaaataaagcaatcataaagagggaaactcaccttcaatgtatattaactaaaaggattccaaattaataatgaaaaacttcatattgaaatagcacaactaatcaatatgagataaagaacattagataataataaaaaataaaaaatatgactgatctgtttagggaaagtggaagcctggagaatataaaacattagctagagatataatctaaaaaagaagaaaaaaatgcgattatataaagctgtagtaggatatgaattaatgacagagaaagagaaagaagacaagaatgttttacaataatgttttggaacagtggaatacaataaaatgaaagtaaaagaaaaataaaaatcataagtataaaggaaggttaaacattttgtagaaaatcaaatgcacgagaagagaacatgtgctatttcttaacaaagcataaactatatttgatagaagttttttttgcggaagatattttatagaagttatggatagttaaataaatctgtggtttaaataaaattgaatgtttgatcagataatatttctttggcagcggattagataatattgaaagcttaatactccatttattatttttgaaggagaaagcttaatactcctaacaaataacaatagatttttttttttttttttttataaatcgacgttgacaaattctagtcaaatcataatttttttttgaggatctagtcaaatcataatcaataccagtgtatttaaagaaataattaattatagcatccttaaaaataaaacctaggacaggagcatctttaaataaacaaaaaaaaattcttcgattaatatctataataatagaatgataaagaaataggaatctgggagtctcaatgattaagaagagttggatttaaaaaatcaacgagttagaaaaaaaaaaaaaaagcatatgaattaagaattactgttgacggccaccctcttgatttcgtgggcaaacatttgtttttcctttttaattttcatcttctatctcagtgtttgtttgtttgtttaattttttgatttttaaatgttccaagagaccaagacacaatcacgggaagtaaatgaatgcatagccaccaagaatgtaaagaatttcatttaaaatgtcaaattccaaacttttaatcaagtcactattatattattgactttctcagccaatatcttagcttattttttaaggaagcaacaacgtttaaaaaatattaaaacttttattataataataacacaagaattatttagcaaggagtacctttttttatgttaatgatattcaatattttaatcaatatttttagaagaattaactaaaatacattaaaagcataaaaagaaagtaccattatagtaaatttgttattctataataataaatatcttaaatattatacttaggatgatttttgataagatataatgcaatttttttatattaacagtatatgaagattaacattttctttaaatattcgctaaaaattcttattttatttaatataagttgacaatatatttcttaatccattatttctaacatatttttattattaataaataaaatttaagtacattatttaaatgtcatgctcttattttccatataatgaattttatctattttaaaaaaaaatataaatgccgaaaaagagttgaaaagtgagtcgctgctggtccagaaaaaactgttaaaataaataaaaagtctcaaaccggtaatataaaaacgttaaagcaattctttctgcacattatttgtctttactttctctctcatacgtagaggagagagaaaaagagagaatttaattttatgtttacttgatatagttgacagaggctgagccaagagaagaagaagggtgggtgtagtagggtttcaatcttcattcttcactaatccttttatacaatccgagtgtgtgtaagaaagagagacccgaacaaattcacaaacccttcttctctctttttttcttctttcaatttcaattttcttgttactattactaaccctagcttccttgaacactcactttgaaaccctagctgcttcagccatggctcatttcagctgaattcgccactatgttgctgccatttcaattcacaacagcgaggtaagttcaaaacccgttcgttccgtttcggcattctcatgcaccgtcgcaattaacgctgttttgtttttctttggctgtaatcaggtgcatgcgcgttgtttgagtggaggagggacaggcatggaccgtgcgcttctcctcgcgtgcgtgatttgcgggatcctcttctcggtgttgggcttggcgtcgttcttcatcctttgggctgtgaattggaggccctggcgaatttataggtatctcgtcaagattctgtgtttctgtttacctgtttttcacttggtgctttgggtttgtttgtagttttaagattaaattgccatgctgcaatgttaatgctgttgattttttgtggcgcatatggattctgttgctaaaaattagtagttgttttaaagtattttataatttgatatttactggcattggctgctgtgtactgtcgctgaattgcataactaattagctacatttgtttaacaacttgggaattaagtgtgaaccattcgggtgctttttctgtttttatgatggtctgctaagtatggtggttttgtgccgtttttgaactgtgtgagccggtaacttgggaattctgtacacgaggttgatgcttcctagtcctgagtgctttgctttcttttactttgcactccttttttaagtaatttggtcggaattcacatgatgatgcatttcagtaacgccttaagggctagtgtttttagtgaatgtatcacacataggatggtgccaaatgtaagatgagaagtctaacatttaaacattcaatgtgatgtacttatggacattgtaggaaataaccttttttttttatctattaatcaatgtgtttgttttaaacttaaaaaaagaaactttataataagtgcttttttaagaagcagataggatttgcctcttaaaaaaagcagaaaactgcttattttaagtacaagcagtttatacaattacatcagaaaaacagaaatctacttattttaattgaatttcctttgtttccttaaacctaaaccctaaacctaacctaaccctaaacctaaacctaaacctaacctaaacctaaaccctaaaccctagaaaaaaggacgatttggatagagttgtggaaattctcatgaaacttgtagtcatatatattaggtttacaatttagtatatctgttggaatcttaattaacagtggtctgaatttgaagaaatgattacctggtttaatgaatataaatataaaaaaattgagattacacatctgtatggttcatatatgtgatttgtattaattgagttgctaatcaaggagataatagattcataatcttcagtaggcctttgattatttcattgagttgctcctatgataaaactgtatcaccaattgcatttagatcgtcaattagggattggattcaaaggtgatactaaaaaatagttcaatcttaaagcattgtgcttggaagttctgtgtgaagtttctgacctccacattcttgtgaaattgaaaggagtgaattttatcccataattgcccagagctttttcatctgattactcaagcaatcatattgtcagaaatagacgattgtaaccaagagagaagcaactggtcttgttactctgatgtgatatagatttcagaaatgtgatttgccccacattcttcatgtgtgcggaattatgatggaattactgtattggcgagaaagtggtgaagatgacagccttggattattggttcaacttgctggcactgaagtagataatttttcaaatcattttctaggaaacagagtgacaaaatataactgcggatgatgccagagaagatcccatggaggagagaggtgttgatggaggatgcaatctcagtggcaagcatgaattggttgttcagaggccatcttgggttcgagcaaagctctcgaagtcatgataaagttgtgaggaagagaaaatgaacactgaaccataaatttataattctgtaaaatgaaaggctatacatagcaccctgggctggcttcagctcatcaagatatcctataggaatgggtacaatcatattacagagagtgagagagttacattactctaatatagatacacctttaaagaagaaacctttgaagctaataagaaaaggatgtctcataaaagttgagttggaattatgttctagcagatagcaccagatttcttttgtgtgtatattatttgttctattattaaaaagaatttcttagctctttagtgttattatactattattattggatagaaagaaagaaatatgaatttattattgtcttgcaggacaaggctagaataggtaaacagagcaaaaataaaagtaaaaattgacatctaggatttttcctactttgtttcacatgagtctctaatctctatatacatgttctgaaaattgggtaatttcacttcttgtgttgatgtggtctgttgtgattaattttaaaatatttgatgaatccacagtgatagaaactgcattcttgaacataacacataatgttgctctgggcctcttgactgtatttcaggaacaaataagttcaagttttgctacataactttctatgttatctcatatgttttgagaagaaatacaagttgtttttatgctgctttgtcatgctgataaaaaatgctgctttgtcatgctgataaaaaatgctgctttgtcatgcatttaaagtactctgaattttggaacattgttttgggcttcttgcatctatttttatttatttgtttctatttcagttggatctttgctcggaaatggccaaatatcttgcaaggtcctcaactccatttgctctgtggtttcctgaatctttctgcatggatagttgttatttctccaattctggtgcttatcatttggggctcttggttgattgtaatattgggtcgagacctgattggtttggctgtaataatggctggcactgctcttctattggcattttattcaattatgctgtggtggagaactcagtggcaaagctcaagtatgtattttccggcctattttttatttaacaaaacatattttgtgtcgtgttcacagttattaagcttatatattctattaatctattcaatatgaaacccaaatttctaaatactgtatcttaggtagagactgtttctggtattattactgttgtggattgttttctgtcgatgatcttccatcatttgagcaattgacagcctttggatgtgatgattatgtcttctgtttcatgaaaaagtgaacagaagagagaagaactgtaactgctgtcatgtatgactcttccattgttaaaattatgatattctcattataaaaatggaacaaattgcgcaggctttactggattcagtgcaaacctggttcccaaaaaaaatggtcaaaaaggttgctggacatgttggttagtggtcataaagttgccaaaaaattgagaacaactgggaactacagcagggtgaaagtattggatgccaaacaaagaagttcctcagttgagaaattgactaaaaataataacttgatcatgtttataggagatggtattgccttggttagtgaaaagaagtaaaatagaacaagattgattgaataatatataagattagattgatatggcgtgttttacttctaacacaaaaatggcgctaatattgtaaaacttactaacaacactcatagcaaatcagaaggtaaacagttggattatcaataggtctaggtctagcattcaacatgcatgtttcctttatatgtctaaggcgtactggcagtggcggatctaggaccttggaccagtggggcaatttatttaaaaataaaaattgataattgtcattattatatggaatagttggattcaaatacgaagataagagaaacaaaatatgaagttttaagataaatatttgcattttattaaaaagagggtgcatttatttactcttacatgtaaactggtaaggagattcaaatacataaaattaagggttcaaatataaaattatgggtgcaaaatatgatatttttttgcattttattaaaataagatgtgtatttacttatttttacatgtgaacaggtaaggagtttcaaatacataaaattagagggtacaaaatataaaattatgggtgtaaaatataatattttaggacaaatactagttattttattgaaatgaggggtgcatctgccacctcaaatacatgtaggtccgccggtgcgtactggttgatgaatagtaatgttgaccttagattgagcaacatcaattctttagaagtaccagagttttccctaattttggtccaaaattgataaattataattatattttctaataaaatgaatgctatggtgatcgtcatctgtaataacaatttcattagcatatacaaccaaatatattgtaaccgagaagtacaacgacttcaacataaagatctgcttctttataaggcagaacagcctgttgcataacaacgctatcaagcttaaggaggctgtttgaggccataaaggcatctttgtaatcaacacactggttgtaaagattccccctctgcaacaaagcccggcagttgctctgtatgttgttccttcaattgtccttgttgaaaggctctgtatgtgtgtacaaattgttgacggttgtgtgcacatattggatccaaattttgctatgttgttaaaagagaaaagtttaaaattagatctaaatgtcctggcatttttgcttcttagtacaaacagaaataccgaattgacttcgaagcagagctaaattttttaaaaatggaatttttgttccttttttgttaagaattacttggttcaatgagaatatcattgataaaattgtaacaaaatattgaaatctctaggttgaaacaatatgatatagaccccatatgtagtatgctctagatatgactttgaaattactattgtgtcccaatcatttgtgaatgagattgggagaaaacaagcatcaggtgaggttaaaagttgataggagccatgtgaatcatgctttctgctgattatccttttcttactgtggttttgcggaagaaatgctcttttgtttatgctcctgctttggagaatgatctggagctagcaatttaataaaatcaaatagtgaaggccgtacagctgaaagctcaaataatttgacatatgttcctcaactgtgagctagtctcatgggattgtgcttgagagttattactctgtccagaatgcctagggcatttagagtttttgccgtctaagctgatatcatattacatttcttcttgtccaacctatgtaaggcgtttgttcctatttctatgttttccaacagcagtgaaataagttgcttgtaaataggtattttgttatgagtacaacaaacaacaggaaatgttctttgattaggtcttcagtcaaagctattgacggaaaattttgtccttgtcagctgcacatctttttttcttttgttctctatgctgcttttcttccaatgcctaagtttagtatgaataggcgaatgatgtggccaagaagcagtgttgtacaaatattagacatgaaaagtattttacctggttttataaagatatagtatgtttgggcatcttatatgattgatttagtttcgttttcatgttgggcgatgttatagttgtaatacccaatatcttcatttttcttttgacaggggctgttgcaatcctgcttcttttggctgttgctcttctttgtgcatatgaactttgtgcagtatatgttacaactgggtcacgagcatctgaccgctattgtccttctggtttcttttttggagtctctgcaattgctttagcaatcaacatgctatttatttgcagaatggtgtttaatggtatgcttttgaatcacttagttcatttacaaattgctattcctgattattattaaaaggttaagatatttttttggttgttgtacaagataatcattttcaacgtagtccttatgtgacgaaacttttcaattagctcctaatccttttcaatgttgtctgtactgtttattgtcataatattgtgatattgaagttgagttaccctaaaatatatggatcaaatttaataatgactgtgatgtagtgacaaaaatatagtattttagtccctacatacacaacactcatctttagtttggtacacttcattgtgttataactccagtagatagtagtattataatagtagtagatgacattcctttttgatgtacatggtgtcccttcgtacgtatactgcttttggcttgattctatttgtttttttgtttttcgttatttgcatatcttattaccattattcattgtagggaatggcttggatgtggatgaatacgtgcgaagggcatacaaatttgcttattctgattgtattgaagtaggtccagtggcatgtttacctgaacctccagaccctaatgaattgtatcctcggcaatctagaaggtatgttctaatgcttgttctcattgttgactatcctattggagacaaataattttaaggtatttttatagcattcattactagcttagacagacatttattttgctattgcttctcaaatatttatttggattagacatatagtactatttcattaagctttcttcctccaagttcttattgtttttgtttgtctttgtagggcttcccatcttgtactgctctatcttggctcactatgtgttctgttagtatactccatcttgtatggtctaacagcaaaggaggagaattggcttggagcaattacatcagttgctgttattattcttggtaatttaattagctcttggtatttattatattatttttttaatgttaacagaaaattcttgtgcacttttcgtctctggttatttgatttgctctttttctgtgcacttcttgttttgtagactggaatttgggcgcttgcctgtatggttttcaacttcttgatagtcgtgttgcagcactgtttattgctggaacatctcgtgtgtttcttatctgttttggagtgcaatactggttagtttcttaaatgaaaaaagacctttttctcagcgccactgcatgtattattggtttgttctttgttgacttttctctactttcaccactcacaggtatttaggccactgtatcagctatgctgttatggcatctgtactgctaggagcggctgtttctcgccatttatcagccacaaacccattggctgctaggagggatgccttacaaagcactgtagttcgtctgagagaaggattccgtagaaaggagcacaacagttcatctagcttttctgaaggctgtggctcaagtatgaaacgaagtagtagtgttgaagccggtaatcttggtaatgtattgaagctggcagggctatgctgcaggtgatgggagcaattggaataatgtcctgtctcaaactactagtttgccagatggaatcattagtgataaaagcatagatagtggaaggtcaagtttagcattacatagcagctcctgtcgctcagctgttcatgagccagaagttggaacatcatctgatgatagaaatttggatcacaataattctttggtggtttgttctagtagtggtcttgatagtcaagggaatgagtctagtgcatcaaactctgcaaatcaacaaacactggatttgaatttggctcttgcattccaggaaaggttgaatgaccctaggattgcaactattctgaaaagaaggacaagacaaggtgatcgagaattgagcagtttattacaggataaaggattggatccaaattttgcaatgatgttaaaagaaaaagtttagaattagatccaactatactggcattgttgcaaaggagtagcatggatgcagatagagatcataatgaaaatactgataacaccagtgttgacaatgccatgcctaatcaaatttcattatctgaagaattgaggctacaggggcttgaaaagtggcttcagttgtgcagacttgtattgcatcacattacgggtactccagaacgagcatgggttctgtttagttttattttcatacttgaaaccatcattgttgccatatttcgtccaaaaacgatcaaaattattaatgcaacacaccagcaggtgagtgctgagtccctccctatatatttctgtttgttttgggggactgaaagatacacacacacacacctatctctagaagcttgttatccgtatttcatttgtttgatcttggggttgtaactgtttaaaccttacaatgctcattttgatatttttgaacctttattgcttgtagtttgagtttggtttggcagtgctcctgttatctcctgtgatatgttcaattatggctttccttcgatcacttacgacagaagaaatgtccatgacatcaaaaccaaggaaggtactagattggctgttttttgattaaaatgcaaagttcatctactgaaatggatgaatttaatttttaactgtttatcttgttgagctgactaatgtttggctacttgactacttgttgtaaatttgtaatataggaagtgcttctgttgccgtataatgtttttggttttgatgcggcagttttagtcttttaaggtttatacattcttatagtgcacatatattagttttagatgagagggctaactttactggtgctatcatgataccattctcttgcccatataagctcttggggtgggattattgggaaactctttggaaaagtgggattgtcctagtttgttgaactgggtttgcctgtctgtgatgggctgagctgggcagcctgtgatccaaacatgcaatttgaaaacctgaaatccctaaatccccattgtctcagcctctttgaatcacttgacctccctcttctctcagaattaaccccctctctcttggatgtggccccgaaccactataactctactctcaaatcactttggtatggcgagtgttgaagctttatttatttatttgtttgtttgtttgtttttgtttcttaaacccataatttgagcttatgctgggtctataaaaggtctcatgattctttgacttctcattacttttctgtgttccttctttcctttccataattgctgtaaaatatcaaatagacattgaattattaaataatataactattaaacaaatatataaattcttccttgaaatttgctggtgggattgtacatcttatgtcacacaatttatgagcatcccaatttattttagctaataatagaagatatgtattaatataacatgatataattaacagatgattatgtttttaaaacatgtgattagatatccaatcttatacaacacatttattaagagatatcagtttttaataaatttcaatacttcagggaaataatatctatttcgcagtgaaagaccatgttttcccctcattcctaagtaggatctcgattttgacaaccttgcatcttgatttccacttggacttaagttacaatgttgttttcttagcctgtcagaggtgtgcagtcatgtagctcatgaaaattaatggttccttgaagttcattcccccaatttatccgaacaacttgctatcgtctgttaaatcgggattgtatatcttaatggaaattgtagaatcaaacaatcctactagtaaaattgtgattttgaccaggggtggagctagcatttttatgtaaggggggccaatataaaaaaaaatcatgacttataaaagaatatttaaaatttttcatgcatgatatttatagaacttttaagatataactaaatgtattttaggagcaaaataaataaataaataattgtgttaagcatgagagagatactaattaccaagtgcgattaacatacaagggccaaagaccagtatcaaaagaagaagaaactaaaaaaatcaattaaattaagtgaaaataatttttcatagtcaaagcatattattaaaaaaaaataaattcaaaagtaaataattgtgtcacatgaaaaatacgtagaaaatacttggataaatgaatcacacttgataaatacttacataagttaactaagtataaatgtatcattaacaaaaatagaaactataaattagaaatgaagagaatttgactttttaggtaaagtgttttaataaaaaaatattgaagagaacttagaaaagtaaaataattttatatgatgagagttttttttagcagcaaagaaagattatattatagttataattatattataaataaatggattggaatttgtcacaagatgtgggcaaatcaccaaccacagaaaattacaccaagaaattacacaaacacgactcataaatataacatagcagcactgagaatccaacgactaacaatacataaaactcagtaaaaacacccaggctcattgaacccattacaaaacaaaaccgtaacatactaataccggctaaaccaaactaaaagaaagtatgacaaattccctgtatattgtgtccaataagaaatagccgattaaactgctgctattaacctcccctataacgtgttacgacatcccctaatattttttccatatacaacatctcctaatattatgagagtttgaaaatcttgggtgggccatggcccctgtaggcccctgtgcctccgcctctgattttgtcatccttccttggaggggtagctacagcctatgggtactgattgccttgggaggtttttaactcactgattgtaatgttaactagaattagggatttcatttagccatgtgttttctttttaatttattcaatttattatgtttggcctggctatgtatgtctgttgttgcttattcttttaagagactcttgttttagtgcatgcatacaataacatgaataactaataacatattctctctttctctctctctaattcaccgtcttcagtatggttttattgcttggctactcagcacttgtgttggattgttgctctcctttttaaggtaagccctactattcctgaaagttgttcatacttttaaattttgacctcatttcaattgaatgtgaataccttttttgtatcagcataactgcctatgcctttgtttgcattttattaattattcatcatataatttatgcagcaaatcatctgttctcctcggtatatccttgactgtgccactaatggtggcatgcctttctgttgccattcccatatggatttgtaatggttaccgattttgggttccccgcatgaattgtactggaagtgctggaaatgatcgaattcctcgaacaaaggaggttagttcttatgcctttcctacttactatcagggtgtctataatttgatgttttctgatgtctcttagctttatctcctgatatgtgatttctcgtagtcttagctttatctcccgatagatcactttgtttttcattctaggatatgacatattaattattttaattcatgaattcattgcatagggtgtgttatgcatttgttactttttgctctgtcaagttaaatttcttgtcaatgcataagcttgtcttgttcccttttacagggtattattcttcttatcagtatgtcagtatttgttgggtctgtactggctttgggagcaatagtttctgcgaagcctttagacgatttaagatacaagggatggaatggtgatccaaaaatcttgggttccccttacacatcatctgtttttcttggctgggcaatggcatctgcaattggtttagttgttacgagcgtgcttccaataatttcatggtttgcgacatatcggttttccctttcctctgctatatttattggactttttgcaggtattttctcattttgtatttacaaatacctacccccccccccaaaaaaaattgtttttgttgttgctgatatctaattatctatgtttctgaaactattgctgcagttattcttgtggcattttgtggggtgtcttatttagaagttatcaaaaccagggatgaccaagttccaacaaacggtgatttcttagctgctttacttcctttagtctgcattccagcagtgctgtcgctttgctgtggattgctcaagtggtaggtgacactttcttgtatttgtcgatttatctatggtaaattgacaaatgacagctattattttgctttttgatatatgtctgatcttttttaaaatgtctatttgcaggaaggatgatgattggaaactttctcgtggtgtatatatttttgttataattggtcttttgcttctgcttggtgctatttcagctttgatagttgttgtcaagccttggactgtaagtgtgttgaattcattgtctctttaactcccccttccccaaggtcaaaattctttggctgaacctcttccttcatattactgcagataggagtagcatttcttttggttcttctccttatggtattagcaattggtgccattcaccactgggcatcaaacaatttttatttgagccggacacagatggtctttgtttgcttccttgcttttctgttggctttggcagcatttcttgttggatggtttgaaggttctagtcaagtccattatattggcattgatatgcatatcttaagtagaaagtggctgatctgtaagtgctaacatgatcttttttgctctttttttctccaggtaaaccatttgttggagcatcagttggttatttttcatttctttttcttcttgctggacgggcattgacagtgagttactgattctaattttcaatcttataatatcagcatgttatcgtatcccaaatgcttttatgcttcaatcagttcatctttgttttgctcagagttttattcctttgtgatttttttcttctattccataggttctgctttcaaatcccattgttgtatattctcctcgagttttgccagtgtatgtatatgatgctcatgcagattgtggaaagaatgtcaggtttacccccactctaaattttgtttttaaatacgttggttaattttttgtttgattttacttgttatgtgatttattactttatgtatccactgcttgtattgttatttacagtgtggcctttctcatgctatatgggattgccctggcaaccgaaggctggggggttgttgcaagtttaaagatatatccaccctttgctggtgcagctgtatcagcaattaccctagttgtttcatttgggtttgctgtatctcgtccttgcctaactcttaaggtctgtgaagtcattgtgatcaacactgacttttaagctacttcaaaatttaaatgattggatttattatatacactgaaatgtctgatgaaactggcttattataatgtgctaacttctttcttcagaaaataccttctaattgaagttctaacctttgtaaaattgtacagatgatggaagatgctgtgcatttcctcggtaaggaaactgttattcaagcaattgctagatcagcaacaaaggtaagtagatttgccaacgagattgcaggaccctattgggccaatatctatattttattcttgtcctcctagcattgtttggactctggagtagtaggtagtaggcattctagccttctctacaactgctatgtatgtctgtctatgttggcaaaatttttcttcctttacagaaacaatgttcttgctaaaatttggtttactgctctgcagttaatacttctgcaaatgtagtgagaaatttttccactgattataaagtactctgtaaatgtggctgtatttattttataaagtactttattctcaatcatcctgagttttggaaatcttttatgcttttgaattaatttgtttttatcttttgcattatcattgagctcagtaattcatgctttttcttttttaacagatagtccatgttttatcggaatctttgccaaagtattctagtttagttttgaaaagtgcttcatagtgaattgattctatttgaggaaattgatatgttattctcatacattgaccatgtttcaagcatgttatttcctattaaattgttgctttttgaaataatttctcattggaatccaatctttattgtgaacaattgcctgaatgccttagtgtcagagacaatgtgccaaacgtttgacaaaaagttacaacagattaacggctaattttgtcacaccagacttgataacaagtagcaactctaggttctgaatttcaactgtttctataaatatgagaagtctattcagagtttgttcagtgaattgaattacataatatacagaaaaactttccaagcttctcttttttatgtcattttctaactcaaactgcatctctatctctgaaaatgtttacatttgaatcagaaaacttgttaatgaaataaaatttcatcaaccaatcagtctatgtttgtgtttcttgtgcatgcattgctttgaaaatagtttatgataatctctttcagtaccctgaattaatataactaaccttaaaccaatggaaatgtgttaattgcttgaataattctctttaatcttgatacttacataaatattttctaacgaatatgttctcctttatctgtttgttgattattgaatgttattgtcggaaaagaactcctgcatttgtcaatgcaattcaactgtgaattaatgatatatacttgcactgcagaccagaaatgcattatctggaacctactcagcaccacagaggtcggctagttctgctgcacttttgattggagaccctaccattatgcgtgatagggcaggaaattttgtgcttcccagagctgatgtgatgaaattgagagaccgcttgagaaatgaagaattagttgcaggttcattctttagtagattaagatatcataggacattccgccatgagccaaccagcgatgtagatcatagaagagtcatgtgtgctcatgctcgaattctggcactagaagaggccattgatactgagtgggtgtatatgtgggacaagtttggtggttatttgcttttgttgcttggtttgacatctaaggcagaacaagcacaggtaatggatatctagttttgcatatagtggatgatatcttgtttttatttttattcttgtgacaatgataatccatttctctggtaggatgaggttcgtctgagactctttcttgatagcattggattttctgatttaagtgctaagaaaataaagaagtggatgccagaagatcgcaggcaatttgaaatcattcaggagaggtactatcctgagtatctgatattaatatgtatagtatctttaccatgttttttctatctaaatattttgttgtgaattttctagttacataagagaaaaggagatggaagaggaagtcttcatgcagaggcgtgaagaggagggcagagggaaagaaaggaggaaggcgctacttgaaaaagaggaacggaaatggaaggagatagaagcttctctgctctcctccattcctaatgctagcagcagagaggctgctgccatggcagcggcagtacgtgcagttggaggcgattctgttctagatgattcctttgctcgagagagggtttcaagcattgcacgtaggattcgtgcttcacagttgtctcggcgtgcacttcaggttcattaactgtctttgatatttattctgaattctgatagcaattgataggatctttttcagttttttttttttttttttaacagtctgtttaatttgttggagggatttcaatgggaatagaaaaataattggatggaatgatttgtggaaacaattggcaggatcttttttcagtttttctaacagtctgtttaatttattggagggatttcaatgggaatagaaaaataattggatggaatgatcatcctctttatgtataatctgtgatgtagttaatagtggaatggtttccgttcccattttggttttcaagaattagcaggattgtggaggaaaagtattacaaaagtaaatgtttttttttaaattatgttatttgccatatttttttgtgaaataatgtaaaaaaatagtgctctgtagccttaaaaagtagtaaaatattttttgaaatattttaatttatgatttttatttaaaaaattaaatgttaaatctgatgttattttatttaaaatatcttttaaacaaaacaaatccatctgataaatataaaagcttataaatatagctttttaagtcaaatatatattgtttgaagtgtgtgtataaaaaacaagattacaagagtcttaattttataatatattattcatttgttcttcagatctatgtttctcagtagattaattttgttaattaaaccaaatttatttgataggtaccagcaagcaagaaagactaaaaggaagaaattaagtatgaaaatatttgtattgcagtaactggtctgaatcgagggaattcagatcctggaatattctgtattgtgtacaatggtacaaaaatgaaaagacacctagacagttctcaagagtgtctaatctctcccagcccaagcctacatctacacacctttccctggcttgtattttctctctctctccccctctcccccttacatgcacttccctcatgctctggtgccaggttggcagttagctctctcgctttctcttccccctctcctataacaaatttgatacattgcaccttttgcctctcttttcatacaccttcagtgatcttgggccttggcgctatattactattcctttccaaagtattcagtaaacttctgattcattgcatacttgttccattcccgccagctcatttcagctaactggattttctttatgataatcatctatttaaaatttctgcatgcgctcacctttattttgactgatggattactcactgaaaaaaggatgatggaaaattatttttaagaatttaactagaataatgcattgacactgtatatgttttttactgtctgattgttgtcagatcctaaattgtcatgtgtagtaaatttgttgatttttttaataattaccttaaaattcatatttaaggttatttttaattgaatgacagtatacaaatatttacactgacatgaagattatacccatttttttattggtatttatataacaatccattacgaaagtctaattttgtttatctccacttgtggtatcataatttaaataattaggatgactcttctggagattacttaatttacattgaaattttgatatctttgcagacaggagtggcaggtgccatatgtgttcttgatgatgagccaacagccagtggcagacattgtggtgcaattgattccagtctatgtcaaagtcaaaaagttagcttctccattgcattgatgattcaacctgaatctggtcctgtttgtcttttgggcactgagtttcagaagaagatttgctgggaaattcttgtggctggatctgaacaaggtattgaggctggacaagttgggcttagattgattactaaaggtgataggcaaacaacggttgcaaaggagtggagtattagtgcaacaagtattgcagacggaaggtttggtctttctctttattttatgtatcatatatttgttttttaaagttcaggttcagttacccagttctcttgttatatatgtttaccttttgttgcaggttatcttcacatgtgtgtcagtaatcttcttagtataataacattttgttattctaattttaatccaaatgcattttgggaattatatggtttcagtatttcttattaattgttttacaattctctccagatgaagtttcacaattttttcaataattaagaattcaaaagtcaaatttcaatctctgccagctttcttgagatgcaaaagatagctagttttacctttaaagactgttaggactgacttttactattttggcatggtaaacttgcaactgaacaaaatttatactgcatgagtctattttaaaatacaggagatttttatagagcaaaatacttatattatttgctcaattgcttgagtttgtcattatatatttggatggttctgtctaggccatgttatttcaatgcacaataaattgttgtagtttcttacgtttctgtgtgggtaatatattgcaggtggcatattgtaacaatgtcgattgatgctgatttaggtgaagcaacatgttatttggatggtggatttgatggctaccagaatggattaccattgtgtgtgggtagcagcatttgggagcaggggacagaagtgtgggttggtgttagaccaccaacagatattgatgcatttggtaggtcagatagtgaaggggttgaatctaagatgcatattatggatgcttttctttggggaagatgcttaactgatgatgaggtttcttctatttataactcaatggcttcggcagacttcagtgcacttgttttccctgaagataattggcagtgggctgattcaccttcgagggtatgctgcttcttccttcgctgcctctcccttcttgtagagaattgaaattttaaaaacaacatatataaattatagaaacaaaataaattgtcctcctaatactgctaaatgctccaacatgtagaaaatgttcttatcatgctttactaaacatcatcctgttgtctgctttattattaaaaaataaaaatagtataacaagtggtgttttagccatcatgtttactttgtctaatcttattaacacattttgtgtctaggttgatggttgggacagtgatcctgctgatgtagatttatatgacagagatgatgtagattgggatggacagtattctagtgggaggaaaagaaggtcagaacgtgatggcatggtggtggatattgattccttttcgaggaagtatagaaaacctagaatagaaacacaagaagagattaatcaacggatgttatctgtagaattagccatcaaagaagctctctatgctagaggagagagacgttttactgatcaggaatttcctcccaatgatcactcattgtttgtggaccctgcaaacccccctgcaaagttacaggtacttctctttattattatcttttagtttactgtatttacccccccttacaaattttatattgtttcatgtacaggttgtttctgagtggttgaggccaggtgagataggcagacagaaccatcttgactgtcgtccgtgcttattttcaggagctccaaatccttcagatgtttgtcaggtctcatgttttacacctcacttgcaagaattttgaaataaatgtttgttctcattatgttttgttagtatttagattttgcaatgtgttaatagttatgtatattgaacagggccgtttaggtgattgttggttcttgagtgctgttgctgttctggcagaggtttcacgtatatcagaggtaataatcactcctgattacaacgaggagggaatttacactgttcgcttttgtgttcaggtaataagcatatagagtcagattttagtttctttttattttctctttttcatgctgtgactggatagataacattttccaaataaatggcatctaagttcttttcatattttggttcatgatatctagggtgaatggatccctgttgttgttgatgattggattccttgtgaattaccgggtaaacctgcatttgctactagtaagaagggctatgaactttgggtctccatattggagaaggcatatgccaagttgcatggctcttatgaagcactagaaggtgggcttgttcaagatgctctggtggatcttacagggggtgctggggaggaaattgacatgaggagtggtgaagcccagattgaccttgcaagtggtagattgtggtctcaactgttgcgcttcaagcaagaaggttttctcctaggtgcaggaagtccgtcaggttcagatgtgcacatctcttctagtggcattgtgcaaggacatgcatactcaatactgcaggtaatgggataatgttttatatttttatattcacgatcattgttagatgtaaaaccagtaataatccttcacctaaataacttggtaagtttttaagagagttggtccttgacatggaaacaaagccttttatgttgagttagtcaggagtttatccttgttactttgttctatttttttaagttgaatttgagcatgaagtagagtggagttgtgtatgattcatgctttaagcccaaaaggttctcttatttgaggagtgtgtttggtatatagtcattcatggcaactcatgagccttcacccaacaactcaagccttatggagagttactctgacaatcctaatgatttttaatgatctctgctgtcatacaattttaggtaagagacgtggatggtcataaacttgttcagatccgaaatccatgggccaatgaagtggagtggaatggtccctggtctgactcatcgcctgagtggacagataggataaagcacaagctgaagcatgttccacaggtagttctttatgcttttctgttgtggattagtcatatgcttgacttcttagcatctctttatgattgagccgactatttgctcttacccaatgttattatcatttgctgacgtcaattaaccattttatttgttacttttttcaacagtcaaaagatggcatattctggatgtcctggcaagattttcagattcattttcgatcaatatatatttgccgtatttacccatcagagatgcgtcattctgttcatggtcaatggcgtggttacagtgctggggggtgtcaggattatgatacatggaatcaaaatccacagttcagactgactgcaactgggcaagatgcatcatttccaattcatgtattcattaccttaactcaggtactactgatatttccatacttagtactgcaatttctgaaaagaacctttcccttgaatttctttaaaacttcatttcatgatatttatagggtgtgggattttcaagaacaacagctggttttagaaattaccaatccagccatgattcacagatgttctacattggaatgaggatactcaaaactcgtggcagacgtgctgctttcaatatatacctacatgaatcagttggtgggacagactatgttaattctcgagaaatatcctgtgaaatggttttggaacctgagccaaagggatatactatagttcctactactatacaccccggtgaagaagcaccgtttgtactttctgttttcaccaaggcatcgataactctggaagctttgtagtgcctaggatagtttttacatgtatcttgtcctcttgataagtttctctgcctgggttctcggtggatcatgtacttgcactgccagaggccgtcttagaacaattgggtaattttctcttccccctctcccaacaattttcttttcatatatatgtcatctaacatttatggtttgtattttctcttcacagcattgagacactattcctggggaaacgacatggcatctgttcgagagatggatgaggtttagctgcacataaactcttggtctttgaatctgatgattcatcatcttgaacaatgcttctgccagcattgaagagggctctcgggtgtttattgtgtacataaaaaagtggtactataggggtatacttgtaaccatgtaagcaaagttgaaaaagaaatagctgcaaataagtaggaaattactaacacctggttcaaatggaggtaaggacagtgtggggaggtatagtaacaagcattgagtgactgattgtaaattcagttgccgttttgacaattgcaaaaaattgtacaaacattaacaattatcagttcctatcatttattggcatttgggaaaattttgtacaaatgtctttctaatctaatttgatttcaaaataaaggagcattcactagttgtagttttttcttggttgaaatacaaaatgatgaaactatgaaacggcgagaaatgttcctatcttacagtatttagtcttgcagtccttatatgtctatagagttccaatcgtttatataacttgaaaggtcaaaaagcgtttcagagttttttatactttctaaatgttaatttctatagactccaattttaaaattacaaatttctaatagtaactgtagatactagctattttttatatcagcaaggtgttgtcaatttagcataatttttttaaaatgtagggagcaaactaaataaaagatttgtaaagctaaacaaaaatttgacgaaatcatgtctgtggagggaacgataagggcaatgtcaacataacctcgttttgtctgctatgacacgtttctctaagcttttctcttcgaatataaataaaataatgtaattttttttaaaaaaggttgagaatagaaaataattgttatactaggcaattgtatgggcatgcagaggaaaagtacaaaaaggggaaagaaattcgaaaatgaagatttaattaaaagaaaaattctaataacattttttaatatatacttttaaacattttttattattaattgaaatctatatatccattaaataatgtgagttttatttgtcgtacttttaataaatttgagttaataataaagaatgtattgcaaaagatattatataaaatgattgttttcgttaaataaaatatatacatagcctaaaagtgaatgaaaaaatagatatttacatagccaaacctttacgataccaagagagagatataaggtgcaaaacagagatagtgttgaggtgaaaccgtgaaaatttgacatgtagtattaaatttacgcgtgtatacacttgtgtattgataagaacccctcttattttggaaaaacaaaaaaaaaaaaaaaaaaaaacaaaaattggaaaaaaaaaaaaaaaacgatgagatttggatgtacgatgttggcggattgcagaagacacgcgagtttccattttattttgataggcaactatttagtggctcaacaaattttgcgggaaagtgagaggttttatcaagtcaaaactaatgtgcttcacgttcataatatcgtttgattgttatttacttcttgtaatataggaatctgatgagttaatgatgaaatggtttgtgttattggtgtgcagagttgtgagtatatgtgtgctgtgttgccttatccatagtgtcactgtaagagggaaaataataaatcttgaaaaaaatatgaaaagagatataaagaaataatgtaatactacatgatttgatgaaaagaaataaaaagggtatatataatatgttagcatttcttatgtttataataagaatttaacggatacgtatttttaatataaaatgtttactgttagttaattaaaaatcatattttgtatgatttttaaaataattattataaaattaacaaactttattatacataatataacttgtgagtttgaaattgaataaggtcttatatatttttcttataataaatcaaatctaatgaattttggattatagacttgtatacgaaacaagtagggttgtgttacatgacaatgttccctccgagtgatttgagagaagaaaataacaattaacaagtgatcctgcaaataatttcaacaagttaagatattttattatcacctctattgccaattctccttgatagcttatgtgagtgtaggaacgaaagatggaagaaagagtgagtggatgtaaccatgtcttaatggttccatacccaagtcagggtcacataaacccaatgctccaattcagcaagcgcttgagcaccaaaggagtgagagttactttggtcacaaccattttcatttccaagtccatgcatcttgaatcttcttccttacgaggcagtgttcaatttgatttcatatcagatgattatgatcaaggtggttttaatcaagctggtaatgtaccaaactatctttctcgcattcaagaagtaggttccaataacttgagggaactcatcaaaaaacacaactcttcagatcaccctatggtgatatgggtattggatgtagccaaataatttgggttattcggagctgcttatttcactcaaatgttgcagtcaattacatatattataatgtttaccatggacttcttaaggtccccatttcatcaccaccaatctctattccagggcttcctttgcttgatctaaaagacaaaaccagcctttgtttatgatcctagattctatcctgcttactttgacttggttattaatcaattttctaacatccacaaagcagatatcattcttgtcaattccttctacaaggtagaggagcaggtatatttcttgtaaacttgcacagtatttcaattcctttccaagaatatgtttaatttactattcatttgatatcaattcttatgtcaatggtttcaaaaaaaaaaaaaaaaaataattatgtctatgattgcgtaccaacatgtttaaaatttatcatgagccatgtattggggtattgcagagctagtcaaaacaataatttcatccctattcatgaaaatgactaaactattggtggtatgcatgttaattgaagcggttgaatagtaacagtaatgattaggaaaggtaaccagaagggagtagtagagcaagataagatcttatatcttatgggttacaagttcgagtttccacttgcctttctgtttttttgagccattagttggctcaaacaaaagcctgcagggtcagttattttcatatcatttggcagcatggtgtgcttcagctcacagaagatggaagaaatgcattgggcctaatggcaactaccttcaacttggtcatcctgattagagaaagaatcttccaaaagcgttgggagaggaaattaatgcgcgtggaaggggtttgatagttaactggtgcccacaattggaagtgctatcaaaccatgctgttggttgctttttcacacactgtggatggaattcaacacttgaagcattgtgcttagggtgcgaatggttgcactgccacagtgaactgaccagcccacaaatgcaaaattgttgaggatgtatggaagggattcagagtcaaagaatataatggattgtaatagagaagaggttgagaattgcatcagggtagtaatggaaaaggacttaggaagagaaatgagaattaatgctaagaaatggaaggaattggctatagaagagtgagtgagggtggcacctcagacaacaaaatcaatgaatttataaataatctgaaaagatcctaaactaaatatccatattggtttcaattaatatttattatggttttccctaaaaaaagtattgaattgtatgagaatttatttccttctgtctgtttagttgatattatatgtttatttgattgtatgttaaattattatatatacaagcaatcacagactaaactattggtatatctttcattgattctgtattctaaatttgaactagatgtaaatatgagactgagttatacacgagagaaacgtagtaacacgtttttttttttttaatcaacaacgtaataacacgttcttttaaaattctgctaaaactacatggctctcacttgataacaacattatgtaattgcaccagatagcaattcagtgcaatacatatcgagtaattagtcatctgtctatgaatgaagagtataaaagagttttataaagacatctaataacaaattgttatagatggtaattccttttacaataattactttaaaatttatatttattgtaatttttatttgttgatgatatgattttttttcctacattaacacattgatttgcccaattattaaatcatatttgaatgatcaataaaaaataaaatacacatgacttttttaaatagcatgtgatcactaattaactaataatcttatagctcttctttcttgcaataaaatatatatcaaaaacttgctaatggatgtgctagtgaaataatcttttaaagaaaacaagattccgattgtcaaatcaccacgattcaaagtcatttaataaaaaaggtttatttcctaaattttcaacatatttttagtccctgaattaatatttttttttttttacttttagtccctcaaagaaattaaagtaaggataaaaaatgaaggttaagagggacattgatcagtaaaaaaaacgttcaggactagaaacaaaaatctttaaaatttaggaactaaaaagataatgaacccattaaaaaattataacacacaattcaagcgtgttaaacaaatttaattaagtagtgagaaagaaaattatatttgcaaaggaatcaacagtgcatgcataaatgatattcatcatatgtctcaagacaaaataaccacactcacggatgtgctaacttgtttaatgtaataattttttttgcagataatacaattttgattgaagaatccagtgaagcaattaaccttaaacttgaactttggacactcacggatgtgctaacttgtttaaagtaatcttggatgtacttaccaaaaatgtataaaaattatccctaatttttttttttgcagataatataattttgattgaagaatcaagtgaagcaattaaccttaaacttgaactttggagattggatttggatagagtttaagaataagtaggaacaagacaaaagacaaagtatatatatatatatatatatatatatatataatatatatatatatatatatatatataacacacttagctagaggcaaaggtttccaagtttaaatatctaacactattaatacaaaatgacaaaaaatgaatgaagatgtcatatacggaatacaagcaaaatggctacatgaaggcatcgacagttatccgtgatcacatttttttgtgtgaatattatctgtgatcacatgttacctaccaaagtcgggcaagttttactatatgtcctagtgacctactatatgatattaaatgttgaaattttgaggaaagaaagattcacagaaatgataatgttaagatgaaatatgtaatcacacaagaaagaacatgacataaaataatagtatacaagaagatattaatgtatcaccaattgagagaaaaaaaatgacaaacaattatgatgattttgacacaataaaaagaaccagtgaagaaaataaattatatggtttttaggcgtgtagaaagggagacaaaggacattaagaaaagttgttaagatacatctcagtaaatatcaaatgaaaagttttgattttctacatactaaaggattagttttcatttaataataatttttttatttcttaacgtgtatttaagctattagttaacaaattattaaatggtattgtgtttcacttatatttcaattttagtacagtaatgcaccccaatagccaataaggcctaagtgtcgtatcatgtataaattaaagtatatttgtgtgctcagctgtcaaaaatttacagagcttgctcacacttcattttcgtctgtctgactgctacaattgaactatttgttaatacgaatacaaaaatcaatgactggaaaattcgaatggcctagagtacatttgcgcaacatattttgtggcatggaactcaaataggatgtctctggaagtcaaatgatgggatcataccctctacctgctctcatcttcaggtgcattaccatctttcctccaactgcccaacttaacaatgtcctcaactagaattttcccatctatagcaacaaaatgatatccgtaaattattgttttcatgaactaatcttcataaagaatagataagtttgataaatagtcactggatatattattcagataaacattacaagtattcaacatcagtccttgatgaaactctttagaagttgataacttcgtagggtaaacattaatttggagaccaatttttttaggcgcatactttgaaaagtaaatagtaacactatatttaaaaagaagcggcaaaatactggtttagtaacatctcaaaaccagtcattttaaaagtaatttttaaataattttgataacccactgaataatactttaatggcataaccatcccgccaatattcatagatgaatacttttggttgatctgtctgtgatactgttcagttacctattgctctacacgtgaatttccatgaaaatttcactggaatttattttatgtgaataaagaacaaaactatttctgaatgcactacattgcaaacaaaatcaagaattaataagattaaaaaaaaattagcatcatgtgcgagagaaatgacagacctctatctttggaaagactgctgacaagttcttggataccctccttgcccaatgtatcctttaagtacattgcagcagaggctacctcctcaggagttactttcccatcataatctctgcaaaaaggcccaaaaatatctctgaaatcttatgcacagaagtcattacatatatagattgtcctaatgaagtaaggcatgtataagtggcaaacaagaagaaattgtgcacaagactaatcaaatttatcgtgaaataataatcacattgacatcccaaacaatattcaacttttagaacaaatgtggaaatgtattcttcccatttagagttgattgataagcttgcaacttggaaaatgagttcagacttatacctctgtcattcaaatgccagcaacttataatcaatattattattaacagaatgaaatatattcacatctttctcttgtggtagtggaacttaaattgtaaacaacacaaatcctttgtagattatgaagcacaacaaagtagtgcccttggtgaaatttataattgttaaaagccttaagggaaattgaaaacagcctcacttggcggttatatatgaacaaagaagcaggagaaagttaagcatggtatctttggtggtaagtcattgacttctatctatgcttattttactgactatatatgcaataacatttattcttactataatatcaggttcagaccccagaaaggtcccttctcatacaattacaatatcttgattaattgaacagtaatcacagtctgtggcttaatctacccgtcactctccttgggtaagaattcaattacaaaagagaacattttatgacatcaaatcatttatagaaaatacgaagtaagaatcccaaccaataaccaaatgtgagcaatagcaactacagaaatgccaacacacgccgacaccttttgagttttgaacatatttttttattattggttgaaatttattccaacaacaaaatttgtgggtctcacttttatttaatgagcactactcatgattttatagttttcaataaattttaaccaataatagagtgtgttgaaaggagcgtaagtcaaatgattcctattcagcaaacttgaagcagtatgatatattcaagcatgcagtggcaatcacagattcacagtttaactttcactaaactaaatttatgcaaatgcattatgaaaccacatacttcactttaatgagatctgataaggttagacaaagcatgaccaatgaaaattgaaatgtcaaagagccttagctcaaaagcaccatgtccctttagggactgcttgatcatacaatccatctcagcccggccactttgcctaaactttatcgtacctccccccgcccaaataacaatgttgaagagctagtgcaaacctgtccagcagcctccaacggtcaccaattttcgcatcaacgtcatctatttccttctcaagattttgaagcatagcatcaacctgacagattttcaaataattacaaattcagaagtgcaaaattagtttctaggttttccctaaactagataaaatgaaatgggtcttactctcccaatgagtgctgatgacaccttatccccttcacctgactcagtagcgtgttcatgttcctctcgggcagctttatatgccttaaaggcatcttttttaccatttgaaccctcttcctctaccatgctgttatagagttctatctggacacatacaaaacagcaatgataagaatggcaaatggattaaatatatgtgcacaatcacacagagggtggggatcaatttaagtgtaacaattgtcatacaaagacaaatgcaacttatagggcaaggggcatgtaccccacacttagaattcatcctcactatcactacttgttaaaaatgctacatgttaacaatgtcacagatgaattgtttgtttgattacattaatagagagaaacatttgaaagtggtagcaataataatattattattaataataatatcaagcatatgaaattgtgtattaaacaattgtagacttatctttaattaggttatattattgtatttttctctataaataaatatttaaaaaaatatttcatgtgttcattataatctttgaccatgccccagctaccaaaactgcctaggtttgccagaacaacaaaataggatttgatacattacagttagttacaacacacaacaacttcctacaagaaaacaatgactacttgaaatatcaccaatggttccgtatatctttcaagccaatcatttgaaaattgaaacaaaaataaatctgtaataaaaaggttaatgtttcacttatttgcaaagcatattaaagataaattctaatatttttcaatgaagtctaaaatgctcttaggcaaatataaaattttatgagaatatgagcatgatacagactttcaatccaaaataagacttttctgaaaattcatcttatagaaagtaattcattatagacacacactactctttctttctgtctttgttgatggatgttagcactccatctttttttttggaccaaaacaaattcctccgttttctttttcaaacaacttaatcttattggtatttggtcttctaataatttatatatatatatatatataaaaacaatctttctctttctttccccctctcttttgtatctctgaacctctttcccttaccttttccctctcccacacctctctctgaaaacctgacccccctccctttcagctttttaacctgtctatcctctgatgatgaaattggatgaatctggtgcagaggagaacaagggaaaaaataataacgtatattgtagacatggtgattctcacagcagaagagagacattaacccgagaaaaaaaaggataactaatgaattttaaatttaaaaacaccaccttaataaaatgtgttaaagacctctacgtgtttgtattgattaaaactcaaagacatattgttagcacacttgcatgcacaacaaatatttaatgcaatctatagaagatgtaaaagcaaatgatgaattttgaaagttcacacatacctctttgttaaccagtctaagaaaatcttcacgctctgaacttacagactgccaccagagtaaaagacaaaaccacacattaaacagcttaatgttaaatagtatagattatgcaaaataaaagaagcaattcaccaaattaaaggaattgaatgttttagatatcaaattctcaccgatgcagaagctaaaacagctaatgcacgactaagttcacacagttgttctttgttttcaaatgctctgtctctagcaagttggtgagcctcttttgtgttgaaatattcatctctttcagggccttatcatcttgactagaactactctccatccttgcttgcaccacctcctctctctcttcctcctcctgcatttatttataatactatgttatgcattgtgttttttgataacatggaatcttagatcaatagaaagctacttaattttcatcaatagttatttaaaatcagaaaatgaactttatggtgaactctagcatatcaacacccaatacttcatttgttaaacttactgatcagactcccaatgaattctgtcaaacaaaatattgaaatgattctttttatgtcactgatcatttagtattttttagtagattcttctcatatgaaccagagcaaatatcaaacactatcaaacagaaaaccttgtcaatgtcatcctaatacaacaaagataccttttaacgggataactatctagagcaatgcaattccatagtttaccttaataagttcttcttgcatttcaaggaactccaatttcctcctcctctctgagacagaatcctcagagggcaaagatgtaacctgtatagtatctacaacctcatcagggagagaagaaagtgtagcctgtacagcttcttctggtttcaatctcccagacacagtaaatgacctataaaggatatcaagtgagatttcaaaatgcatatccagcgcattttttctttaacttactatttggccccatcaagggactgagggaggaagccatgctaaaattaccttgaaagtatcaaaagagatgatggaacagagtgattcagagataagtccaaccaatctcgaagctgcacaggcaggttcacaaattttagaatagaaacaccaaagcaacatttgatattcaagaaaactgaggttttaatatcctcatcaagatccagtactcaaatagaatacaaatcatgaattgtttccaacacaaaacctgttggcgcatttcttcaacagaaagcaacccaagcatgcctcgctctctacaatcttcccgaagttcatcttctgaaagagaatccacaccttctgcttgaatcaatttatcatcttccttaatcctaaaaaagggggacatgttgcaagtaacacaattacgaggttcatcaagttatatggtaaattgaagtaaataatctgaaaaggtgaaaaagaaaactattttgtgaagtttttgtcaccaatgaggctaattatagtcataacagaaaatgaatgcagtagcatataatagcagtttgaagcaatatattaatgagagattaataaggaacaaggcctacatttcaaacctaaatttgtaccaaatcttttaggcctacatttttgtctccaattttttctttttttaaataaaattcctctctaaatgatccaaccttaaataaatggaaagaaagtattcttgtaataatttaatcatgcatgatgataccaattttcaaaagttaacatagcattaaactccaacccaaacttaggaccaattccaatccaatttgggcaccaaagttgcatcaatggatttatcgggaatttgatatttgattgagcccaatgacattatttgtttcatgaagtcaaacctatctatcaagatgaggctttggttgttgttgtagccacaagatataggagtactctggttgtgttcaatcttttgatatttatatttgaataatacaattcacagagattatttgttctcttattttgtaccctaatgacatagtatggggaggtaatattttctaataacaaggtatctttttttaattagagattttttttttcattttcctaattgtattacaaacagtttagataaaaccccaacttgcaattaaaattagtaaagaaaaaagttacaaaaacatgcattataaaatgcatcctacctccgtaaatgttttcttagcatataacgcaagtatgcatcagtgccaaaagggctgattcccatgtacttgcacatattgactaatcgtggcctacgagcagtaaagacaaaatataagtcataataccacctcacaactgagaaaaacgcatattgaagtcaaacaggattaagaaacaaacctgcttatattatctagagtaagttcatcattaaacaacttagcaaagcccaaaatttcctcattagagacagttgcacctcttctaatctgcagaaagtaaataaagcataaaaatgacaaactaaggaaaacattcagaaagaaagattgataaacaattctttgaactgaagttttaaccgtgtttaaaaattcatcaagatcttcagctgttttctttagttctccactgcgggagttctgaacttcttttgccatttctttgactgtatcctgaaggaaccttgcatactctattcttgccttgagtctccttttcaatgcttcctacacattgagcaactgagtcacccaaagaccctacaatgggcaatcaaatcacaaattcatggtaactgaaaagataaaaaataatgcacactacaaatacagagacacaaaaatggtttctaatgaggatatttgttaccagtggctgctagagaacatagaacatatattggtgcaagctcatatacaattttcaaccaaagatgctgattattagggtattttggaagtttggttttagaagagaagggaaggaagaacaaatttttatttcaaaaaaatttctctaattcaataaaaaaattaaaataaaagaaataaaatgatagatcagcatcaattaatatgttaatcttttataaacattatacagctctcttaatttaaaaataaaatatttgtcctcccctcccttcccctccaaaacctaattcccaaacatatcctggtaaaaaatggacattatgttgatgttaatccttgggagctatactttacataggaccttcaacaaaggctaggacaagccttgcagttgcttagttatagaatttctatttcccctggtattattagaatgaagaatccggctttttaaagtgagtgatttcagttgttgataagaaaattaacggttacgtgcacatgcataataaatcaaggatgtgttgaaatatacaccattgattttctcatcaacaattaaaaatacttaatttatccttactcacttttgagaagccaaatcctagatggaatgggacaaagaattcaaacagtttatgtacagtttattttaaactagcaaagataacagcaaacagccaaaaaaattcttggcaattacctgttctttcatcttgtcttgaaatgttgacggcaacatgttagggaataactttagaaacacaggcaggaggaactccataaagggaacaataatgaaaacagcaaaaggaactagcctaaagatatcggcagtagtccgcgtcagttgctgcctttcccttctggagagactcttcccacccgcaagcttcaacaacaacctggaactgatcctcacatcagcccacagcagcttagaacccaaccaataatgctgcaacgtcgacacaaattcccctttccagtgaaccagtttttttgcccagtcctccctgcagcagcagcagcagcaacaattagcaaaccaaaacaccaaataaccaaccattaacgaataaacatttcactgcttcaaatttctatctaataaattcaaaagcccgagctgcgatttctatactctaaacacaactataacctcaatttaaaatcaaatgcactctcaaccgtaaatgcaacaattagcaaacctaaacgccaaatcaccaacgaacaaacatttcactgtttcaaatttcaatctgaaacagcaaatagcaattgcagccacaacactacaatttcaaaagcctcaccgtaattgctataatccaaacacaaccgtaacttcaatctaaaatctaaaatcacatacaaatatcaacagtaaatgcaatttcgcgtaatttatgaaaccgtaactgcggacctactcatagacgcgacagctctcaacgcaggaccgattcccaaaaacgcagtccacactctccgcaacacgctttgtaggtctttctgcgcctcttcttgcgcccgtttcgccatggctttggccttcgcagtggtcaagccttcgacggcttgatcgcactcctccggtgacgcttctttccgcttctgcgccaccgtctcatcgttctcatccggttcatgacgtttcgccgccgaggccgacgactgcgacaaccaccgcacacctatcggcgcgttcagtgtcgaaaaagcgtcacacggaaccgcgctcccgaatcctcgaacaacttgcaccaatccgaaacgattgaacaagtcgtctctgtacggcgtcgttccgtgcttacaaggaaacagaggtgacgtcgtagctatagcgcgttccagagagcgattactcggagacggagaagaagcaaaacagttattcaagtattgatggattaaacttctccttctcaaaattgctcgtgatgccattctcgaaggaactaaccttggaaaagtcacagtaagagatgagaaaaaaagaatgaagaatttgtggtactacacgtacgaattgcttagatcttatttttggttctattgttagtgagaattcggttagaggttgaagatgagatggtgattgaacttacttatgcggagcgtagaaaacggaggaggagaatacgaagaaggaatgaagaaacaaagtgtggtgagagttagggtgttaggaaagtagagcggagaggtttaaggagtttttgttgtgcagcgtggggaggggtcatcgggttttcttacactttgtccttcctacttacgtcttattcattttataccctttcaattcgtgctgcttgactcgttatttaggttggtgggtaaggcaaattattttgttggtttaaagtattttataaggcaattgcttcttgcatcccatgtttgcttcttgcatccataagaaacttaaaacatgcaaaaacatactaaaatatgcttctcctttgtctaaccctaacacacctctcccttttcccctaattgcacatcacttcctttccttgacatcaatgttgtttaaggtagatccgttgcagtggttgatggaaagggtttatcttggacggcggtggcaatgacctcttgcacgaagaggcatgtgagacaggtatcgtgggagtagtggaggtcaacgtactcgttagtgatggagagtggagtaggagatgttggcactggtctagtcgatgtagagggtgacggcgtatcaccagttggagacaaatcgggagggtgcgacatggtggttggaggctagataaagtgttgtagttagggccaacaattgcagctaagcaactaacgaaaactccacttgaactccactttgaatagtcataaatttgccaatcgaaatagggtcttcaaagaatacacaagtattgtggactctatcttgaatgtgtacacggttgaatgacaccaaacaccatagtgttcccttttgtgtttttgtttggagaacataatttggaatagtttttggtgtccaaattatgtaatttgaaagaatatgggtaacctgaaaaacttatacttttatggaatacctattttggaatatgattttcattttagaaggaccattatgtaataagtgaagggtgatttgaggatttaaaaacctttaggggtggaggaagcaaaaaatcggtgcaggaagcaatggcgtctttagaattgatatattgttttaatctggcccaaatatatgaaactcttaaatccatttgattcattttactatccccaccttaatgttttgcatgtttgaggttgagaagttgctattggcttcaaccccatttgttattggcctctacaaacgtgagaaaataccttcttatccctctatcttcctcttcacttcttctcaccccacccaacccatcacaaccacaccaacgctgcgcgccaccaccttcgcctagatccaaaatcgcagcacatcaccacagtcttttcgaccacctcaccacgtgaccacctcaccaactagatctgaacgcaccactaccatcgtcgcacatcgctcccaactttagatttgcatgcacgacctctcaccagcccagccaccgtcgcgcgtcctcaccattgtgtccaaacaccattgcatcgccgcaactccttcccttggtttgtgcgcccccaccaactccagatcacatgaaaacatgcttctgttaaggaggaaaaaatatatatacacaacaaaaatgtgatttcgttttacactatacaatagaatcatatttccgttgtatatatttttcacccctacttaatccaatgaaattgtgttttttggcacccccattacataatgaaaagtcgaaaacccaatttcgttgtacaaatagaatcatgtttccacgaaaagggcatttttggaagaaaaaaggtgtcagtcccttagtaggggccattagcaatggcagcagggccaatagcaaccaccctaaggttgaagtgtctcatgtaaattgaaattgtaacatgaatagttttgagaatgtggacttcttgttcattaaaaaaaaaaaaaaaaaaaaaaaaaacagaatgtggacttcttagtgaacttgccccatgtaatatgggaagagaaattcaaagaagacacaagtgattctaatcctgtaaaattatctagatgcaatcctgcaggagttgaggaaggcaatcaaggcatagtgtaatgcttttcctttgggtaaagcctccacagtaaagatgattaatcatgattgcatggtacattgtaagggttcctgtcctgtcaatacgaactacaaagtatatccctgcaacattaaaaaatgtaaatacatagaaaaagtatttgctagaaagattcatatttcgaacagaacaagcctcttaatcttatattccttgcagtattttctggacctgatgttttcattcatggataatgatgttgtattgctgttgcatcctttctttcttttaacttgtgtgcatttttgtgttcttttgggtatttaggggtgggttcaattattgatatactgaagtcccgtgtatacatagcacaattgattaaaactcagaaatcaaaaaataatttagaccaagcatcatgacaacgaagagagaagaattaattattaatttatctgttactgcaagttcatatttatttattgtgtttctaatatatataactcctatatttaagccttggtaattgaagattttcacattctgattttccccaccttaatctgcaaaaattaaaatgcatgctagtctaactcttcaatcattaattgtctgttccaattctcttttccccatgctatgattttgatggtagggacaggggaaaggtgtagctaatgatgggtcagaatggaaacttgaattcaaattttaagataacatggttgagttggttcaaatgtgtgcagctacacatgaatttagtgtccaagtcttcaatcagttgatcttaatgtgaatttatacttatattgatgataccatctcacgtatagatgtctttgccatagcaagtgccccttttgcaaggcatgtactgggggaagcatctgaggattgagggcagatgcaacctgagatggcaaaacgaacgctttagctcaaattgagagatgtaaggtaatttacacaaacatcatggtaacaattgttagcatgacagaaattacaaaattgagagatacaactaatcatttctaagcaaaattcttcattcaatttgacaatcttaaagataaaagatataggaaattacaaaattctggcattggtaaataatgagtttagacacagatttgtatcctcgtgacttaagtacagcaatattagtatattactgtgatcgggtttcttaatgcaaagacaagatacaaattactcaacatatcaccataacaagatagcctggttatggatgtatataaggtccagcgaaaattatctttttcaaagaagagaaataaacttactattttttaacttacagattaataatgttcactgaacctttatcatccaaacagaattgagaaccacctccttactgtcaatcatccatcctgaatcaaaccataaaatttccaacttactgaaaacgtcagccaatctttagcttactgtcatcaacttatcatcaaagtgacaactattaatcagattatcaatactcttccttcaattttttaataagaaagatatattttcatttttcttcaaaaagaaaaacttggccataattaagtgaaagactgatcaccatgcatgcaacacgttgttaatgagagaaaggaacactgaaactttatttaaaagataaagttacacttcaccgttgaaactttattgtttcacgctgttgaaatataaatgtgggttgaaatccacattggttagaaatgaaaaaaattaaataatatataaatgaagaaaaaatttatgtactttaactttaaagttttaggttaaagtaggatgtgagtgaaatttatttatttgagactctaatgtaaatctccccatgtttcgaaagtcttgtgagcccaagtttttgtgtgaatctatcaatcttatcatcaaagtaacaactagtaagcaaattaccaatggccctccttcaattattttaacgagatatatcttttcctattcttaaaaaaaattctcaattattaaaaaactacattcaattttatatcattttccaaagtaacaaaatgtaaaaatgataacattttacattgataatcaatataatcatgtaaaaatatatatttacaagtttattttaataaatgcataattattaaactctaatttttattcaatgtttacaaactttaattcaaaccaaacatacatttagtgagctgcattttttaatattattgctttttgttttttttcttgctatctgtctttttttcaaccttacatacactccagttgatattttttcctaatataaggtgccgaatgtacttgaagccaatgcgcataacacattattccaaactgataaactatcatcccatatatatatatagaagaagcatcgatcttgcagtctaaagtatttgaagatggtgtgttataagcaggcagaatctcataccttgcttgttttcacatactcgtggttgtggtgggctacttgtcttgctgctgcaaataacagtttaaagccggagatacactgaatacaacaagccggctatgttcagaaaagaataaatactgcatgggtttttccccattaataaatccaaattctccagtctacacttctcacttgagaatcactgacaccgtaaacggtgatgatggcaacacagtgtgggttgcaaatagaaatcaaggtgttgaaaaggattctgcagttcttatgctgaaccactccggtgtactcaaaatagaatccaaagatgcaaaacccatcatcctttactcttcacctcagccactgaacaacaccgaagccacgctgttggacacaggcaacttcgtgctgcaacaacttcacccaaatggaacaaacactgtgttgtggcaaagttttgattaccctactgatgttttactccctgggatgaagttaggggtcaatcacaaaactggtcataactggtcacttgtttcgtggttggctgaaaacgacttaagactcgggcattcagtctcgagtgggaacccataagaagagaattgatcatcaaggaacgaggaacattgtgctggaccagtggagaactgagaaacaacaatggattcatgcacaaaacaaactacttggttgtctcaaacgacgatgaaagctacttcacaattacaacttcgaatgaagagcatacgttttggacgctattagaaactgggcagatgataacttcgaatggagaagaggctgcaagggctgatctgtgttatggttacaacacagatggagggtgccaaaagtgggaggagatacccacatgcaggaatcctggtgacactttcgaagtcaaggaactttacttcaattttaaacacataagcaatctagctaatcggagttatggtcccagtgattgccgggctatttgctggaaaaattgcacttgtgatggatacacaaattattatgaagatgcaggaactggttgttcgttcttgcatttgaattcaacggaaggtgatacttttgcaattgggggcgagaagtttttgatattggtaaagaacacccatcacaaaggtaagtccatatgatttcatgacttcctacttcacattttttatactctttccgtttttaattataattatttttttataaattttttttttataaaattatttttaatttttagatgtattaattatttttctcctatatatttttaattattcttttttcaaattcaaaatatatttcacttgtaaatttaatatgattaattaaattaattattttttaagaagcataaattaatttaaaattcttataattagaacggagacattaatttttttaagaagaaaaatgtgtattttaattcttatgttttcatttaaatttgattttggttcctatattttcaaactaatgaatctaatcctctaattctttaaaatatgtgagcttaatctttttcgtgtttaacttaacatttagtaaggggttttaccgccataaagttagaaacaaaattaatttaactcctcctataatatcgcaagaaggttattgatgtttagaattatgcttttgtgaacacatattagtctgcaaagagagaaagaaaattagaagaacgaaaagtgataattgatgtgacatgtgataatgtgatagaaaaaagagctgaaaaaagattagttgttaaataaatatttatactgagtattcatgcatgtatcattgttgtaatattttactttaagtcacatctgtggtaaacgttatagatctggaatcacacttacatgtcttcttacatgtaaacactatgcaggtaaaaaaaagtggatatggataactattgtaacagtagctgctctattatttgtgatatgtgctaatttcattctatttttcgccttgaagagaagaaaaaatctgcttgaaggttagctatatctttccagtaaacgttgttccaatattttatatattgagcataatccttcattcactatttctatttctatatatcattcaaaattttatgtaaattaatagagaagaaaagaaatagaatgaagatgaagacgctagattcagccgttaaagatcttgaagatgagttcaagaagagacaagatctaaaagtatttaactttaccttaattttgtcggcaaccaacaatttttcaccagaaaacaagctaggacaaggaggatttggacccgtttataaggtgacgtgaaactattgactttgtgttgtaagctgtaacaagttatgacaaggaggatttggaccagtttataaggactaataattttttgttgtttagggaatcctaccaacagggcgagaagctgccataaaaagactttcaaaaacatctggacaaggaattgtggaattcaaaaatgaactaacgctcatatgtgaacttcaacacatgaatcttgtacaactacttggatgttgcattcatgaagaagagaggattctagtttatgagtatatgccaaacaaaagcttggatctctatctattcggtatgaaatatgttggagtttatttaattataggtgatgctttaatttggaagacaaattaagatgatatttttttaatcatcaagcaataattccaatgccatcgtgtagagaaacattaagttttcaacggaaattttcattaatgagaaatattagtaacacattttctaatatattttttaaaacacatatttattcatcgattgaaatttattgaaaatcataaaatttggtaatttaatataataactttttctcttaatttcatattttttaataaattttaactaagtaaaaaggatgtgttaaaagagtatgttcttctttcatgttatgggcgattcattgacttatgctttcctttcttgaacatataactgtgtaaatgtcatgctttgtttaacttttttccatcttgaacataattaattaactataactaaactataccaatgataaatattgctaacatattccaattaaaaataagtttgtataatctaacaaatgtttccgagatttagtaacgtacacatttatttttttagttggagtatgttaacaagttataattagatattatcttaaatacatcaattaaatatgtaattgttaacatatatacaataagtatgtatacattaaattctataatatatactcacaaagattgctttatttttaacacttgctttatttccattgagaagatagcactaaaagcaagtttttagactggaagaagcgtttcaacataatagaaggaatttctcaaggattactctatcttcataaatactcgagactcaaagtcattcatagagacttaaaagctagtaacatacttcttgatgagaatatgaatccaaaaatttctgattttggattggcaagaatgtttgcagatcatgattccgcaagtacgagtaggataattggaacatagtaagcttgcaaaactctatcatcggtttcaagtgtagttgaagaaacataaataggtttgttttgccaagttataattaaactctttttttcagtggttacatgtctcctgaatatgccatggaaggaattttttctataaagtctgatgtctatagctttggagtgttggtccttgaaattatcagtggaagaagaaatactagcttccatgaggatcaccctataaatttggtaggacatgtaagtgaaattagtctcaacgacttcttttaatttgattttttaatactattttctttatctaatttgactaaaatgctaataggcgtgggagttatggaatcaaagtgtttctttacaattaatcgatccatcacttaatgatgattgtttgatcctgatgaagtgaaaagatgcattcaaattggtctcttatgcgtagaacaagacgcaggtgatcgacccacatgtctcataactttcaatgctaacaaatgacagtgcagtaattgccatgcctcaaagaccagcattctatgtggaaagaaattgttttgacagtaaaacatcttccaagagttatatacagcttctacttaaaaattactacttccttgtaaatatataagtttgtggcacgagatatctattccttatttttgtttttataaaaaaattattttagaattatttcctgtaaatttttccataatttacttatatgttaggacaacaaaacaatatatatatatatatatatatattaattattgactattagatattaaactttccacctttaccaaaagatgttaaattttccaattgtgttatgtgctggtgggggagcatgcactgaatgacaaatattttaaccaaattaaaaagatttgtacctctttgcaaggctaagcacttgagaaacattggtaacaaaagatcagttctaaattaagcattcctagagctttgaagcccttgatcagaaaagatctaacagctaggataaatgcattaccacctagctagcgttcttgttggaaagaaattctattatgcttccctttaaaacaattatcacacttatgcaaatgtggacacctcatgccagacatcagacaacacatccattttggttagttcaactatgcctttctcacatgtaacacaacctttgatgtcataacttaactttttcaactagctagttccattgcatgaacaacatcaataaacatttttgcttgtgtcacgtaaaggttggaatatttcatacgtttagaaacaaccatagaacactttggtgagtttccaagtatcccgattgtcataagcttcatcacataccctagcccccaaaagatcctctttttgtgtttctaatttgtttcccttttttttctccataggacatgagtttgtgtggtttttgcaagtggaattctataatatttttatctaacaaatgttagtggttaatttattattttttgttaatagaattgtatagtggttggttgtcatggcagtttgcatgattctcttctcgatctttttttttccttaaagacatgagattattttgatttagatcatagatattttttattaagacaatctgacttcaatcttgtgaaattattatgatcaacaaatttttctctaaatatttaacacttatatacccaagacttgaatttgagtagatctttctcatggtgaaagagtttatgtttaggttaaaaaaattataaaaatgtttattatattattaataatattttaaattttctataaataatattatttaaaatatttcattttaaaaaatattttgttatgcatctttgttttttttaaaatattagaaacataaaaaaattatatttattatttaaattaaaagataaatatttataaataatgattattttatattatattataagattatgtcaatatattatttccggaaaatggtcatcctttttattttaacaaataaaatataattttattattgaaattttattattaggttatattatattattaaaatatatttttaaatagttatattaatttaattatattttaaatagtaatatttcttaaattttccattattatattatgttatagtgttctttggaaaattaaaaattaaaaaaatgatgacgcctaaaaattataatatagtcaattttttaataactattgtattattatgaatcatttaatctagtcttaatatttatttattacttcattgtaatgtatacataataatattatcttattaattgtaaaaatgtctaatatgaacatataaatatagaacaataattttaaattattatttatgaaatatttttataatgttgatattaatattttaaaaaaaatctctaattatgtttgagttagagaccaaaaatttggtttgaaatcatcgaacatatagatcaattagtgtggaattattttagtttaattaattgtcttagagtttgaatttatcctggatatgtagttatcaaataaggaataactttgcttccctaaaatggatactatgtgctatagaaaagaaaagaaaaaaaaaaaaaaacagttagaaacaaatttttagcctctaaaatggatcaatagcgactgaagaatcaattcccattttatttcagtcactaactgaaaattttgtctttaattcaataacaactgaaaaattattatattttaattagagaccaaaaattcaatgtttaaacatatgagtttgcctaaaaacacatatttgagttagagaccgtctattagtgtataaaatgagttaatagtgacaaaaaaattgtctctaattaaatttcaactagagaatattagtctctaattatataattaatttttaagatcattaacaattgaaacattagtctctaatagacggatttagagactagttattttggtttctaaatcaatttctatagtaattgattattttcaatttctaaatcaatttatgtttaataaatttcttgtgttaagtatactttgtttaccaacaatggttagtttaagtgatcggagtttgaacttcttaaacatgtgatcagatgttcgatttcttattggtaccatgaaaaaattattgttggaaagagacaactcattgatgagtgttaacagattctttgaaggagtttaaaagttttgataatcaatcgagatatttctttgcaattagcgcaaaaaaaaaaagtataccttgttttagaaattattggaataaaattcaaacatgaggccacaatgaaattattaaaaatacaattattaaataccaaaaaaaattattaacatatgtagccattctttatataagattagataaaatgatttacaaatttatggcttaaccatataattttcatggtaattaatgtgtagaagccaaaatgcttgttttttgatatcatgatgaagatccaaaatatcataaatattttggtgtgtctaaaatatttttggaaatgagagacacaaatgtaaaagaactttctcccttcatagaatcttggattctcacccctcctatggaataatttaagtggaaaacttaactaaatattctttttcaggaaaacttaattccaaccctcctaattctgcagtcattcatctgtgatggattcgggtatgcttctgttttctaattaatttatatacctttaatcatttgacaaaaaaaaacccttttatttaataatggttatcatgtttgatatcttcctcatttctaatacaatttgcttgtacaaagctcttcaatcactgttagcaaccaaagctgactgagacattaggctttaaatgggccttgcaagtggcacgagaactctcctttgataaaattatggtttaaactgattgcctacagctgttccaagtttggacaaagaagcaaagacaagctttctcctattttgagactatggaccaatgcagagacaagcttttgttcgatgactccatgtacagacattcttttctcatcaatgcatgatatttccaccctttacgcaaaaaaaaataataataataaaaataaaaaatcattgaattctgcttgttacgttctaataatttgtacgttgttgcgtgtttttaatgaagcaaattattgaattacgatacgattcaattttttttttttttttgcatttgaaaaaggttattctatagataattaatttcattaccgtgatgtgtaacatttttccttttacaagaataaccagatgtttttttagatggtgtattaatagatagtcaacccaataataaaacatctataactaaaagttttaggcctatcagtaaaaaaagttttgttattaatttttataaatgaaaaataaactcagaaagactaaagttgatgagtcagaaaggaaaggaaacgggttatcaaacaaagaaaggaaaaaagaaacgaaagaaactcaaaggagtattgtcgcctttttttttttaaagaaacaaagaaaggaaaaaagaaacgaaagaaatcaaagaagtattgtcgcctttttttaaaaaaaaagaaaggaaaaaaaaacgaaagaaactcgaagaagtattgtcgcctttttttaaagaagattgaattatttatatcatcatcaatgtactactgcaactactactatagtaattaaattatcactactctctcccttcaattattttaataagatagatctttaggaaaagttacaccactagatattattatttttgtggttatttttcttttaagttagtgtggcaattaatagcaatagcaatagcaataaattaattactaatattttattatttaagcaacattatttatgactaatatatattatcggtaaaaattatttattaagacaattattaagaatagccagtaaaaaaattatattttattcaaatcatatctaatttttatttctctttattttttcttttaaaaattgtgactaacgcactaatactttttttagtaattaatcgttctctttcttgacatactttctcgcttttaatcgttttcttttcaacaacctctctcactcatcacaatgactttttccaatcattcattttaatcatcctctttctcaacgacctctcttttttgtaatcactcaccgcatttgacaaataaatatcacttttataaaatgtgtattatctcctttttctaaaaacttatcaaaattaaggagaaaatagaagaaatggaagagacagaaaatgaagagaatccatttccctagcaaaaatgcttctcatataatgcttttagatatctctgtgtttattttttagagcatctccaatataaaatatctatttggatttctttatcaattttttgtggtctatgtggtatttttttgtggtccctaagtgtcatgtcactcataaaaaattcacccaatattttattccaatgcaagaaatcacaaaatactcaaaaaaatccacatatttatatttttttaataaaatttaatatttttttcaatttttataaatacaaataaaaatatgaataattgaagaaaaatgaaatataaaataaaataaataaaacataatgcctaatcatataaaataaaattttacataataataaataattaaacacaataacatcgaagtaaataaaaaatatagtgattcttattccatcaaacgactattttgtttatctcttgcaattttatgtttttcatcacttcctttttttttctccttttttgatgcgcatttcttcttcacttcctatttctttttttctccttctttgatgcgcctttctctgagccttcttcacttctccttctctgtgcatgaccttcttgatttcttcactcacttctccgcgcctcatcgaaggcccttcactcgagccagcttcctcgcgccgcgtcctctgttgcggtcccttcaccgtcgtcgggcgtccaccgtcgtggtcccttgtcgtcgtggtcccttgccatcgcgatccttcgccatcgcgatccttcgccatcgcggtccttcatcgtggaggtccttcgccgtcgtagtctttcgtcgtcgtggtcccttcgccatcgcggtccttcgccgtcgtggtcccttcgtcgtcgggccatcaggttagttattttccctcttcctcgcgctagtagttgatctaaaacgcatttctctctcctcaagtttgcgttccttatataagaaacacatttctcccttcaagaaccaattccgccacataagcactctacagtgcaagacttcttcacgaaaccggttcgtcatcttaaggaacgcttgaagataccgtgttggagatgctcttaatgttagaattttgtgatggttttatctttcaaataattgtgtttgtgatcataaataaaggaacagtagaagatatgagattgatttgatgataaaatgtgaacgaaaggagagataagttggagattcaaattctttggctgataaaaattaataaactaataattaatatttattgataaattaaataaataaataaaaggtagatatatcaaagaagaaaatgaatgattgagaatggatgtatacatggaaattgacggataaaaaagaacaaaacatgtaatgtatgttttatctatgatattgataaaatataaatttttaaataagagtgttcgtgggtcggtttgaatcggttttggccaaatttaggatcaactcaatcaaatttgatcggttcggttcggttttcagaagaaaaaaaatttgaaacacagcccattcatgaacggtttggttcggatcaccgagttacctatttaattttttaaaaaaaactattattttatatcacgattctttcaaatatctcatacaattaacataatattatcaaatgtatgaaagtagtaaaattgattcatataataccatcaacataatattctaaaataaacttataatataaattaaaacaaaagatttttgaacaaaatttagtataatagtctgaatcacaattgtttcttacaaaccaaattttgttataaccaaatttattgtaaccagatttgctaaaacaaacaaataaacaaaatatgattcattaatattataaacatgataaataaaatatgaaaaaaaagtgaaacaaataacgatatacctgaaagttttttaataaaaatgtagatggtcaatttaagtcaattgatatcctagctttccagtcagaagtaacacgtctcaattcatcaaaaacagagacaaaattggtatcctagtttcccatatgtgactttttctaaagtcaaaaaagaagaatacaataaaatagttacatttacgtttctattccttaagcaaataagtatctttaaatcctgatggagagttgaagaatcagacttgtcaaacgcttctatatgatctcacaacaattctctcaatgatgcaaacataaactctctaaactctaatattatttggaatggaatgcatacatgaacaccaaaatatgtttctatttatactaatttaaagaattttttaatacaatcctaaatatattctatcatagcaatcttaaaaatattctattatattatgcaatgcaatcttcaaaataatctatcatattttttaatgcaatcttaaacatttacaataccacacctttttttattgtcaaatttttaaattttttttaatatatatatatataaataataaaatttatattattattatgggttcacaggtttggtcatcaggtcaacgactctgtaaatctaaacacgtgacccaacccgtacatgaacggttttgattggttcgattcggttttgacctaaatatataaataacccaattcaaacggttcggatcggttcagatcaattcatatatacaagtgacctatactcatgaacacccctatttttaaacaacaaagaagaaaatatattaagaatatcccatacagcacaagttgtaccaatattggagcaaaagttacagaggttagagaaagctgaataattgaaaatagagtccagcgaataaacaaacattcctatcaccggcctatattacccggtaccgattccatcatcccacgcctgcaactgaaaacccattgatgtgtgcatctaatacaaatacttcattacagaaaaaaaccaccaccagtagatacttagcattgaaaatcttatacctcccacctactaccaacatcataagcatgtccttgcatagttatgtcctaccgatatttaaacagcactttgaaccttggagatttattcctttgtgcaataaatattaattttactaataattaatctttattaaaaatttaattgattatttttagtgaaatctttatttctattatgttttttatattacaaggttcaaattcaaaactttaattaaatatatcaaattcaattcagtatcactcaaatcaaaaatttgttagtaaaaatttagtgttaagtagatgaatttaaaatatcacaccgaataaagttaataaataaataaagcttataaaatagtaaaagccgacgaaagaaatgttatgtgggattgagggagtccattccaatatgggaaacgaagtaacttagaggtccatttgatactctatttgttccaaaataattattattatatgttattttatcatacgaagaaaaattaagaaataaataaaagcagtaactttataatattaatattataatatcattaatttatttataaattttgttgtacattattggtcttataagggatataaatgagaaaagaataattaatatcatattaaaaaactagaataacaattattttttacatgataatcataatgagacagactgaaagagagtattacacttcctaaaaatgtactttctccattttttatctgtcttttaagattattatgtaaaaaataataatttttttaattctaataaaatagtcacgtgatttcctttttgccttttttttttcttatttcacaataaatgcatgagcaaaataattaaagattagaaataagtatgaatataattgataaaggataattaatgtgatattgaactttgtagataagagataaataaaacaaattaaaattttccataatccaacaacacttgaaaagaaacagagggagtagaatatgtatctcctttttttgttgtcctgactcttcataattcttatataatagcatattatttaaaatagtatgagaagaaaaaaaatagaaatattaattataattttaaaataaaacaaattaaatgaagagactggttaaagtgtccaaagttagaattttgggtgcgcatataatcgcattaaatactcaatataaaacttttcgttcataaagattttattcaacttaattattattaagatgatcttcagtaaaaaaaaatatatgtgattaaaaaaaagtgtttaaagtggtgataactatattttgtcaccgcatggttgtcatagatggcataaataattattatattaattgaaattaatatttaactcttgctatagaagaaattttagtttttaaagattttaaaagaattttctttttaagtactgtgtaaaaaaatttgcactaacaattattagaaatcatcatcggtataattttaagataatcattataaaaattaacaaatttaactaatcatacctgatcatttgtaattaaatgataatctaaagactatttacattatatagactatatatttttaaaaaattaaaaataattaatttcagtcttaaataatcaagtcattactatttaaaagagacccgtgaattgtgaaaacatcaaaaccttacggtattcttaatataagatattatttagaagaaatagataatcatttttataagacattttacagtttctttgaagcatttttttcttattaaatactctacgtatctttgtgttttttattgatgtgttctattattttataatgtccttaaactttaatatttttatatcatccataataaattaataattattaataaggataagattgatatattagtaatattttgaaaaagtaatcaagcaaacttatgtacctatttttatcggtgtcttatattaatgacgggagggagtggtaaataaaggcattggaaaagtatacataaagaataaaagtatacataaaagacattggattagtgattatgatccaaacacgcaagtgtcttcttagaatgttttagcgtgtgaattgcaaaaacttttgaatgggcatcttaagatatggtaagatttgtctttcattattaaaatttatcatacttttagacatctaaatagtagaaattaacacttgattgacactttataagtataatgatgaaattaggagagagaaataatatataggtgttagttatgtttttgaaaaaaaacaagtgttcaaatattattgttttatgagattcttcctatgtgtgctctaaatttttacttttatacatttaaaggaaaaaaaatcaaacaaaccattaattattttaggtcttgaagacggacttctgaaaaactattcttttgttaaaactacttctgatgagtgaatcctattttgggaggttgatatatttacattaatttttctcgagtttaactcatgcttcttaatcaagtcttattcttaaaatcacacctgacaaatcataaaccaaaatgatatatattatattctcgaatttaactcatgtttcttaatcaagttttgttcttaagatcacacctcacaaatcataaataaataataatcttaagtcttgaagacatagaattacttcttgttaatttgttattattgaaactttattgtataaaattatttgcttcctcttttctctatctttatgtttctttttattttccacctaaatcttatattattattacttttactacagattgcttaaatgtgttttcaaagtacgatgactttgaaaaggagttaactaagtcatgaaataattttcttacaatataaaatcataaaaagataatataaatttatgtatattatattatttaataaaaagttatatatatgaaaataaaatgaaaactattataattctttttcaaaaaaatatataatcaccaaatttcaagttctcataaagtagttaattgcccttacataattttgcattatccatgagttaaaaggtaagttctatcgaacatttttaactaattagttaagcatatcaactttcactggacaaacttttcagcttttaaatgattaactgctaatttgacaaaacattgccaaacgttcactgagtgccacagcagcggcatctaatttgattctataaaagttatacacaacatttttttattttttttttgtgttgggacacaacatatatcgtgcaaaaagacgcaaatagaagcacatatggtagtcaataatatccataagtatagtgtagaaacacatttttattagaaaatttatgagaataaatattatatgttgtttatggtacatttttcaaagaaaaagagatttaagattggttgagtaattaagaaagaaagaagaaggaaaaaatttcaatttgatcacttttattaataaaaataacaaattaataaaaaattaatatttattgataaaaaaaaattatcgaaaggagttgttaccgacccgctagtggacaggaataaaggtgtaaccatgcaaattcattttcaccacccacaaatccaagctcaagttaatattattcaaattccaaaaattattaattgcaatggctattgacagtacaccaatatgaagctcacaaattggttttgaggatgcaaccctgaacttgcatgtcttccttgccacgttgtatgtaccttgctatttatttcctgcacgcattgaaatgtatcatggtattgccaagtttagaagacaacaaagaagtctcatcaacaactactaaagtctttttgcatgtatcaacttgtgatctcaactctaaaaacacagtaagtgagtgcttaccactagactaaaaatactagactaaaaactataattaatagttaggacataactttttatgctttagagcattagcctaggtgtcactattcagtgtaactcaaactcacatctgaaggcaagaagctgaattgttggaatatagtgtaaaatgaagttccacattaaatagaattagaaaaataagtacgatatatataagtgaggagaaaatacataaaatggataatgcaaaatttgggagcctcatgtataatgaaagcaaaagaatatgcatcaacacttctatcaattaaaacttcatcttttgtaaatctttataataatactatatcacaatatttcttgaaatgcttgtccattttctttacttattttttcaagtatggatttttaagtattttctttgctctctaagtgttggttgtaatttgtatgtgaaaaaagttaaatatcataaatttttggagctaatcaaaagacatggtcatggaattttatatgattgtgataattttgtatgtgtgtggttatttggtacacatatagtaattttgtacgtttgtgcatcatctatcatttaaagattacagaatcatctatcaaatttaaatcataattgatcatattctttaattaagaaaagatagaaggagaatctccacaatattatagataagaatgaacttctctctttgaaagtagtttaatctttagttttattcatatctttttacgaatttgtgagaaatttgaggcttttgaaagctgaatagcggaacaataccgttaggatgaatcatgatcattgttcttgctattgtatgtctatgtttattttttataggattgttagttttgttctaatcatgagtgactagccccctaatcaaagattatgatgtaaatgtccaaatgtattcttatccttgttcttaatgaaatttttcatcattttatgttaattaattattttccttggttaatgtttatttgaaaccggtcatactaatactcaattaattgtataatagtgatcatctgcatgtaattggtagatctagaaaatattttttgtaccaaattgcatgatcaaactgttttgtaatatccgataaattagttaatctttaattaaacatacataaattaattttatcatttgacttaattgataatatatgatcattagagtattgatttaagacaaacaacatttctgatcttgacttagtttatttttggaatccacaattaactaggaaagatatttcattggaatgttgatttaacgcacgtcaacttttagcttttcatccttttaactaatgcatctaaaaataaaaaatggataaaaaatttcaaaaaaaatttataattagtaactaatggaataatagctaatttgaccaaacacattgctaaacgttcgttcaccgagggccacagcaaaaagcatctagttgactattgaggacaaaacagattccatataactaaagtcacagcagttggtagacataaaaagcaaaaagacgcgaatagaaacacatttttataagaaaattctagagaaaatgttatatgtcatttatggtacattgtacagagagagttgttccagaccctctagtggacactaacataggacgaaccatgcaaattcattttcacgctccaattaatattatttgaattccaaaaattattaattgcaatggctattaacagtacaccaccatgaagctcacaaattggttttgaggatgcatccctgacttgatgtcttccttgccacgtggtatgtaccttgttatttatttcctgcaacattgaaatgaatcatggtaatgccaagtttaaaagacagcaaagaaggttcatcaacaagtagaacagtaatatcagtctttttgcaactagcattgctcaaatctaactaaatgcccgagtacagacacaaaccacaagggatggttgattttatcatttcaaggtataacacttcaccgtttgaattcctccaagacactaaaattttataaggatatccgtctaggaatcttaccaagggagtttaaaagtatctttccaccatccttgttttgagcaatttgcaacgattttgtccaaccgtgaaatgacctgagaaaatgttggcctgacaataggtgttggatcccaacattcctcaatcaacctgcatacaccatgatactaagaccgttttttaaattaaactgaagcttgaagacataatttaacttcaaaatacactaactctttcaactcggaggataatgttttgttttgatcttgaatgctggtcttttcccttctaagcacatcagtctaactgcctcctccgaggacatgggatggaagggatgtgtaccctctatcatctgggtccataaagataataaataaaatttgttgatttcaactaatatacaataacatatgaagattagagagataaatttagaaaatctaaatgattttggaaaagctagatttttttttttcatgaaaacagaagtgcatcagtaatcttagggaactacaatgttacataacagacaagaaatgtcaagacaatgttgtcaaattcctcatccttcccccagcccatgcccttctgagctctgtagattgagtgtttaccactaggctaaaaactatagctaatagtttggacataactttttccactatagagcattagcctagacatcactgttcaatataactcaaactccacgttctgaaggcaagaagctgacccaaagcaataaaaacaagaatctcaaagaaaaactaattggaaaactaattaatctgatataagaaatcataacatgatgggtgatgcaaaaatctggtacctcgtatataatgagaccaaaagaatatgcatccacacttctatcaaaaacttcatctttgtaaatctccggtgccacgtacaagcctgcaatgaatacagccaaatcattaattgaaccatgagagatacttttagcaattctaatcttcaaatatttttattagactaacatataaaacactataatgcttgtccattttctttacttagtttttcaagtatagattttcaagtaaattgcattgaagggccaagggaacatcatttagaaacagaacgagtatcgagctatcaatggagaaaattactctccaggtgttgagtaatttgtatttgaatctttaaatcataatggcagttaatttgtatgtatacttcattcatcattgaaacggaaattcctattgcattcacaaatctaatatgttgaaccagttacaattaaactgaatcttaacgcaagaaaatgggacactggaaaacaaaaaccttcaaataaacttggaaggagacaaaatccaagaatttttttttaaaatacccaaaaacttacttgaaagatcaatgttaggctcaggctgtaccagctttgcttcatcaggtgacattagtgaaaatctcacagtgccaaatccagctatcttcaattgccctccattattcagcaaaatatttctggcaccttaccaaaatttcatatattaaaggaacagtacgagaaaaaatctaattcaaaatgcactcacagtcataaataaacatcaaattgtattaagtgatcttactttggctttaaatcacagtgaataaccggatctggtttgcattcatgaagatagttcatgcccctgctaacaaaaaaatatcaagatgtcttgtataaacaatctggcagaatctccaataaatttataatcatttggtacattgtaagcttagcaagctaagaaaatgaccaaggcgacttttagaaatcaatgaccaaccatataagatataatagaagtaagaaaggacattaaagtttttcaaagatgattcacagagatttcgtacagcatagttccttgaaatggttacttgcctggcaatatcaagagcaaaccgtagaacttttgatggagacaaacgccctttcttttgaagatagcttgccaggtcaccctgaaaaatcaacattgatatgagcaaagaaaagtgagttagatacaagaaacttattttgcaaagatacagagaacatagagggtaagcctaccttagaatggtactcacgcacaatcatcataggtatattctgggtgacagctccaacaaactggaccacattcggatgtcgcaccctttctaataatgtgagttcatgtttgaaagcatttctgtgtgaattattgaaatggtcaaaatttagagccaatgttgagtaattaagtacagaaaaaaaaaaaaaaaaaaaaaacagctatttagaccataatcaacttgaccagaaatcaaagtgaaaagtagtgatatatgcagtcactcggacaggaaaccagcatcaaacaacccggttgattggcaagaagcatatcatacagacactcacaagtcacaacaaacattttcaattgctaaggtgtatacatacatggtatcaggatttgaataactgtccttgtcaagtatcttcactgcaacctttgtgccattccatttagctacttggtatgttccctgcaaacagattgaccaaagaacaatgaagaactaaacaagcaagtttaacccctaatgtcgaatgtttatagatacattaactcaattcccacaagtatcaacaacttttattatacatgaagcatcagcacattaggtaccaacaattatcactttgctggtattacttgtaataaaccaaaagaacaaaatttaacaggaaaaatgaaagatttggggaaaaatattaaaataaaaataagatagttgccaaaggaagcacggtgcataggtcgcgaaatttggcaaagcaaatatttaatgcacagtagaaaacatcacatgccacattactagtcatgcaaattacattactaaagcaaaatgttacagcacagaatctcaattgaccaatttgaaagcaacaataatgctccctcagagtgagaatagttgtgtcagttgcaagaatcaacatgccttaatttccatgaacaaaacaaataccatgtccaggtggaatccaagttgtctaataagccaaaaaagccataactattgaataaccaatcaaatgtaactaagtgaaagaaagagaaacatacctttgaaataccatcactcttccgaacctgtagctctaacgggttgagttcatattccggaacttcacgaggattcgcaacagtcattggagtcttcctggttttctaaccacgtcaaagataactaatcagtaagtccctaaactgaatccaacatatttacacttacttattgatccataacaaacaaataacgatagaacaataccggcacttttgctccacgagccttcaacatgtaataaatttctgtatttccataatatttggcatcggccgccgcctgcacatccacacatccatcaccacttaacacagaaaatcaaataaattttgcactctcatccgatctcaaagatttgtatgttaaagtttattgatttgtttattgtttacaaattaaactcatcttgataataacaaagtttaattgccaattgccatgcactttttatattagcaaccaatcaaaggtcagatgaattttttacagtaatcatcataggtatagtttattgaattttatgtaaactaccttaaaacttaaaaagttatatctgacataattttttttatcaaatgacaatataaagagtgattattttcacgatgatagtgtcatcgtggatataaacatttttcatcatgagtagaaacactctttaaactttcagcatacagagttgtaaaactaatttctcttttaaataatttttaaaaattaacaaaattattatttatgactataacttttttcaataataagataatatatggcgaggagagaggagagagtgaaattacggtgctgccccagcgatcgcgagcgtcgaggttggccttgcggctgagaaggagcctgacgacttcgacgtggccttcgcaggcggcgacgtggagggcggtgcggccgtcgaggtcgatgctgttgacgtcgatgccttcgttgagcaaatcctcaactcccttgacgtcgccgcggcaggccatgaagaggagctgcatggtggagtccaggttctccggcacggtgagctcggcgttgtcggggccggggctgcggcgaatcggatcgagcgaggactggcggccgaagctgaagcgctggttgatccgccgcggatccagcgaggcctgccgcgtgaactgccgcgagaggttcctccgcagcgaacccgacgagaactgccgcgagatgccgcgcttcagctgcgcggcaatgctttccatgccgccgcccagtggaggagaaggaagttgcaacgcaacaaaataaaacttctcacaaatgaaaacaacaaagagcgcgctctacatgttgatatggaaccaaccctgtgcaggttaggttaggttcggttcagttcggttcggttctgttattccaaagagaaaatgaaatgaatcacgcgaggaaacgcgattgcgagaaagaaggcacggatgtctctctctctctttccatcgcttctgaattgccgcaattagacgagggtggtgtgatgcgtccatgtgtaggggtagtttcggttgacttacggggactatcatggttcagtttttttctttttttttcttttctgaaaaaaataataataattaggccaatatactctgacattataataccccgttatacctgtacgtaaatgcttggacccgaccaatgtagcaaaaacaaaacatttgtaatattttttttttactctaatctattttataacaaattaatgtatatattaaaataaataaaacttttttttcattttataattgcaaaactagctctcattactaactgtagttaatatgttgttaacttccttacacttttctctatctatcttcaattattatatactagtcgaaagatcgaaatattctgtacttttctatattttttaagatttaaatacatcatgtttttaatttagttgttattataaaaaatatcttgttattttggtttaatatatatactatatatattgctttttaatctctatcatatttttgttcgttttacattaattccttttaaaaaataagcacacactaaatattttagtaaagctttcaaacagttaattggatcaaatctctatcatattattgtccacttgtttatttttaagctcacactaaatattattagtaatctctatcatattattgtccacttgtttatttttaaacacaatttcaatcctaaactttgaagtcaagcgatgcatgtgtgatatttttcagtaagattttaagtttaaattttatctcctaataaaacctttaactagagagttgactcaaatgttgtagatcatatttctaactcaatgacccacgcagtttgactcattcaaactatttttcagtatttttaataattcgatcagttcgtatatagataatatataatataataataatacatgcaattacagtgtaaagaacttactctattattcaatcacatgataattatatttgataaatttattatttttaatataattaccttaaaattcatactataaatgttttaatcagttaaaaatatacacacttttacactgaccatgtaaactaaactccataaataatatatttttggtaatttttaaatattaaaataatttatagaatttaattaaaatgactaataatatattaatatggagatgttttgcatttcatttaattatacattttctgatctgttgattttataaaattattttaaaaaatatatttaaagtaatttctaattaattgataaagcactaacatgaaaattaaactgtaatttaaattcaaattaacttgctgcaaatataacaataagtctctaataaaactataactaaacaaactttcaaacttaaagtgaaagagttcatcacaaataatgtgattaggcatattagttacaaatgactcgtatataagccaaaaaaaaacattcttatatttaggcatggcaacagggtggtattgcgttctcttccccgccttgactcaaaaccactccccatctcgccccaatttccgtcagattttaaaatccatctccatcttgtcctcggtatttgattaaaattaaaaaaaatatagcttttttattgaaaaattggatgaaaaggctaattacttaaaaaaaaaaaataacaaactcacattaaaaatatggatcataatttaaaattgcaaaacaaatcaatcaattcaattaaaaattacaaaataatatattttttttttttttttaatattatttattacgaggcgggtgtgggtgctgggcggataccataatccatatccgccccgcttttggctatgggggaaactcgaacccgaattgataaactcgattttttcccgttaaaatcagaacagattcagtggtattcacggattcgagtccgctgccatgcctattatatgttgaacttaaataaagtaaatttaaataattttatcttatttaatattatcattcttaaaatactctttaattaattctaattataatttcagtgactttttttattcatgaaacaagtccaagaataacattttagaaataatttatttttatatgagattagaaaattaaggatgtcaactaaatttttaattagtataaattattatttttgtttatatacaattcaaaggaagtaccttttgccataatcaatttaaaaaaatcaattataaaacgtatcttttatagtttaattggaaatgtctcataattttttttatttaagtaaaagttataaataaaaattaaggaaatttataaatagtttttatactaataatatatttttactttatagaataagtaaagtacagaatttaaaaaataaattatttaaatcaagacacgttttcttttcgatgtagtgtgttaaattcaaaattttaaaatcaaatttagattaagatggaaaaatcttaaatttaagtttgcaaaaaataattatatgttgacagtgtaaaattttttatcatatagtttataatatagaaaggattatattattcaccttcttataataataataataatatattttattaaaataagtaaaaaatatataaagcaatttagacaaacaaactaaaaaaaagtttcttattttattaaaataaatgcttagtcaataaataaatttaatcaaatttatcatatactttgtaatataggaatggattatattatcaccttcttataataataataattatgatgatgatgcttttgctttaaatgtttttattatggtctaatttggtgttttgaaagaaaaaaataaaaatgtgaatttgatacaatgctagctagtactaattaacgtattatttttattaactatatttttaatccctcaaattaggtcactttagttttggtgtcgtaaatttgaattttattttttttagtctttaaattttgaaaattatttttttggtctctttcacagtaaaaaaacatgtcacaaaccataccttcaaactgtaaaaataatgcagaaaggtctaaaaagttaatttttcaaattgagagacagtaagagataaataaaaattgaaccaaaataaaaataatataattttaaataactaaactaactaactgtttctctttggatagctccacatgaaactgtcctcttacaagttttcctaaggataagcctgtactcaagatattttgatgcacaaggccatagcaatttacaagtacatggaattaattggctacccaaagatgaaactaatgaaatcgaaatgtctccatggggtcagcgacgacttcataattaagtacgaattgtgtcgcctctgattagattacatgtgcaaaaatacaattatgtcggcttggaccaacgtgtgtttaaaaataataattactacatgttgataattctgctatacttagtttgttttttgtttttaattgcatcttggtgacctatgtctttggaattggaatacttgttaaggaattcaatttttaatgaaaaaaaatgttttttttttttttttattccttcaccatttgctttttttttctgtcaacaaaaaaaaacagccatttgcttcttcttttttattccattgttcacttatttttgttttctattcttttattacatcatttattttatatgtgactatctttcttttttttttctacctttttcattacatctgctctagtacttaaggtatctcacaattaaaaatttaagaatactgatctcttaagttgcaaaaaggttaaattagtttatcactattctaatttatttttaggtttgattttgtcttttaattttttaaatttattttgatcttttaatttttaaaattaattaaatttaatttggctatctaaattaggtcaatataataacaaatcataatttgtgataacttaaaatcaagatcaaatttgaatgatatgatcactcaaattattttagatagtagtatctaattaataactaaattgaaaaaaaaatgagaggattaaatggaaccaattttaaaattaaatgatcaaattgaattaaaaaataaataaaagaccaaatcaaagttaaaaataatcaaaggaaaaaaaaagctaatttaaccttaaaaaatcatttaagtaacttttttcccaatatatacacgaaccttaaaaccaatttttaactacgcatgcaatacctcaaaatgaggcctacatattaatcacttctcacctaaaaatggaaagataaccacacgatagtccttgtaggccacccatactaaagcattaaagagattgaaggtttcctttcttttttgcaagagacaagaagatggacacctatgaaatgtcattttgtgcgagtatcacatgatcgactcattttttgtgataaaataatatatttagtagtcactctatttataattttgtctttcttatgtctttttttattaattttctatttgcctcgtctataaatgtttatgcgtgtctcttaagaatgggatatatatatatatatatatagaaaaatcttgacattttaaggaaataagttacaaacttttagtatttaaaaagactaaaggtatggattgaattgagattttataagatttcaaaatactttttgttataacaaagctttgcgtatctaataatcttttaaaataatataaacaagtattgtagtataccggtacttaatcacgataaaaataatttattgaaatatcaaaattggtgatatttaattgacacttttataatttaaaaagaagtctctagtattaaaaaccatataaattttaatggattttgtatacttttttagtgatatataatgtcacatttgtccaacaatcacattcaaattcctaagtctttttgtcattgcatattttattttctttaatcacaattttttttccttgaaggtggtataaaatattggtacaatatttgatcatttattttttcccaatagtaaaaaaactttctactatttttgtctttaatcaacttgtttggatgaattaaatgaatgtatcaccaaaaagataatgtaaaaaatatataaagatttttggatacttgaactttttggttgcttgatcaaaacaacactgacaatctttactttgtaggaagtatattatgaatcgattcatttataaaaagagaaatattaactccaacaaaattaaagttgctacttttgacacgcacagtattgaaatttggactagtttctctttccatttggagagcaacttggtaggttgcatttcaaaagtgagttgtcaattgcaacaccggtttctcttacagtgcagtggaccctttgcattatattttattaaataaatgaaaagttgtgtctttaaaatattgtgggattcattttgagaatctttagtgaattttttgattgagtaaattttgattggattgtttagagtaagaaaataaaaaatatgatgtgatattatagagaatggtgaaatgttattttaaaaaatagaagctaaattttgatggatttgttggttaaaaatgttctaatggtagaaagttttttcttgcatttattttaatgtgcatgtcagtggataatgtcagaaccatattgacacacttttttaaatactttatgtaattaattgaaatttattaaaaattacaaaaaattaatgaatctcacattttatttaatttaatgattctcacttaaaatgtattgctaacatcctcttataaaaatattttcccgttgtgcttttttttttttttaatgcaatcacgttgttgtgaatcaccattgtggttgtgcatggcaatttaaaaacattgcaatgaatagtatattcaggataatcatttctcagcccttagtgtcatagtggttgttaaaagatgactttatactcacattggtttttgcaatctgagaatccaacttcaaggtaaagtgtttgaagacacggttccatggtatagcaattccatggaaaattgccagcatacagagcaaaaaccaatattagaggcataggaaaacactacagtacctaaacactcctcccacacccacagcatctttcgtccttcagataagcgtcataattcagcttaaaatgaccagtggaaggatgaatataccgaatgaaaatgaaaatgtatatacgatattggattatgctataaggtgatcatagaagaaaattattgaatatatttaatatatatattaaatattaatatgtttactgttaacattcgatattatgtcgtaatatttcgaacactcaacacaaatccttctctttcaaaccccttttaccttcaacaaaaatgaccagaaggatgaaaatgccgaataaaatgaaaatgtaacatgtcactccaacaactttgaataggggactcgctcacgttgctacaaaatttccgacagccccctgctttgaatctacggtgacaggaagagcatgatgtagggttagagtttaatttttatttcacgttacatcatttattataaatataactggggaggggttgtaattttcactttaaagcaattaaaaggtattcaaaaggatttttacgaaatttattcgaacttacaaaaataacttgcgattcttataaagtagtatttttaacttattttgataacttaataattaaatttgggaacggatacacttattttagaatatatgtttttgacactcatattatacttaaaattaaaactaaattgtaaaataataatattttatttttataaaaaattatgaagttgttttactataaataaattctcaattcaacacttgaattaagaattcaatctttataaataaaataagttaatcaaaatgcaggaaatgattattaggagaatcatattcaatttttttgtaagtataattttttagttaataacaatcacgtaatacaaatcaattaattttgatctaatagataatttgaggctcatgtttttttacttaaaaaaataaaataagttaaacttcctcgtaaatcatttcccattataaaattggcataattgaagcttaataaacactatcaatttgaaataatagtagtaacaaacgatctttttctaacataaaaaaaaaaagaaataaaaatcgccgcagtgcagtgaaagcagtagtagaagaagaaaacacgagttacgcacaaagacacacactcccggtgccgccaccaccaccattgctttcagtctccgaatggcaaccactctaactccaattcaaaccctcaaattccgttctcccaatcccaaacctctctttctcccaaacctccttccatctcacacctcacaccttccgcgccgataaactcactctctccgtctccgccgccacctcctccgccaatggttctccctctccccctcccccgctcgctcaaagtacgtcctcctattccattccctttcactcctctgcgtccgattaattactgttctgttctgttccgattcattactaattgatgattattattgacaatgcagggttcgtcgacacacgatttccgtgttcgtcggcgatgagagcggaatgataaaccggattgccggcgtgttcgcgaggagaggatacaacatcgaatcgctcgctgttggcctcaatgaggacagggcgctcttcaccatcgtcgtgtcagggaccgataaggtgctgcgccaagtcatggagcagcttcagaaactcgtcaatgtcttaaaggttcaccgtctttttcgtgacataccaattccgtataactagcgtttttattgggtgtttttgtgagatgccatgtggagaaagtgtttgatagtgaaattagtgagagaatgaatctgaaggaaactgttgcttatgctggctaggttgaggatctttcgagggaaccacaggtggaacgtgaactgatgctcataaaagtgcatgcggatccgaaacaccatgcggaggtacctgcttagtggtttgtggttgttgtatatgtatgcatctgttatgttatgtgtgtgtttattttgttgattgcttctatttgtttatttttgctggaatattctcagttgaagtggttggtggacatcttcagagctaagattgtggatatctcggaacattcggtgacaattgaggttattgctggagacctttaaatatgttttaatttttaatttccatgttttagtgcatgctctgtatttatatgtactcaaatcaattggatgtatttatatgtactcaaatcaattggattgtacttgtaaagtggagaaaaatatcattgttgtttcattaagataattatttactattggaggtgaattgtgttatgagagtatggtacagtgccttgtaaacagctcatcttgggaatatactacatgtattcatatactcttccttttattgcataaataataatggtgtaattacgaaactaaggttggagtatgactataatgtggttgacttgttggactggctgtttttatgttattttgttcttgataggagtctttcatttttacataaaataggattttgctcatctttaaataatatcatgaataaatagtgtgctgatatgagctgggtagatattttttaaccttatttgtgcaagtgtttgtttcatattttgattattttcttttccatctacctattacttagtcacaacacaaccattaccatatcattacttgcaatatgtcattagatattcttggtgataaaatcaggtcgtaatcttgggtgaattgttctgctaatgttacaggtaactggagatccagggaagatggtcgcggttcaaagaaatttcagcaagtttggaattaaagaaatagccagaactggaaaggttggaaagttcaattgaatacccaacaaatttccttaacttttgtatcttgtccattttgttgagcattatattgtaaggctgtgcaaaatttactaattcattattattggatgatgtaactatacttagattgcattaagaagggaaaagatgggtgcatctgctccattctggcggtattcagctgcttcttatcccgatcttgaaagaagaacacctgttaatgcccttgtgggagcgaaaaatatgaaacctgttgccaaacctgatacacctgtgggggtatgatcttatctactcttcaactctacggtttcctttctagacctatgtttgaacacttcaacttgaaaatttaaatgttgtagcttgaaattaaataattggcatatcctatcaaaagtgttaaatttagaaatcacaaacaagcttagtttcctgaagtaaaattatgctagacaaatattgcaaaatggttttaacacttatgcatatctcaaacactattgatattacagctaaaggtcttttctattgaacatcttttgtccatgtgctttggaatatattcttgttacatttaggttgtctttgactctttccttaacatcaattgttctaatttttaagtttatagaatttcaatgattggctaaagaagaacaaatcagtaactattgcaaagaatgaagctaatgctgacataaatgcactccatcactacatgattgatattttccctcccttctgttctttgatttgtttgctcattattaatttcaaatatagtctgactgtttcttttgacatgtttgcttgtgtgaagggagatgtttatcctatagaaccatcagatggttttacagtcaatcaagttcttgacgctcactggggtgtcctcaatgatgaagatgtaagtggtttgtagtttcttattgtccttaaatgtatccctttttcttgtttccttctaatacattgtagatatatgtacattatcttcattagtttctatttgagtttttggttacatagttgaatatatttgttagaaaatatatggaaatatcctaaatattttattgagaataacctcttttggaatagtttcccaattccttattacctcttaggattagttaccatatttctttattttatcataatatgtttccttaattgattatgattatgatcaatataaataaggcttagtacttttaggtttatgaacatgtcaacacatcaatacattataatacgtctcagttactatcaaccattgcttcattctcttttatctttcttcctcccttaatacctaaatccccagaatcaaacatggtatcagagagggtaccgttctctctcttctgtgccttcaatactatgtttattgtacattagcatgtaatattcatcaattttctgaatgacatgcttgtgactgtcttactgttggtgggataattccttcagactagtggaattcgatcacacactttatccatgcttgtgaatgatgctcctggagttctaaacattgttacaggagtttttgctagaagaggctataacattcaggtttcctttttattttattttataatatttgtgtacaaattgcaagcacataagtccgatgttttggtttctctgttttctcatcttgaatctgctttgttatttccagagtttagctgtaggacatgcagaagttgaaggactttctcgacttacaactgtggttcctgggacagatgagtcaatttgcaagttggtgcagcaactctataagctagtagagctacatgaggttcaaaatgtctttgaaaaagaatgcatcatatcctatacataaattatttgctttgagtaatatatattgttagtgttgctgtttgcattgtcctgtagcactttgagtgcctgtttaagttttttttggagaaatattcacatacttttgccagttccctgagagaagtttaaaataaaaatgcttccgaaaaaaaaaaaaatcccaaacacctactaagtgcagatctcccatcagtgtcctagtggatacagaatttgacatatcaggtttagccaaacatgtgaccctgatagtctacaatgtcacacaactaagtttttttttttttttttttttttttttttgcaatttgtgttgaaacttttgaagtggaggaggaaaaggctaatgcttgattagcctgaaactgtaattccgtggtatgatcctattatattgtaaaatcagcagttatattaggtgttctaaattgcagctacagtaaggatttaggtgtattaggttaagcaatttgtcaaagttgttaggttatttctttaagctaccgatttcaacattgagtatgtaatccttgaaatcttcattgatcatagtgaccttcccccttgtttttgcccatggacgttagcctatagtttactgtacaaaccacattaaattcctttctttttttgtttgtgcaccttgacatgactactagcacaggacatttgtcttgaaagcctttgttggaacttgaatattagcagattttgtgtttcctaatattatgtgaataataaaaagagtattctgaaacttgagatcttgcactggtcttatttttagaatctttactagtttttggaatctttagtatagttccagaattcctatcaaaaaacattctatcaaatctcttacttgaagcataaatccttatcttcctatcttctgtttctttcttatgtattttacctttgagaatgagattgatatagagtgcataaatatttgaccatttttaatgtttacaaaatctggccattgcattcttttctgtatttaaactgatatttcttcaggttcgtgatatcacccacttgccatttgctgagcgagaattgatgctaataaagattgctgtaaatgctgctgcacggcgtgatgtccttgacattgctagcattttccgggctaaagctgtagatgtatctgatcacacaataactctggaggtgaattttatgcagacttttcaaccaagtgatatggcatcgtatttaatgtcaacttatgttgatactcataaacatggtggatactggatacctctatatgtggagagaatgttgaatttagtgactatagtgtaattacaaattgcactaaaaccaattttgtttagctaaatgttacattgttactgtgctacaagttcataggattatgcatttataccagtttaatatctgttggatcatgcatcaagttttgttcaacagccaacgaaaccaccacaaattgggcagggtactagagccccaatggtcctcagtttatcataaagattttttctcggtcatgaaaataaataacattaagctatttatccagcatcctaacattctaagaatcctgttatgcccattgtctgcagctttccacatccatttttttcattgacatgataagctatcagcaatagaattgcttttcttctcatgttaacaaatataattgtagatttaaataagaattgtaccctaacctttgtaagtaactttatttattcttcttccacattaattaatattaaatacaaaagtggggcactgaaatgacatttttcctcaaaaagtgtaatgtagtagaagttaacaactgatgacaccatattggtgcaaattctcagcttttcttctaagtcattatttcttccttccaactacgcctatggttattaaaacaacaggctactgcttttttcttaataaggttatgctgatgacaaaaaattggaaatttgattttatatttatttatttgcttcaaagtatttgctagttttgaaatgtctgccatgatgacgtcagatttacagatcctttattattttgatttttaactaattgatttgcttttgaaccagcttactggagatttggacaagatggttgcattgcagagattgttagaaccatatggcatttgtgaggtatgttttataaatttttttcacttaccatagtagatattttgctagacagtgacttgtttaaattccttattccataaacttccagagtcgaatttggtgcatttacttcctcaaatgtatctcctgattctgtccaagattgtttactcagttgctattattttgttctgaggttttcctttgttttatgggtcagaatattcatactggaggaaagaactcagttttgctggtcttggctaagatgtccttgttttcttttgaagctctgtagaggataagaataggatgagccccctacacaggcagttagctgagtcattcttacacgtcgatgttcattttttattatctacaaaacacaccagtagccattattttaaaaaccaaattagggagtataacagtcaaagaagagggttaagaattgcgtttcaaacagaatttggagtacatgtattttattaaaatataaaaataacaaaatacatcagaaaaaatgaaaaatataccacaatgaataaatataaatttataaatattaaaatttagttttttgaataatttttcactatatatgaaatttggaaaatccttctcaaagtataaacgagtttctctgtagaacaagcagaggtattcacctttaaattttactatattatgatcatgatgcactttaaattcaatcaaagagtgaatattctggcaaatgtttactttgaaccttttccttaacattttgcttccttttagcaaaaggaaaaaaagctggccaccgtgcatgctatacttggtttggtttcttagtgtgctgtgcttcatcctaaaggttcaagattcaaattccattaggaacaagtgggtgtgattcctctaatggaaaagactgttaaacagtcatttaccaaacctgtgctggatcacactcaacagtttagtgctgaaccggccagttgtcaccagttcaaggctagtgcagttctaacatgtaatcggacacaactggctggttcagtcttgttttaagactggtttttgctcatgctcctattgcaccggcactctttactttgaatcagtctttctgatgtttcttattgtttcaggtggcacgaacagggcgaattgctctagtccgtgagtccggtgtggactccaagtacttgcgtggatactcttatcctttgtaatcactttcacctgagtggaagaaccatcaaagtcttaggattttagagcttgtactttctcttaaactttgcctacggattcttgctttctgaactataatgttaagtctttcagtgatttgcaaatgtaggcttgggatgacattgagattaaaaaaaaaaaagttttcctccttctctcaactttgcttcattttttggttgaattacagtctactgttttgtgtagggacaaattttttacatgtcaaaatatttatgtttcgtacttggatgttgtctgttcaaaattaaattccttatattaatgctatcgagtcctatgttgtatgcattaggacattaattttattgcttatgcaattgtgatgttttaaacatatcagtaatatttctcgtattgatttcttatgtttttcgatgaagaataattgtcttatgataataccaagttattaacattgtgttatttatatctatcaatacaaataatggaaggttccaaaatagtcgatgtattattaccaagagtaataaaaattattaattgatagtgcaggattttatgaaactaattgaaattcacttgacattcattgattgagtcaacaatttttttcagagtttttaatgtgcttttattcataaggtttttaatgtatattgatcaaatattagattttgtgtgatatataaagcttaattgtaagttttatgatcaaactttattattttacaaattttatcataaacttttcataattttgtgaatttttactattcaacttttaatattttacaaatttttctatccaatttattatttttatgtatcttattatcacggtaatgatgttttattttatttttaatttttatttgtgacacgtgtaaacatgtaaaattaaaaaattgagtaacaaaatcataaaatgaaaaaatttataattaagcctaatataaatattaggtgttaagttaaccaatgaactaaaatatgatcaaaagtgaagagataaaatttacaaaaataatgataataacagacaaaatgcaatcaagtcaaattaaaaatgtaattataataaaataatgattaaataataaagttaacagtacacatttttactaaaaagtataatttaaccctttaatgtttgttattttaatattattagtcttaaataatctttttggctaataattaagttttaattattattttagtcttttaagattttaaatttaattttagtatctactatcaagaaagtaacaacattaattcatacataataaaattaaaataaaatccattgacttatcacatcacaagacaattatgtaattttgttataataacgtttttaaatcctggtgagtttatcatcatttaacactactacttaatagaaactaaaaaaattaaaatcaaaacaaaaatattttaaatgactaaaatcaaaacctctttttataaagactataaaaagtttttataattttttacatatttgaattaaaatgaagattaatacaacccatatgaatttcaactaacgaaagataaaagtttccaaacacaaattgccgggggatgaaatggttggagagacgtgcaattaacatttaacaacatgaaaataacactacattaccaaactaaaaccactgcagcagaaggcaatgtatgaacacacaacagagcttctagacgggaaaaagttccccgccacacaaatcttgtttaaaaaagaaaatatttattataaacgttaataacattcgttgtaagtccatcattacggaacccatcagcaacagatcatcaccgagttttctttactcttctgcagcactagcagcactaagatccacactgaggtcaataacctgttcaacattaggagtacaagaatcagcatgttacccaattaccaagaaagttatccaggaatatcatcaatgtttttcaagatttcccatgcccaaacaggttgctagtccacccataaggtttctgattactcaatggtattaatacaatagcaacaaatacaaaatcaactagaatgttcaatatttttcattcaccgccattcttcaatcaaattattaacgagtctacacttagtttatttataagaatcagaattcacgaaaagcaagcaaccgattttggaatatataaattttcatattaagaaaatgattggttaaagaataataaaagatcattttattaataaattacatcactgaaactgctaaccatcaaatttccagtgaggcatccattgtataaggaatagaaagatgagaataaatttaaaattcattgtataactctacaaaacgacaattagatatccaactcattctaaaatgatcaattaaaatttatcttagccattttagcttttgggagtggggaagaagagaatctaaggatatttttaatttgagaaaatgttctgttttcatttcttattttcacttttaattacaaaaattaatctaaggattcctacagtatgtagacttataaatatgtgatacaatattataaaatacagtactattgtagaacaatctcagtcactatttgtggctcacaaattaattcaagaagtggaaacaagtggtaaccaaggcataacattacctttccagttatcaatgtatacatgttgagaacgtcatccacagtcgactcaaagtgagtagtagcatcataactctgtcaaaaagttttaaatgcggtattgtcaacctatcaacatatggcaaaaatattaataccaccgagtaaactcactgttgatataaagcagttgtccaaagtgggttcgttgaccggttcatatctgtcatagatatcaaaaaatatctcatcaacaggtcctagaaggtcaattccaggttttagttcaattgcggctgatctgtctctgcctcggttgatacaaatgcaataaattttccttttggagcaacattgtgagtatacgaacaacaaaataggtacctgaccagaacagaatagagcattcaatttaaagaggaatacacaatttacaattgattggacatcgcatgcacaaaatattagtaattttttcaagttttaaacatcaaatcatcttagaaattttagtataccttctgtattggggatgattacaaaattaacagtcctaaccagatcatgagtttatggtattgtttactatgtttaataagaagagtttaaaatcatacatttatattagtatagctgaaaaaggagaaaagaaaccaaaggacaacatgacgggagattgatattgatatgtaaaacataacacatacctaatggtcatttatactaataggtctaggtcaatttagtaattaataatatacaaatagtataaccctggcccaataggactgttaagatcatgagactccgaacatagaatccaaatattctaaaatccgtaagctaaagcttgttaagctttaaaataaattagaagcatacttgtatttttcacttgtcagcttgacagccagtgattttatctgtatcattaaatttttgaaatttcttattagaatttctaaataaatgaaatagaagcaaacttatttcatgctggaaccatttgataattcagatgagactgaacaatttagcttcagtcaagaaaccactgcccacgctaattaatggtcccagtagcacgatatatattgtatcggtattgcaaaattttctacaaatttaactatatagatatatatatatatttaatatgtgcatgtaaacttacatgtctgacttccgacccaactgtttctgtggtaaaataatttgcaccgaatgggaatcatcagtgctggggattgggtggctcatgatggctattgcccttgcaaccctaccaaccttcctcacctgttgaaatgattacaattttgttttaaagaaggacgcagttccatcaagagtcatttaagaattaatatcagttcaccttcgccaataatttttttatcaacagtagttaaacatccttcagaaacaaaactatttacatagcattactcctagatttagaaggaagcaattattcactttcaccatcatctgaactggttgcaaatatcaaactacaggttggtttctaataccttgccggcaaatatgatggatcacaaacaacttttttgcacttgcagttccccttcagatgtgacaccaacaacctttccttcctcatcaaatctacctggcattcaagcaaaaaattaaaaatccacaagagtgtatatcagcatacagttcaaacttcaaaacaaatcaaaatcacatggcaattatagtacaaaaatagggatggaaataaacacaagttcaataatttaagaaggtatatatattgggttaggtatactgacagtggtgtatatcaaattcacaatcaattatacaccaatgaataaatttttcaaagttagcttaattcatgcaattaatacatttttcaaagaaactaaaacatcaactacttgatgacaattgacagcatgattttattcaaattttcaaaaatacgacattcaagatctaaaaataattatagttcgaagactggattaataaaaaaatcctattgaagttgtaattatgcaagtgtgccaagtcttacactagtgtcaattgagagatataacagagaaatgtgtgtatgtatgtataatagagtatataccttgcactcaggcttattcaacatatatgttccaccgtaaacagcactaagccgtgcaaatgcctgaagaaaaaaaaaataattaacgaaccttgagcaaaacaaactccaacagtatattccagaaagagatgaagcagatgggtagacatgggagagtgagatacctggggaagctctcctaaaccatacaaaggatatatgtacggtgaccctccttgaaagcgtgcaagagactctgcatataactacaagtaggaaacatacatatgaatattaaatagggaaacacaataaagctaatgggaaccaaatggaacagaagaaattttcaattaagaagatccacgaatgagcatgaattacaagtgcatgataacccagtaaacttaccttcattctcttcacagtgtccagtgctggctcagccaagtagcgatcatcctatgaagcgccaaagcatgaccaatgaagtctatagtgttatcatcaaggccgtattttctgtcacacgtcaacaaaaaaagcaaaagaatcttaaaatactcctttttcttctcattagtcagtacagggatcaagagatatagggaaatgtatgatcatcatggatgcaaaataaatttgacgtgtaactacattatatatttacaacaaaaaatgccaaataagagtaaataatcaaatgctaagaatttgaactaataaatacatattgactccctatacaatataagaactacagaacagaccataaaccatacacttacattttactaccaactttacatgactgactcatgtagcagttcagcaaatccattatatataaaacacaaatataaataaatcaaaatttcatgacattattgataaggacagggaaaaggcaaggtaattactcctaaaccaatttctacatgtttatgcagactatgaaggcaacacaaagctgagcctgagatgttaaatctgcataaataatggacacggcaagaaaacaagtgcacacatacgctatcaactctttagtagtcactcttgtcaagtccatcccctcgtgggtcttgggatcactctcattgtagttttgcacataaatgaaaaacttgcgtgcacggcgtttttcaaatagccccataagtggggacttcaatgcctccatgtcgtttgcaggcaccttatgaacctgtaccaaccccacaagcaaaaaaaaaattaaaacatctaaaccaaaagaaacctcccattaagataacgagcaacactacacaaacatacctttcctttattaaacacatagctcccatccacagctttgaaatagagatacttggtaacatcggtatgatgagaacccgcaccaaattgccattagccataataaactagaagaaaacaaatcataaataataatgttgcacaaattgagaatcatatcatatgcatccagatttagtataccaaaatataataaataaaaaacaaataaataaattataagaccttagggttcatatcgatgttgtagtccctgctagcgcccaaatgtggaggaggcttgtcatctcccctgaatctcttccaaagctgaagaggaggacagagaaaatcatcatttcgcagttcaaacttcataataacatattcttaatctaatattattatttttgcagaaaatgaaaataataaagaaattattaaaaaaaaaaaaacctgaataagattgagcgaagtggactctcctccgtaatagtcttcctatccatatgcagaacctgaatcgaacaagaaatagctattagcatgcgaggattggatcgattgagaagaaaagaaaaacgaaagtgatgaatggaaatagtaccttgaggccatcgacggagagaagccgctgagaatgcactccttgagacccgtgcccaacacgatcacatcgtactcctcatccatgttcgatcgatctcgatctcgcccgaaaacggggtttagggtttccgaaatgagaaagaacagcgatggatagacagaacaacacaacacaaaagtgtgatttgattggtacgagagaagagacaagatgggaacaaccgcaggaacaagtaaagaaccggatctcgggccttgacctgcacagcactccacacttaaaaataaaagaataatagtaataattaatcgctgtgtaatgaaatgatatcgcgcgacactttcctcatccctgttactgttattatcaccgtgcccctcaattttgccatgataaatacagtatctattttagtgcctaagaagccgttccatacggggagaaatttttcatatagttgagaattatgattttagaaaatcatgaatcctcaaatatttatttataagagtttataacaaatcttaattttttcatcaaaaataaataaatcatgtgattttttttcatattcgatttaactttttgaacataataaattacaaagcaaaatataatacttagttataaaaaaaaaaaagcatagatgatatgtgcaccttgagaaataaaagatttctggttgagtctcaattttatgtaataattactttcatgcataaatttcaatagacgagataagtttcatataaatcaatatgatattcctcaataatcaaaatcttccaacacgtttcttagcatgtgtaattaagtttgtaaatctttagtatggaagcaaatccttatttgactagtgataataattatatttgtattaataatgaaaaagtataagacataatgagtgtcatacacaatgacatatacaaaaaagatatagtcaccatgagtcaaaatttatgtgtccataatatatagcaaataaaaaataataatgaaaagttacaaaagaagcatgaaaaaggagaagtcacttgtactaacaatattattaaaggttacgaaatgttatacataaatgtctatattgtcttaaaaacaaaaagaaaaaattataagtaataggaggaaaaaaaatcaaaaaaggcaaaagttttttttgaattgtttatgtatattttttattgaaaattatatcaaatcgatccaaatctatactatttttttatcaaaatctttatatttttaatattcattgacttttttaaattgtaaaaaatcttaattaaatattattgaatttattgtactttttaaaaattataataatcttaattgaatatcacaagacttatttattcatttgaatttttatttaataccttaaaactttttataattttttaaaaattattcaaatcctaatctaatatatccttatttttttaaacgaatatcaaatataaaaaattaagattctcaatattcctaataaactcaaaacgtctccctattaaatgtttcctaaaaaatgagatgtaatatgaaacataaaaaatttaaatttaattcttaaatatgaaaaaaatgtgatagactacaaacaatttaatgacaaattaatcctaaatttataattaatattaaattgatcatcgaaaatataatttattatcaaattatttttgaatattacaattaaattacataatcatctcacatatttaattatataaccaaattgtcaaacttttttaacatttaaaaattaatttaattttttatcttttatgattaatttattattgttttactttcgtgactaaaataggtatttattcattttcctaaatcaccgaatatattttattcttattttcttttctctccgtttttttccaagccaggcagaaagctagaaatacaataggaaacaaaattcacttttttaccatttaatactcgaaacattgattaggctagaagcctaaaacagtcaccatcaattaatctatgacttaatagctaattattataaatgtgaaaattaacatgtattagtttgaccgaaactgtatgtaaaaaaagaaaacagagtttgagcgaaagtgaatttatattcttaaatagaatcttaagttgaaatcttataaataaaataaatagaatgaaaaactcattgaatcagttagccaattttttaatataaattcgtgatttgtaaaactaataattaaatactcaaattaaacattttattttaaaaaatttatatgttccattcatattaacataacattgtcaatttttttatatagaaaatgatatgtgtgatagatttattaattttataatagttatttcaaaaatctcagttagtataactttttattgagatggtaactgtgatttatatattttgtgtaaacaaaattatccagaaaatatatgaaaacaaatatttcttcttcttttttcttgatccttctagtttattaacagtgttcgaattttatggaaatatacacccattcaacctctgtcactttcatggacaataaacaaatctacgacaatcctaattattttttgaattgaaaactctgtaaacgataattagtatccagtacctttcttttattttacctggtttgtatagttaagattacccaaaaattaaccaaaaatctaactagaagttttacaagtaaaagaacaagtgttggtttctttaaataataataataataataattattgttattattatgtgaacttcgttgttaagggttctaacaaagtaaatttgttcccttttttagtttagagtatcttaagttgcctttaaacaattaatggtatgttggagtgaggtgtcaaccagatggaatcatatcttacacaagctatcgatatttgtccaaacaaaagaaaatcaacttaagttatactattttggattgaagtttataatttttttttatgaatttcaatatacaaaagttgattctaatacatcaagtaaaaaaaaaaaaagaatattaccttcaagataaaaaaaaatatattttaaaaatctcccaattttaatctaaacatgcactgcacttatatgatcaatatcctaagggttacattttagaagtttaagttgaatatcaactttttattttgacccatatagaacatcaacccgataattgtcttgatcgaaatttgttagatggtttgaactttaaattttgtttaggtaatagtcatttgtattattaatatgtaaagttgataaatctattaattaaaatatgaaaatttaaattatagtcattaaaagtgaaaaaaatgtgataaatttatcaatttgttaacttctatactttactgttaataaaaaagtgtacatgacacatggagaaaaaatgtctcaaattattaccaacgtgactacggaataaataaaccaaaagttagtaagttttcatttgatcaatttgtcatactccaaatttcgtttcattcaacgataaaatataatttaatttcatctctccattttttttatcgttacaagtataatattacaataaacactaaaaaatagagaaacaaaaataaattagaacaacataataataagcataatattaattaataagtatagtatgtctgatgctttgaagtttttaatgagactcaaataaaaatgcaaaatcattaagttaatccttaaaaaatgagatccaacttttttttttgtcagtatctaatgttgtcacaatatttaacatgaacagtatatcaatcatggcaaatttttcaattacaaaagggggaaaataaaaattatattatattttacctttaaatgaaacgaaattgaagtatgataaattagtctaatggaaacttattgatattttggtctaatgaaaattactgcattttgatccaatggaaacttattgacattttgatccaatctattcagcaactatgttgataatcatttttgtgacattttcgttcttctatgtcactaggctttcattaatgataacttacgaaagtcaacatataaatgaatttgtcatacttttttactttgaaaattaaattttgaatttttatctttcgaagatgaatttgtcagcactttacatatctaagaacgaaaataactacttacttttagcttatttaacttaacttaatcatagctcattctagacttaaacctacaaaataggtgaaatataatgatttatttgaaatatattacggggaataaagtcataattatctaaaatatatttacaagtttcctaaagctagtcatatctaatgaaaaaaaaaatgttagtgtttccatggaaagaaagcaaatgagtccccttataattactccactttgacctaaaaaatgtcaagaaaagtgaatcttcgttgttttcgagcatgaataattgttgttgaatactttaacaagaactcacattaaaaaggaaaaagaaccaaaaaaaaaaaatgcttaagatactataaaaattccaatgctaaaaacgacagccaaatatatggttggcatgataataaaaatcaattctaataattaaaatacaacttgtatggccattcgtagtagtaaatcacaatcaagagatgtaaaattttatccaataaaatacatgaaaatgcatgtcatgtgagacatctccatgtagaataactaatacatatcgaagcaacgatcaagataacatgttcttatccaacaacccaaatcataatgcaatttttttgtaacctcgtataacgcataatacaattgtatcataacactttaccactaatcctgaggaacatgactgttagattgttacgagaggtttcaattactattacacaacaaatgaacctttattcacacgtagtgttttgtacaatgcatcctcaatgtctgtctcaatttatcctactttttccatcttataataaatgtcgtgtaaaaaaaagttttaaaataactattattttaattatttaatgtaatattaatcacttctttctattaatattttaataaatgtcattttagtttttcaatataatattaatatttacactcaaatttaatttatttacatatttttaattggtctaggtaattagttagttagtttttagttcagtaaaaagtgaatacattgaaaataataaaaattaagaaaaaaaaaccataacgatagatatggtaacaaattttgatggtttaaactttaaagtgttgtttctcataaaaagaaattgatttaagtaataattattgatttgagtaagcaaaaaatgaactgaaaaatagagaagttgatatcaattagaacatgcaaacaaaataataaaaagataaaaacacatcagttagaagaattgaatatggataataattaataaaaaacatgaaacttatggtgaagtttattttaatatatataagtttataattaattttggatttgcatatagttcatagccagaattccttattctattccactttttattggtgttttgtggttttagccccttccagttccacttccatcctacatagtaccaaagcatgatgaaaaagtaggaatatatgatagaaaatcttcccaaaagatgtataggaatcagttttattataaactttttcagtcttttgaataagcaatttgtcataattttgatttttataatctttaatctgaatttgtatgatcaaaataaattcaaaaaatattatatatatatatatatatatatagattttaatttgtccttccattaagtatatattttagtagattttaatttctatacactgtttgcaatattttttacattattaataattaaaattataataatataaattaaaaataattataataaaatttaactaacttatttatataaaattgtatgattacataatagtatgaaaatacattttatattacaattcatgcacttttattcatactttaatacaaaacttatgataaattacaagttatattcgaatacacgtttagacaacttccaacaattcaaaattacttaattcttaatttttttaataagagttatcgtcaaatttttattttttatttttataatgtaaaagaccagagacctatattaaaaatacaaaaaacagactttttattatttatttaaaagaaaaacagtgtcttcttccattaaaattaacccgcgatatcgtgttagtgaagagggagagaggatccaaatccaagtacggttgggttggagagaaaatgcgtccctgctgaaaacaccaaaccctaaaacgcgaaaaggttctaaaatttgcgaaggaaagagctagcggagatggagattcactacagtaacagctatttcgagaggcgccccatcctcaagtccaaggctcccgctgttaaatgggtcaaagaatggtattcccaatttcttcacgctctcatatttgcatcttatgttttagggatttcaatatcgtggaaaattgtcttgtttgtaacgaggctcaatttatagtcatagttccattattttgttatgtttcaattactcatataagagtaataatacgaaaatattgtttacaaataattagaattcatgaacatgtttttattaaaaattaaagcagtacacatatatattggagttaaaatttttcctcgtgaatttgtaccattcaaacagagatttgctgttaattaataaattaaataactaaaaaagttaaggaataaaagacaaatcaatcagtaattcgcgtgcattagttttctttgttaagtgttagtttgttagtttttttgtcaggagcgatcaaatctgtgaccttttcctccttcccttctttcttaaccacccaaccaaccttatatctactctgttattgttaattactgtgcttatcgaattagctttgagaatctggttggtttttatgtttagatggaggagtatggaggggaaggagggggagagtcactttttcatttatactaaagctttcttagtaattgagttttttttttttaatgagtggaatgaaattgtaatcagggattatcatgggaccttgctaccattcttattatttttataaacgttttacaattttctcgatttaggaatgtgaatgaatggatataatgtgtttaaggttagtctttccatgttgctgttagatggagagatcaggttataatgttttagctggccatgtgcagtttccattcttttcatatttcattggttaagtgttatgctaatcatcagatgctgccagggttccccaagatcttgtgacgacgggagggaagtgcatgatcttaaaatgggtaacaggttggtcttttttactacccagcaagcttacatctttgctcattcctgccccatttggccattctttgtctgtttacatctgtgtattttattttatttttttaaaaattgattaatgctactgtttgttttagcttctataatgatacaaaacttggtagaaaataaggggaaacaagatttgagacagaatttaacatggtgtaacctaatgactaatatgcattgttgacatgagataatcagttgtttggctgttttttgctgaatttgggtgagaggtggtaacagtttgtacgtctggagagatagaagttatagtatcttttttaatacttaatactaattcaataaacaaattgttgtaaacatgcaaaaaattgatgtttaggtgctttgctaagagaccactgtatcatatgatgatgttattatatcatgttttgtatcttacatttctctttgttttactttcctaagaggataccttgaagaccttgaaagaaaaggtgaaagagccttcagtgccagagccagaacctgagccaactactgaagtactttttctttgcagctatgatggctgtggaaagacattcatagatgctggtgcattgaggaaacattctcacatccatggagagaggcagtatgtttgtcactacgatggatgtggaaaggtagtggttttaatacttacagatgcacaccatacacatgtattttatatatattatatactatatatttgccattgtattgccaagttgtgaaacaatagttttcattactgcatgctgcaaaagcagatcaaattacactttgttttaccagtctcttatccagtgattagcctaatagcctatagctttaatgaaacattgtgttgatccctctcaagcataaactctgtttttctttcatgccatgaaatagattttgcatgtgtttgcttttggattgaagattacatgtctatcatggggggcagggttaggtaaagtgatctaagaactgcatttatttgcagacttcaggtattggcatgttatgctgcatgattggagcataattaattaaaacaaatcattaaacctttttaattggtttatatttttttaattacactttatttatttatttaatgctatgtatcaagttgcaatagcttgctgtggactgtggtttactcaatagcaggtctatttagcagtgctgaaagtatttgtttacattgcagaaatttctggatagctcaaagttgaaaagacattttctcattcatacaggggagagggattttgtgtgtcctcatgaaggctgtggtaaggtgatgatttgatccaattaagggtttgttgttttctatgacggcttcctttccctagttggtgttgcatgttctgtgtgttgttctttatggtttacacatttggatttgtgacatagtcaaattagctgatgctttccatctatttcttcctatcacaaagaccaacatgaattcagtcttcaactgtccactctgaatctgttttggttggaatgtttttctcaatggaaatttggaattaccagagatattcaagcagcaaagcttgagttcttaattgtgagacctatgtgtacatagtctttaaattgttgatatagagggtaaccaatgaagttgtaaattttcaatttgaatcaatatagaccaaatgttttttatagttgagtatattgtgattttcataaatctgtcatgaactctctctctatacacacacacacacacacttttgatggataaattactttatgtatgatatcatcttcaattattatccactatttggtaagttattattagtcttttctttggagtttggataatgtctttatgagtgtatgtttgtaatcacatctgctgcaggccttctccctggatttcaacttaaggtctcacatgaaaacacattcccaagagaactatcatatctgcccatatccagattgtggaaagagatatgctcatgaatacaagctaaagaatcacattgcatctcatcatgaaaaggttggtaatgtttcctatttgtgtagctggtacattttccttatttttttaccactcagtgtattaatattatatgatgcatgttattatgtaaagcatacctgttgttttagtccatccatttggtgtttgtgcggtagtttcatttggtttgttagtatatctcaatacaaatatgtattatttctctcatgtatgtcgtgaatatctgtataaagatgtctctaattcaaactgatgaattactccagtggatgtgactccagaaactgtaaacatttcttgaacagtcttttgatttgcaatttcaaccttatcttacagaatgcatccgtggatgtgacaaagtacactactccaccttcagagaagcaaacaaaaacttctaaaccatctggaggggcatatggttctgcatcatctgaccgtccctatgcatgtccctatgatgggtgcgaaaaggcatacatccatgaatacaagcttagactccatttgaagagggagcacccggggcttatggctgatgaaaatgcagagcatgctcaggctaatgttgacaatgaaatggatgaagcaagtgaccatgatgcctatgttgcgaaacgatcaaatggtaaaattcagaagcagagtaagcctaaaccaaacctcaagttgcctccttccaaaattgcaaaacgcaaagtgtccactcccactttaactgtaaataaaaattcttggccgtgaaagatgaaccttttgatgaagaagatagcgaagaaacagaagaggatcgtgacaatgttgaagatggttggagatatgcaggaggaaacaatgaagatgatgatgaggaaacagaatatgaagactgaattagttatggcatcctctacggaacttaccttttccaagaaatatattttctcttcaacaaaaaaatttcagttgtctcttttttatttggctgaggaaatgacatcttgtcaactttgtgttggttgttacagccttaggaagaatttatataaataaaatgcgatgtaaaatgctcttggttcaattgtcatccgttgtcaccacaagattctgactgaattttgttgactttggataaaccttggtaggtggtctattcatcctgtcacagctatatacttcaaatattttatcattagtttgtttttaaatgtttaaaaggtcacaacatcaatcttttaatagattttaactttaaattagttaagtaaaattgtcattcattcttatttaagaccaaaagagcgatacaaatggataaattttaagatgtactgagcatgccgttcacgattctccttgccgaccatggcaccaagctccatcaccctttcgagcttagggtctgagtagttgtgtatccctagcaatgatcttaattttagactgaccattcaaggtaaagagaatacttaaatgtttttagactaattcaatgtttaatggtggaattgatattaataaaattgtaataatataatctcagattttaataggtcacacaccttgtgccaagtatgagttttaatgaaattagtgttgcttataggaaatcatatttttaatattaaaagtatacatagaagtctaaattataatatttacttttaagttttaataatatacaacaatattcattaataatgggttcatatttaaaataataagaaaataacataatttaagttgattttttatttgtgtaagaaaaaactaaaacaatattatattaaatgtttttcaaggacaattgaattgttggttttttctaggttagttttttggtataggattaatttcatttttttttctttttttcttttataattatcgaagtaatttatgtaaaaaataatgataatcttttcaaaaataatgaaaatgtataaaatgaatattattcttttattttatgatttcgtacattttgttctttaacttttatttttaagtttgaagtaaggcaaaatgtataatttaacttttagaaatcgataaacacattaaaggtgagatttaaatctttacgcattctttacttgacaccaccaaaatcgtgaagttcgttaagttatttgtatttttgatttattactacatttgttaattgaagttttaatcgactattgtgcaaatttaattttgatttaggataaataattattattttaattttaaagtaaaaataatataaatattataatattaaaataaataatgtagtataagtgatgtcacagcaaagaaacaaacagatgaaaagaaagagaaaaagttagtactatatgtttatatctattagtatatgacaaaatattaagagttaaaattataaatttatttattaaatgttttttattttattataaaaatttaagatttttttgttgatatatttacataactgtcgcattaacagtaacatttaataaataagaagatgtattatccaacaatggtaatcacatatactctacgggtttatttctctcctatgagattcttcattcaataaatgagagaatattcttgagtcctaccacagatcataataatgtaaataagatctcaaaacagatttttacccaaatctacggagcaagtttagtttggtgttgtgttgcactgttactgttgttttaaggtaggaagaaagaaagagcgggtgaggagtgaggaggaggaaacatggctacggcgtcggcgtcggcgtcgtgggaggaactgacgctgaaagtgaaatggagcggcaacgagtacaccgtccgcgtctgctgcgacgacaccgtggcgagctcaaacgtcgaatctgcgagctaaccaacgtcttaccccttcgccagaagctcttgtaccctaaaatcggttccaaactcaacgacgactctctcttcctctcccagcttcccctcaactcctctctcaagatgaccatgatcgggtacgccactacgctgtcgtttcgtttcacacacttttatttttagggttttctttcattacattgctcacgaataatgaatgaatgatttggcagtactacggaagaggacttgctcgtggatcccgttgagtcccctgagatcctgacgatttggagcttcccaaagatgaggctgttgacatcaaagatatggaagtcaacaagctgaaattgaatagacgcattcatcaattcaaggttcaagttgttctttttccgcattttcattttgtttctttctattgtaactaacaatacctatctacataatatcctacagattgagcttcaaaatccgtgtcgccaagggaagaaactgcttgttctggatattgattacactctcttcgatcaccgctccactgctgagaaccctcttcaactcatgagaccctgtaatttcatttccccctttcgttttcttcttttttcactcagtggatggagtttgcttaaaattacaaaaatgccatttttaatcactcaagttatcgaaccttggcaactttagtccttagttttgtaattttagaggctaaaaggttgttggtttggtaattttagtgattaaaatgacattcttcgaattttaggaactaaattgatcaatgcagatgatttcagggactaatttgattaatctatttttttactattattattgaacttaattgaaaggcattgatattataaatgtctttttacactgtcattcaatcacatgttgttatgtatggtaaatttgtttgccttttctaaaagttatctcaagaatgatttctaattggttgatagtacaagatttttcacactgacagttaaacttggtattgtttctttcctctctcttgtctgtaacagaccttcacgagtttcttactactgtttattcggagtatgacattatgatatggtctgcaaccaggtactgtcatcttactttatctgtattctgttctgtcaattttttattcttttgggacgataatttgtaatggaatcaatgctacattcacttcctgcagcatgaagtggattaaagtcaagatggaacaacttggggtgttggacaatcctaactacaaaatcaccgcacttcttgaccacatggcaatgatcacggttcagacttcttctcgtggggtctttgattgcaagcctcttggtttgatctgggctaagttccctgaggtataattatgaatattatgcaataaactaacatgccatttattttcttaatgaaagttaacggaattatgttggcatatttgctcaatcatacattaccatctacagcccaatgaatagtatacttcttatatggggagaaacgggacacccagaaaatactattgctgtaacttagtcttcctgaaaaactaaaaagatgttgatgcttgtgagtatagtcataagtgagataaacctaggtgggttatggagttattgattctagttaaataaaattgcaaaatgaaactatttgacattctaaattgctgtaatctatacctggttttcatttatttctgtattgttttcaattttttgcatcagttaaccatgcccttgatctagttgtcttgatgttggtttcttattctatttcagttctacaatgcttcaaatactatcatgtttgatgaccttagaagaaattttgtgatgaacccacagaatggtttgacaattaaaccattcaggaaggctcatgccaaccgagatagtgatcaggagcttgtgaaacttacccagtacttactagccattgcagagcttgatgacttgagcaaccttgatcataataattgggagttattcacagaggacaatgctaaaagacgtaggcacagataaatgataattgaatgcaataactgaatctggtaagcaagatgcaacttctagacttgtaaaagtttgcagttttataagagacattgttcagccagaggatttcagttttttatatcaagtatttatgtttggacggggtgaatgacagaaaggaaaggatttcttgtagcagcttttggagtatctaagatgattaatattgcttatgcaatttctatctagcaattcctgaacagaatttgatttgatgcatgaaaattttatcctttcataatttgttgggaaagggtataaagcatggataaattgcaaaatgatgattagttgtgtggcacctatggctgcaactattctccaaagtgatcaattgattctaattatagacaatgtattacatggaagttcaatcttctcctcgtgtttttcggcctatcatgtaattaacttatcattgttcttggattttatgcttcatgatctatattgtctttttttagtgatcatcttctaagtgggtaattattgtgtgaataactccatttggattaagtggggaaataagagagaaaatgatagggagaacataggtgaggtccaatttggttcgtcttaaagtgactgaagaaaaaagtgtatggttctgcttctgttcgttttaataactcaatgatttgttatggattctctaagcaaaagtatcggattagttaaaaaaaaataaaaattgttaagtcagatattgaattagaaatgtttggtaaaattagtctttgaattagttgattaattaaatataaagtgacataaaataagacgttatatatttttataaaacttactttttgtaaataaaatgtatgtttcagctaattatagttttatgtttcacttaatattgaacgtagtgatttttgtttgaagtatttattaaaaattaaaatgaatagtataataattaaaataaacactaaccatcaaccaactcacctattttacatattgatttttaaattctgattggaggtttaactcgacaccaccggtttagttcttgactacgtccttcacactttgcctttaattcgacactacccgcaagtaaaacggtgttcaatatataaacgtgaacatgaaccacaaacatgttgcccaaatagtgtgggctttattgtgggttggattcacaccgtgggcaacacgttaatataacaacatattagctcatcaaatgaaaagttaagttgctttgacttggaggaccttctaagatgcgatttaatataacaacatattagaacatcaaatgaaagttaagttgtttgacttgtaggacctacaaaatttaaaagcaataaataacctttaactagacttataagtgaaagagaacttgtagaaatcaatgacttaataatatcctaaatcaattttctcatgctaccaaacatgttgagaaaacataacttcattaaaatcacattacaaacattagcttaacattatccatacaaataagacacattcaaatggcccgagatatttgctatttgcactggaccaaattccacaatagtggagattaacaagagggggtatacagctacatattcactgaagaaacagtggggtgaaagcttgaaaatgttggttaccacctctggtaggtcaactgacagaaatagaataagatttcggtaatgaccaccaggtgcacattaaatggtaataataagtaaatagaaaacggaaagactaagagaaggctgaaatcagcaaagctggcaggcagagagagggcatatgatggaaatctctgcacaatcccatgcatgggaagggaaggaagcaattctatcgtgggtgtggcaacaccggttgaatgtagaagcagaacaaggctacagctactgcaaatctaaattctgagagcagggtcttgccctgaattggtgtccttgtgttttagagaaaggtttgcgaactgagattcgaggtctctactgtttgtgcgtctgtgacttccagatggttgctgttgtggctgtgtctgtggttgctgctgctgctgatacaatgcacgtaatcttccaatctctctttcagtacttcctgctccactgaatttcacattgcatagattttagtgtacaaaacatgttcctgtgatttctaatgaaaccaatcatgcttaaaaaaagaactcatgggcctaaagagaactcaggcaaggatttcagttcatgttttctcggagtaatattttcttggtctcctgcatggtgtccccccacctttttgggagccagacaaatccccactcactcatctgaatatttagtagcacggctcaggccacgtgtttccaggggaatatgaatcctgcaatgcaggaaaagtctgctacccacatgccacacggtattaggtggccaactgagccccacctcatttcttgaactcaaatgttaattcctaatttccatcactatcctatattgctagattcttctaatatagaaaggtacacaagaatggatttttccccatggttttgaagtccttgagctacagttttgaatttttcccaaattacttgaatacaacccttaaaagatcaaacctgcctttcttaatctcattacagtaattctcttgcaaccatgctctagcacatagaaaatagaacctgaactttctacttccttgccacttatatgatataatcaaacttagattaaccttatgtgttccttttctattaatttatactatataatatatcataaatcacaaggaattcactagctgaggtatctaaagcatatatacgcaatccaagttaaaaaaaacttgtgttacttgaaaatggccaaacttatatcatagaaacttacaatatttgataagctgctcttgtgctatattttctaaacgttgcttgagtgctttattctccatactcagaataagattctgctggttaagaaactcgagctcagccgagacttcagacccttctgcctatgttgacatagaaagaaatagaatcagcacttacataaaatgtcactctgcaaacatgcacgatattgccttgtgcagaaacctacctgtaaagcttgtacattcctttccagctcagctatgtattgaagtttccggacccgtgaacgttgagcaaattgcctgcattacaagtgtttcagaatttttttcctttccatatatgaattgattggttccaaaaaaaaaaaacttctgtaaattaaatagaaaacaaaaagagaaaaacacaccacattcatcatataataagaagcatggtttaactgctttctctacatgacaattagtataccagcaatagtgatgcagacatcactttgtaccacaaacaattgttatataacttatatcttttcccttctacgtatattattaagatgccatatggccacaggtagtatagtctagatttgatattataataatgtccagcctatttggtaaggcttaaaagggtcaataatggggatgacatgacttaatgggtttgccacaagaaaccattcagaacttgatcccccaagttagatattagtggcataaaatcaagcaatcactgtaataaccataaaatcaagcagagaaaataactacgtactgtttagcacgttttgtatcagtttcagaggcagatgactttgcatgtgaactgtcctttttttcaggaaatgattttgcatcctgtaagcctgattctactaaatcgtgcttttcacttgctgctggtggaagaccatctgcatcatgtggtgtacattgcaatcctgaactctgaaagcagcactgtctttgcctgagggaacaccaactggatttgtcatggcatttgaaaaagagtcccatgacctatttttctgttttacggagttcatttctgcataaacaggtacatgacgaacatctttgctgcggtcaaagtcttgagatgaccaagacggaatagacatcatattcttatatttatactcgtcctgattagcataattaatgttagatgcattaacagtgtctatgtacgcaaaagaatcacttgatgaacgccgatggccacctcttcggacaggtgtctctggctcgttaaggagatcatcaagccatgaaggctgctcctctataacaagctctcagatgaagtacgttggtggtgtgtgtttccatctctaggtctgttaccatcctttaaaccaacaggggatttgggacataatcagcatatgcttgggaaacactaggaagcggacttttaggaggaagtagaggatgctttccaggatacataaaatttctgaaacctgatgagccctttgaatttgccatagaagcagaatgaacaatacctgtcgaatttaaaattaccaaagaatgtgatcatgtgaataaatcaaaagataaagacaacatagaaaattttatatttaaacaaaaatccatgattcaacaataaagatctgatatgcatgtgttctcgattataaaatataaaccacaaatcagtaaaaagatcctataatgcgaatagcatagtatccttgaaaatgttccaaaaattgaaatttggtttatatgcaaatttactcacagcaccaaaagagtaaatgcgctagtatcagagaatccacatgtaatgtaaccaaggcagtttgggagagaaaaaaaagcatctcagtaatctcaataaccataaatgataaatctgcatacttcatcgagaaaaaagcctaagaactaaatatctcagatctccatgatactatatatttcattggataaaagttcacaacatattggcagctttacggatttatctctttcttttattagtccaaaatacaattctaaaaattgtccacccatctcacaaaaatctcaaattttcattttacatatacattattatcatttcagatagttgatcaacattgtcaatcctttcctcacggtacaggagcatcacatcagattgtccattacaatttcatcataagcaatgcacaactcgtatgaaatagtaccaagcacaatagcaatcccatcacacataaatgacataatattaaccaatgttttaagtaaaaccagcccataatgataaaaaaattaccagcttaattttcttcaataaaaaatcaaacccaaacacatgcatctaacaagcctggcatcgcaacagtaaactaccaatgtaacagaatactcaataacatcatttttttttaaaaaaaaggagaaacaaaacttcaaaattggaagccacaagaaactagctaggggaaagaaaatccaatccacaaagaaaaatttaaccacaataagttaaaaaataagaaaaataaaacgtagcacccaattgccaaactttctattttatactttcattttctcaggaccagatgaggggaaaaaaaacaaagatagaaacttcacttttctacctttcccaaagaatctgcccaaaacacgcactcagaaaacaagaggagaaaaggatcaacacagaatttgaaaacattgaaaacccgacacggtgcaatgtgcgacactgtggcatcaacagcgcaatgatttcaagctgatcgaacgaattgggaatgaaaattgaaacagattcgtttttcgcaagcaaacaaaaaattaagacaacaccaaaaggaaagaaagaagaagaaaaaaaaaacctttgcagattgaagattcgagatcccgaaatgcaatggtaaaggagcttgaaatcaaagcaaagactctctctctctctctctctctctctcttagggttcgtttcttcaacacctctctctctttctcttctctctgtcttcttgttgaagctgggaaatggggcttaattgtaaaaccatgataagtaaatactgttcctaaaacttttctatttaacgtttcaccctttaagtttcgttattccaaaaaaaacaaccttgggttagcaacttaaaaataatactcgttgttgtatctctgtccaacttgtctagagacatggcaaaatagaaccataaattcgttattatataaaaaaaatccataacatggaaagattccagtaatagattttggacattggactgaaaataaattcacttttccttagttgactcacactgggtcacccttgataccaaaattttaataatgttaatgattatgattagaactattgatttttaaaagctcatccaatatctaaatggcatatataaatgttgtttattaggaaaatgacacaagattttaatataacgttatcatataaaaatttataaaaatattaattatacatttttaacacactcttttgaatatattttattattacatgaaatttattaaaaataataattttatgatcacacatcttatttaattaattctctttcttaattaattatgttattttctataaacttaaatcaataatataatatgtgttaaaaatagtttattgctataattcttaaaataaattaagacttttatagccatgtagacgggtcgatgtaaaattcaaaatttatgatgttaaaaataattattataaaatttttaaaattattatatatgtttattgtgaataaatgaaaatataaaatatggttataatgttaatgtatattttttttatcgttttaaaatttagcagggaatactattttttttaaatatatttataaatttttaaatgattattatatttcaaatataatatcatgtggtaaggttttttagcattttgaattcactgtgaaatcaaaatggtgaactatattttaaaatgaaaataattattaagttcagatattaaataaaaaactttttgatatgtgagaataattattgtatgtcattacgaaagtttatatagtatatttatatgagttaacggaaaaattaacaatttattgtattttttacaaattcaaaaaaaaatttaattttttatctttaaaatctaattgccataactaacaaaatcaaatacgtaaaaataagtatttatcccatattataacattttccgaaaataaaaaggtatattcttttgttcgaatcaggtaggtgtgccgtatgcgcatgccaaaagtttcgatacaagtgtcatggctcaaatgtcttatttcttactattttaatagaaaaaaatgtatttttttagattaatttagttctaaattttcatcgcataaatgttgaggtgagacctgacatcctatttgaatgaaaatgtacatttaaactttttagctagaattttttcaattaatggctatgacagattcggtttaatttagaagaaaaaaaatcaaaacaaaaaatggaacaaagtaagtatggaaaaaattgatcgtatatacttattttatttttaacaatcatctaataaaaagtagaaatattttttgcaaagtaaatatagtagttgaagcaaaaagaattatcgtaggaaaaataatttcacctctaaattaattttaaattttgtttaagtcttactattatattattttatttcgtctcataattgtttaaaactcattgtttgattgctatgcatgcagcaagtgttatgttccatccattctagtttgtttttatcctttctaattgataaaaaataacattaataagtactcttaagatattaattaaaaattattattattttattaaaatacgtaaatatgttatatataattcttttacattttattataatttccgaattaaatatttttttcattaatcaatactctaagtacattaaaaaaaaaaaaaacctattttagttcatctctattactagttactagtaattaaaaaatgatatacttaaatcaatataactttttttcactaagatcattccagtttattaaattaatataatttggaaacttgcttttaagataaaaaaattaaatataaatagtttattccaaacataatttcaattacaatagattttataaaatgtatagttcaaaaataagtttaccaaaatttaacttaaaataaattttgatatttttagtaattatttaatataaatcaaatctatttataacacagataattaatatgaagtttaaaaaatatattttgtagcctgattagtttttagtttgagttttgaagtttttagaattaacaagtagttttttagctttagtttcaaaaaaatcttaaatcagtttttaaaatattattaattttaaaataaactcatttcaaaagtttcataaatattaaaattatttttaaaacattttgtatagtggttatgataatagtaatatcagcaacaactctgataatatagatacaatggtgattacgatgaaataacaatgacaatattatagatacaatggtgataacgatgaaaataacaataacatagtggtggtagtggtggtaatgttgatagtgacgccaaggataaaggtgatattagtagtaatggtggtgaagacaatgataataatgttggtggtgtcaatggtgatggttgtgacattgacaatgatgggatgattgtgatgataatgatagatgtgatattattggtagtggtgacaatgataataatattgatgataccaccgacaatgataataatactgacaaactaaaattcaaactcaaatattttttttattttgaaaatgaatgtataaatatttcaacaaaaataatctaaaaatcatttcagttatatgtccagcaaacacatttttttaaattacatttaaaaattaaaagccaaaaacttgtaaccaccacaaaactaacccataaaatattatgactacagagtatatgtattaacaatctaaagactctttatactataattcatattttacgttattatttattgtaaatttaaggttaaatatattttttgtttctttgtaatttttttttcgttttagtccttacataatatgttttttgttgtccttaaattattttaaataacatttttttagtgttcaatacatttttcttgctgttcaaaatgctaaaaaaaactaaattacaaagataaaaaatatatttaaaccataaatttattattttttacaataattacctttaaaattataactaccatgatttataattaaattaaaatattttttatgctgaaataaatattaaactcaattatttaacaagaaaattttgatccaactaatcgtaattgattttgatccaactaatcgtaattgatgaccaataatatagtggctgtctcgagacttcacattaaccgtgtccatctaatgtcatgacaaggaatataaacgtcacattaattacaaaataaatgttatttacaatttcttgacactttttcaaatattttttattggttgaaatttaataaaatttatcaattttttgaatcttgtttatcatttaaaagattatcttttatgatttaaatatgagatctacaaaaatttatagtttttttaaaaaatcagccaatcacacaataactatttgactcatgcataatttataaacatatttttaatctttataaaaatattaccgtattttgcttttagccacagatttggtttcacaaccaggttccaaacagatttagcataaacataatctcttagagatgagcattttaatctttattttgctggacttaggattgcatgtttttaattcagttccaggctccagcttttatattcagcaacagattttagctgatgtagtctcggttcttttgttgggcttttagttctttgggctcttagcccctttcatccaactaaaaaagaacaataaggataaaagtcgaagaaaacaaaatacaagcttctaaggttgttgaaataacttataaattaataaaaacaagttgacttattaagtctaagctagtcaaataaattataagttagtttatgtttatttgacatgtcagacatacttataatgtttttttttcatgccttaagcattttttttctttataatatacttatgtttttattttagttcttttaattttttttatattccatttaacttaattaatgtcttttgtttgcattagtccttatcattactcaattattatcaactgctgaggtgcagaaggccacttcatgacttccacacattaggacgtaataaagtgttattacttagtttcttttagtctctctaaatatgttttattttattttaatctttgtctctttaactctttccttcctcattttaatttctctaaattattattattattattattattattattattatacaaagataaaatcattaacttggtaaaaaaagtaatacatggaagcaaaatcaatacaataatttatttaattatatatgatagaatatatgaacgacatacaattgttaaacataaccaccaaagcaattaaacaattaagtgaataaaaaatcctcattctgaaaggttctttattaaaccattttagttatcaatttaaacattttcataatacaagtattcattatgaggtcccaattttgctatcccaatacacaacgtatactctaaaaacacacacatacagctcatttttttcttctttttgacagaacacacaacacgcttaatagcatggattttggaatctataatattaaatttaagacttcataaacaagtttggatgactaatgtcaaaatcagacacatatatagagatatataaattatatatttaaaataaactataatgaatttgtaaattataaatctaaaagaatataggacatcaaattggaaaataacaatgtccaattttaaaaccctaatctatccaaatcaacttaggtcaaacaaattaacagccaggtatcatgctcaccataatgttttatatatatatattattatatatattatatatattatatatcttttcattatcgatttatttttttaattttatttgtcgtctattgcaaaatttaagaagcattcatagtatagaatacaattcatttttttataccaaatataagttaaatatatatttatgtaaaatatatattagagattattgtaatgtttgtaaaaatctaatgcatactagaagtattgaaatttgagagacacacaaatacaacgactattctaccaaaagtaaaaaaaaaaaaaaaaaaaaaaaaaaacctcattagaattgagaagatccaattttcttgatagttgtcgatttgtctgcttacaaagatgtggttgactattcatataaatcaagcccccacaatgccattttttcttatgcaatttcatccgtcatgctcatatcaactgaataagccgaaatacacacggggacccataacaaaatggccaacacacacacgcatgcacgcgacaccataaagttggtaaattaaaaatgatggtgtgaatagtatcagctataaaacacatgatgctaaaagcaatgttggaacatcctatacatcaactattacaattatcgtaagaaattgagatagctgcttcataagccacttctccggtgaaacgtttgtgtctgttattcagatcactcgcggctgagattcaaattgccaattgtcacaacagccttgccttatgatcccagcaacttcttccatcttgcatatgctaaaataagcaagaaaagcaatacgcaagctgcagacgtgatccaaacgaagggccaaaataatccatcaatgtgatataaattacaaggaatgttcataccaaatgtaccagcaatcaaagtttcaatagcaatagcaaatgatgcaatagtcaacgtcaactgcagctgaataagttcatttcggtggttatcaagttggatgttgacatagtcttcagtgtcatcaatatactccctaacctgcaaatcagtcaaattctcacaatatttggcattccagaaacaataaccaaaatcagctgacatttcaacagcacaaatgctccctaaagcccaaatcttggtccatgaaacacagactaacttcctccccctcaacattaacaatatagacttcctaccattttgttataaacaagaaatgaaaatcaacagtaggttacaaccgtttgtttttaaatcaacagggcaggcaataatatattttgtaaatccagaattgcaacaaacttggacaaatctaccattaccattatcctatagggtgagcttaaattaatttattggagcttgggaattcttaaggataagctcccaatagtgtcacattgaaactagcaaacaattgagattccctccaccctcaagacaagagaaaagtaaaataatgcaatattatatctctggtaagtatcacaagtcacaactaagtttatgtggttgagtcacgtatgcaaatgaaacatatgaaatttatcatctaaaagcacaagtgtgtgatataaataagatagatgatagaatccaagtagaaaacgacagtttcatccttcaaaatttgacagactcatgatttgaccagaatatggttgttagaatacttacagataatattttgttacggttccatccaactgcatgaaatatgcatcaagcaacatctccaagtcctccacattgttataatcctcataatggctggtcacaagactttcacttctgttagaaccaagtcggcgaacaaacgtgaggtattaggaaagttatttgaggttgtggcacccaaatgagcctcctcaaattgttgattctgcaaccacttcctcgtcaaatatagttgtgccatatcttcgttgtcatctaacagatgttcaatttcatctcgcacctgtgaaagagggtcatacacttcttaagtatgatatctcaaagatgaggaatgcatcttcacatacaaggtaaaaccgcctgcaataaattttctatatataaaagagtgaacaaaaacctcaacttaagagcataataaatgattattgaacaatgtaacaaaagaaattaaacaattaaagagtttggcaagaaatagcctttcattctttattcaaagactgcagaaatggatgcagattgcagtccaattacatgttatttctctgaaaaatcctcaatcatcacaatgcacaataactaaaagaatctgttggcacttttattagcttgcacatttcatgggcttttaactggtggcttgaccagtccaacaaactatattaattaaacaaattggacttggtacatctattttcccaaaggttaatcctattctcaatttccaatttccaagtcatctataagtaatgaaataactatccacatcaacttagttatagcaacaatcagaggaagaaccacatggtacttatgcaaaaacataccttctgcactcgtgccagcaaccggtaagattactcttcaaactcctcacatgttcaagattcttggtgctaacattccgagccaattcatccaacacagggtaagcacctcgctcaaggtccgccacattcgagtccagataagtacacacagcctccaaagcaatctccagaacttgaaactcaaacggaagctctgactgcaaaccatcagcgcctctggcgtaggcaaccattgcctgccattagagacctgcatttcgccttcctgttcctccatgcgccgagaagtttaggttgacttttgcaggaagctgttgcctgagttgctcaacaaagggaagaacctcctgccgaagaggatcaagcaataacacttcttcagcagtcacgatcgcctttataaactccaaattaaccaccattgctttctctctagctgcaattttttatataaaaagacaattataattctattcttcattcttcattaaatcataataccatccaagaaaagaaaagaaaacacagaaccacagtcaagttaccaaaacaaacacaatttaagacatgtgattcaattcattagagaaacctaattttgagaacacgatgaaaatgaaaaaggaaaattgttgaagattgaaatactgttattattcagttacctattattttgtgagttgttattctgtttagattagaggaaagttgttattctgttacaaattattctgtttaggttgttattaatacttgttaaatacaccttttaagaggtagcagatatgaaggaaatgatgaatagttctctggattgagttttaatatggtatcagaagaaatttaatccaaagaactcaaatcccattttttttttttaatctgattcctttttttagccaacctgtaacttcttttccctctttgcacagtctccaatccctaatttccctaatttctccaccatggaaaaccctgatctcctgtccatcccacctccctaccaacttcttccctgttccacagtccaacatcatcatacagcaagacaactcttcctttcctgtcaccgtcatccttgatgatcaaactaccccctttggtctcaattaatggacaagcacataggtgcccgtaacaagtctgggtacctcactggtgcgatggccaaacctccgaccaatgatcctaattatgctacctggtcactgaaaacaaacgagtgaaaagctgactcatcgaatccatgagcccctctctcatgcagtggttcatccgccttgaatctgcaagcgaaatctgggatgcgctctccaacgttctacgacggatctgatgaaacttgtctgtttgaactcaaccaacactccttctccaccaaacagaatggttgtcctctctccacctattataatggcttctctccatctttcaggagattgatcaccgcatggcttcttttgcaaccaccgtcgatggcgtagccagacgcactcttccatggtcggctgcgtgtctacatttttctgagtggtttagactcagattttgaccaggtacgtggcgaaatccttcgtagagattacaaattggatcttgagagcaaatatgcatttgtccgtgcaacatcagcacccatcacaatgggacgccctgcttctacaacggattctctattttttatctcatactcctgtgcttcctctgcttctacaatggatattcttactcaaacataaaatgaagtcttctctgtttttcaaaatttcataatatggtccaaacccaatttcaaagttcaatccaaatccttcaatcagataatggacttgaatataattttttttttttttctgaattctggactctaaaggtatcaaacatcagacttcatgaacacacctagcaaaatgggttagctgagaggaaaaacaggcacttgtagaagtaacgaggcatctttatttgacatgaatgtgccttccaattactgggggagcagtcctttcagcagcttatttaataaatcgtactccctctagttctctaaattttcttactccacagcaaaaacttgaaactttcttttctatccctcatgtaatgaatcttgaacctagagtctttggttgtactgcctatgtccatgttcccaaaactctacgaaacaagcttgatccttgtgctaagaaatgcatctttgtcggatactctgaccttcaaaagggatatcgttgttttgatcctacaacccaaaaaatgcatgttgcccttgaagtatcctttagggaaactgaagtttttattcaaggggagtttcttcttctcagggggagatccagaacaatagagaagacgaattctggctatctacttctacagttcctactccaataccttccaccacaaatgatcagctcacaaacactaattctcctcaaaactcttcacctgaagtaacctgtgaacctccagaagcagatctcaacgatgcaagtcatcctttatcccatgagacaccatgcctaactgaatcacctattgtacataattctgaaatacattctgaacccagaactgagtcgattcctgtccctagtacagatcattcaatttgtgctgctcctaatagtattcaaatcaaaaatcagagagaccgaataaaggcaaacccaaaactgtttatgaaccagaccctaaagtgaaagtaaagtatcctattagtaattatgcgtcatctcataggctatctggatcatatgctctaacagttgatcaattatctactgtatatattcctaagagtgtgcagtttggaagatcctagaaggaagcaagcaatgaacattgagatggaagcacttcagcacaataaaacttggagattaacttctctaccgagtgggaagaagacaattggatgcaaatgggtatacaccgtgaagctaaaagcagatgggagtattgatagatacaaagcaagcttgtagcaaagggatacacacaaaggtatgaagtagactatcaagacacgtttgctccagtggctaaacttaatacaatcagaatcctaatatccattgctgcaaatagagattgccattgaaacagtttgatgtaaagaacggttttttgaatggtgatttagaagagaagtctacatggaggttccacctggagtgaagctaactccttcaacggagaatgtagtttgcaaactggaaaaggctctctatggccttaaacaatcacccagggcatggtttggaaggctctctttagcaatgaagaagtttggttaaaagcaaagcaactcgaatcataccatgttcataaagcataacaaagggaaggtaacaatactcattgtttatgtagatgatatggtgctaacaggggatgatatagaaggaatgaaattacttgagaagaaattagctgctgaatttgaaatgaaggatctgggtcctctaaatattttcttgggatagaaagtgcaagatctgaacagggtatatttctaaaggaaatacattttagattttctgtccgagactggattgatggcttgcaagcctgctgatacccgatggaagtgaatcattctttgggtatttatccggatcaggttgaggtagataaaagcagatatcaaaggttggtaggaaaattaatttatttatcacatactagacctgatatcacatattctgtaagcattgtaagtagattcatgcactctccgatgaagagatatgaaggcagtgtatcatattttgagatatctcaaaggttctatggaaagtcttaaaataatatagcgtgcattgaaggaacacagactcagacttggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaacagttggtggatgattttcagatttcccatgttcggtcccaggagcaacttgctgatgtattaacaaaagctgtctcagaaaaagtgtttgaggcatgattgatattcatgaacgagtggagtgttgaagattgaaatactgttatattcagttaactattattttgtgagttgttattctgtttagattagaggaaagttgttattctgttacaaattattctgtttaggttgttattaatattgtataaatacaccttttaagaggtagcagatatgaaggaaatgaatgaatagttctctggattgagttttaacaaaaataaaggggaaaattataataccgaggatgttggaggagtgggagaagacggggcccaagattctcaagtctctagcgggaatcgctgcgtggcggatgatggcgttcttctccaactcacaagttctgaccggcccgatcggtcaaacctcatccacaagcgggcgccgccggtcttcttcttcgccttcgtcaaggcgcagctgccggcggcggcggcgataggacggttgttgttgtcgtcgggtgaggttgcgattccggccgcgtagggaggctgcggcggagacggaggaggaggcggggcggcgttcttcttgggtcggcggcgagaggtggagcggcggaagaagggaccctttcccattgtgattgagaataataattggtaaacaaaattattattgttgttaaatgattaaattgaataataataataataataataatagaagagtgaagattgttgttgttcttcttctccttcaccttcaccttctctgctttgatcctccataaaggagacgacactccttctctgccgcacactccctatttgtttttatgtttgggacggctttaattattgacccaccgaccaaagcaaatccaaagtcaatgggtgtggaaataaaaaagtttgttattacttattagtaactgcatctccatcactcgattatcgttatttgtatttttttatacattagaaaacaaccatttttatattaaatttcttaaaaaacttatcgtttaatatcactttttatttattatattttacagatattttattttgttatattaaattttaaatattttcttttattcttttatatttttgaaatatatcattttttatttttattttttactaattacattaaacaatttcaaatttaaaagttaacataataataatttttttaaggaaaattgaaaaagaatcaaaatgatatatttaaaaaaaataaagatcataattaaacttttaaaacttaatatacaaaaataaaataattatgaaacatatgaattaaaagtgactttaaacataaagttattattacatgtatgattatttattaatttataatatttatcttaaaaataatattaataatgatttatctttgatacaaaaaaattgtatgatgacaaaacaaaataattgtttttttattatctatcctcagaattttggtcttggtaattatttttaatattttaaaataaaataaaaatatagcaaagagagaataggttcattacataaaaaattggaatatttttcataaataattgagtgtgagaaccaaatgaatagaaatataagaaatctagacattttgaaataaatgaaaaagagtctatttctattaaataatttattagataattgaaaacagaaaatgtcgagaattattcgcaactaagaataattacaataaaaaatcattataatactacatctatgttagtattttagtgccacgtctgtattttaattaaatattaaactaataaatgaattaaagttatacattaaaatggtggatggactaaatttataataaaaaaataaattttaaaaataacaataataaaaagactaaaaatgttttaacaaaaatttaaaaatatattatgagtattatttttctttaggagaattaatctttatgactgtcacaaataataattctttaggagaattagattttatgactgtcacaaataataattgtttgtcatgtcatcttggtcacactcactaatgaaattaataaataagaactgtaaagttatattttctaagagttcaagaattaattcattagtttaaaagcatagaaattaagatattttttgactaaaaatatacaagaactaaaaacacaaattttcttagtttaaataggatagtttttttcttcgagaaaaataggattgttttttacatttacgggacacaaatttatttttgaacaactttttctaccttaagaaatttctcaagttttctttaatattttcaaagttttcacttactttaatgggttgttaaactccttaatcaatcttagacaattaatctccgacgtttctattttcttcttttatctttctttaaagtcttgatcacatttttagttgaattgacatgtagtaatttcaaatatgcaatatgcttttagttcacaatctgattaagattttagtcaagaaaaggaattactcgatttgaccattatatgacatgcgtggtgatgtagaactgtggtgtaattatgggttaaaaagggatcaaagttccaaaaggaatgtcagagttttagtattaaaatctaacgtcctaagaaatttatatagagttcaaataaaaaaataacttaaaaatatatccttctagtattaattaaatacctcaatcatcattttattgttactgttgttatataaaatgatcaactaaaaatcaacatagctactgatagaaaaacttttggtacgaatccttacgtattaacgtcatagtattttttggatacatattaagaataaaagaaatcaagaaatttgaaataaatcttgcaaaatccttttgttgagtttgtgtgtaaagatttaatcatttattgacgcatttcacatttccctcttgttgaactacgttctatttttaaaattaagtaaatttaaacctatctattattcttccacctttttttgatacattctattttacttccacctaaaacacctactatctaggaatttacaaatgattaaacatttaataattaaaatttagtagaaacatgagaaaacttgaaaaaaatttattgtaaaattaggattaaagaaggagaattgagttatttattttaagtaaaacttgttgaatttaggaaaaatcaaacaatttaattgatttaaatattttaaataaaaaatataataagggtttaaataaaatgaacagaccaactttgcttaattttaaaaagtgaaaaactttatttgacttgaaaaaccttaaagaaacaaaaccatagataatccaaactaaaggaaccaaatataaaaattaactcaaatttatttaagagaaaaatgttagcaacacactcctcttataagataattccttggttaaaagaaacatgttgaaaaattttcattcatgtaaaataacattgaattctgaacattagataggaatcgcgaccaagatttaaatcctaacttaacagcttcaaattcttcaaattgaatgaagatcatatctaggttacagtataggggacagaaatacaagaaccgcatgttatgcataatcaatgatgtcatgtatgcagcaagaatatcttaagttcccaactctttttccattactcatgttgatcccgtatattaaaaagccaccaaagtagcaactaaattaaaattaattgccacacgtgaaaggaaaatccatgatccaaaaaatacatttcatgcatcaactgaatctactactctgcttacccttggcattatatatgcgcatatgctaacacattataaatgttactctcaatgcaccagccaaccaagtacatcaaaagcagactcaattaggaaattagagcactcatgcagaatgtgaccacatcatctatattttccaagctccatcttaattcctcttgattgttctctgaccataatgtatctattattcccgcaatggtaaatataactgtgcaggaaggttggaatccatttctaatcagttgcgtgagacaaaaacttacatgtccttaatgtacagacaagtcgattatgaatagcaaaagcactcgatacatctagttcatactagctacaaatttaaattatactactttcatttagagcttaattttgatacattgtcagtctaaagatttttatatgacaattagggatagatattaattatacccagactctatgggtacccgctcaatggaatggatcaaggtctgggtatttacagcaaaatttaatgggatggatgcaggaacgagtactattagtctagtacccagttcatcccacacccgcatatatatatatatatatatatatatatatatatatatatatatattaaaagagatctatgcactcactatcaaatacagaaatttacatacaaaaggtaattttaagtctataaattggctttaccatcattaccaattttttgagctgcaattcttagcagctatatcagtaggcgaatattctaagacttcctttggttaatcaggtggttagtgcatccggaagtgaatttggtgatccaagaattttgccaccaacatcaggaaaggattcataatcatcaagtgcactgacttttccatccctgctgatcttaactggatattgcatcaagtgtcccctcatccgattctcttcctcagacacatatatgtcccagtttcgtttggcaattttattgacatgtctgacacattccaggttatgaggttcagcaaaacaatgatcaagactaccaaggtgctcagcccacagtgacattctgtatccatacacctacaccaacacaatctttgagggaattgccaattactgagaaaagaaaagatgaaattacataaccaagatctattcacagatctgagtttatgctacgagtccactagtatgagagggtgtcatcaattatgcttacaatgatttattctgataaaatagtatacatgatttatccaaaagatataaactatttaatggtgggttggctctataacactttgggctgatacaaagattggaacctcaagattatactttcacacacacataaatatttagttaattaactttttttggtagtgtctaattatttcgtgtgtttgcaatatgtgctatatatatatatatatatatatatatacatacttttatcttagattaatatgctcaattcctatctagtacaactattctagctcattaacaaacgtagctggagcttcaaacctggccacgtggatgagcattcttttctgtccatgtatattttggttgataggcacccatagctatttctgtgtcccttgaaccatctaaggatctctggttaatatttgctgatccaataattacgtattcgtcatcaactaccattcctttggcatggacataaatcataaaacgtctgaattttttaactgatacctgattatagaaagggaaaaaataacaataagatcataaactatcaccacataaatagaaaaagtctgcaaatggatcttgatgcaccaactgattacttctcaaatgtaaatatgtaatggccattatataatgctgacacttatataatttattcaaaactaagtaaatattcatttggtagataatccatgatcatttggcactaggcatatatttcattgacaaaactaatacaaacttatggaatatctgtgtgaaatgttgaaaatgataaaatcagaaggaaatattttcttttatttcatactttttgaagttgtattttccgtccaaggaatttgatccagaagaccaataaacattttataaatttaacttaattatgtttaagttaacttttatactaataagtgacacagatatagatatgaaggccgggactttaatctccaccaacttcattcctgctagacgagaaggagccaccttgctcattactcatcacacatgtatgaaacttgctttggccaacataaaaagcatttataagtgttctgtatgtttccagaacacaaatgtataacaccgaagtgctatgtggttgctgtttgatcactctaactctggagttcaagggagtcaatggagaatgacaccttgaaacagaagatcacagagatacaccaatggaagtggggtgtgtgctctgtgtaattgaaagagatagagtcagagtgtgtgtgtacctttcaccaacgagcaagctatatttatagatgaaatacctaactgttggctaactgcattgtgcgcgagtggcttcctatatttccggcctccacctgcacgttcataactacctgagtggactgagtcttggtccacgtacgttgaatctcaataacgcatcgtaactaattgggccttaacataggcccaattatgactccagaacagttgccccccagcccggttgcggagtacactcggtagccggggtgctttctttgacgtcacggttgttgggttgacagtctctccgaccacgattacctgccttgttatagattacggatacgattctccgaccacgtttatccgggttcaccctatccagacattttgtgggcgaccctatgtaattgtcctattcagtcaacatccgaggtcggaatcatatacctgttgaagaaaaagatatgttgccgaccctattccttaggaggatcgtgtccggattttcggcgtaaagcatagtcgacctacatttcatccggatagccgtcctcggacgaaatgcccccagatatctatcccttgggttttgaaaagctgttgggcttccaccctggcgtcggttactgttctttataattaaaggtaatgaatgcatttaatgcacctgtctcttcactgacctggtgatgattgttatggacgtgattttaccataataccctggtgtcgtttcagtttggcaactgagccgtttcttttcttctggcggttactgaaaactgccctcactttttcaaatttgattttcaaaactgcccattcgtgtctactactccatcgcttgtcatttctgcttatttctttttctgtcacttcctcttttcctctcattatcctctcgagtgtttccttgcgccttctgcaaaatcttccttcgtttttcaaacatcttcaacttcttcgttatcaacaggttagtatcttcttctcttctttttctgcattgtttgttgttttggcattgttgtgtttctgtcgatatcatcatttcttaggatttctccacagtttctttctggctattctttagttcttgagtttttcttcacaccttttgggtttctgggtttcgtctttcttctctggtttacttcattctgtgattattcgtttttgagatactatgaaattcacccctgaagaagaggcgaatatacgcaggaaatttgggccgcgttccgcttggctgctatatggccttccgcttccggcgggggaaaacccaaatgaccccctgcgccgccatactggcggttccttttcttccaaaaagcaagggaccaccgcctctctcggtggtccatctccttcatttctctcactacatccgggtcctgtagaccctaacccggaacttccagggccaatagtgtccggtcccatctcctctaggactacgtcttctttgggcccttcttttcttgggcccaatgttgacattggtaacccccaaaatctctctttagtcatttctagtcgtaatcccaatcctccggctagcccttctcctcgttccgggtacgaatcgtcctcggatggagtgataactattgagtatgaggcctgcatgaactgtgtgtccgaggccgttaactttatccaactggggtccgacgacattgcagattcaatccttggaatgtgtcgtcataaccctgttttgcgtcctgctttcaaaggctcgcaatctgggcggcccgctcatgctgtcgtcggcggggtttcggcctcggtttctcgtgattttaatgagttgtctccaggtacgttttactaacttactttcttacttcattttcgtaggtataatgggtgttactcccgacacagtggacgaatctgcttcagtcgagtctcagtccgaggtccccccagcgttagcgtctaggttcccctgggtcacccatgagattcttcgaacctcctccgcccttggtcttcatagtatactgtcgaccccagtggggaggcaggacaggtttgtcctgcaggctcccctacccggcgagccactttgtgctcaacgggagggtaacgatcctaatttcttcttcttttttcaagatgtagtaacccaaataggtattatcttccctttttcttcttttgaaattgaagttttgaaccaccttcgggtagctccttcccagctccatccgaatagttggggttttatccgttgttttgagttattctgctcggatttgaaaatcccgtgcacagtccccctcttcttttattactattctcctcatacccctaggacgggtagggagccttctaaccggaagggatggatttccttccgtagtcagagtaaaaggaaactctttgagcctttttcggattcgttccggggcttcaaagacaagtatttcaaagttgctgcgtcgccccattgtcaacccttcttcctgtccgggcctgagtcttctgatgtggagtgggtctttcctttgtactggtcacaagaccattataaacatgatcactccaattatcgttttatcgaggaggaactgtccgactcggacgcctcctctgtcttcgtaatttctgaatttgtgggtgcttatggtcagcccaagacttctgactacatcggcagcggacgtcaaactggtctgctttggtaattgtattttcttggttcacacttgaaatttatgctaatcttgtaaatttttctgattgtagccggcatgggatcccgacctcccccaaagtccaaaaccgacgcggcccacctttccaagccgactgaggccaggggcaagggcaagaggcccgccaatgacaaccttggcggcgcgcccaagaaacggggtggtccttcttataggacattctttgatggcggccccccagttttgtcgttggatgcgccgtcgactgcacagcctgcccctgcacggcctgccccttccccgacattgaatccggtcacagtgatcgatactgtggaccttactgtggccggagatcggtcgcgtactactcctccttccgactccgagcagctccgggcgcgggatcgttcggataacttgtggaaaaaaggggttactgaagcattggtccgtttgaccaagcccccttcttatatgaccaacccgggtgccccagtgggggaagagctggacgagatggtcaaaattgaggagtacgcgtaccgcagcgcctctctggcccgggctcttacttcggtccgggaaaagtaagtgttctttcaataattttttatctctatttgctcaataaatatgcttctaagtgttgtcgtcgcagatatggggtggctttggaggaaaaggagaaggctttggaggagaaagataaggctttggaggagaaggataaggccttaggggaaaaggacaaggcctgcacggcgcttgtttcccttgaggctcaactcacttctctccaaacgcaatcggcggcggaggccaagctgttgaaggaggagctgctcaaatctcaagccgactcggcctcgttgcgggtagagttggctcgatcactgagttcccttgaagctgcggaccagaaggtggccatgctgacctcaaatttggattctgtcaaggctgataaagaagcctgtgttcagaattatgagggtcagttggctgctatgaaggcgagccttcgtgatgctgccgaggagggtttcagcaacgcccttgaacagattaattttttgaaccccagggtagctatgactactgccgggatgcatttcttggcatatgtcgaagacgggcagcttatccctcctcctgcatccgaagagcctttggcggctacaacagaagttgtgtcgacagaagagcctactcctgccgatgctactgcttctaccgacgccgcccacctgtatccggccccgtttctgattcccaacccccgcaaaactgaaggaccagaatgccggttttatcttgtatttttctcttgaatgggcccggtgcccggaacaatgattttaaattctttgttgggctcggtgcccggaacaattagtaaatttgtatataaattgttcaagttcttcacttgattcgtaaaatatcttgcgcgcgcatctttttggttccaatgaccatttgttatatttgcatgtattgtatgtcgttcacgttatccgaccataaacaactttgctaacgaatctgttgtccggcctgatcagggccgtttagcatatcatttatagtcgttatcataccatgaaaccgtatagaatggctcaatacttatggtattcaaaaattcttgcatttatatccgttgttacaataacaatatgtgtgtccgagtaggatcaacactttaggattacaacgatataacttattcaacaaaatgaaaattttgctcaggaaatgtcttcgtcgcgaaagaggaccatatgggctcggatagacctatccggaatccataccctcgatcacgagatcgtcctgttcgacttcctgatgaatagggaccatacgagttcgggtgttacttttcccgaatccatacccctattaaccagtaggtcgacagtttaactgtaatattgcttcaacttgttcgcattccatgttcgtttgaccggcttaccttgtagtgtttctaacacgtacgctcctttatctaactttttagcaacccggtatggaccctcccagttaggtgctagttttccatcccgggcattcttgtttccgacgtcggcacgtcgtactactaagtcggttttttcgaactcacgtgggacgacctttttgttgtacttatacgccatttgctgttttacctttaactcctgggcatgtgctgctagccggacttcctcgatgattgtcgactccagagctaagacttcgttgtttgtttcctctccggatagcaatgcttgttttcgtcgccatgactgttgtccgacctcgactgggatcatagcttcgtttccgtatgtcattcggaatggtgtctccccggttgatgactggacagaagtccggatcccccataggacatagtataattgttccacccaagtcgatccggcctcatacatccgcttccatagggcctccagaattgttttgtttgcggcctctgcttgtccgttggattgaggatgctctactgatgcgaaccggtgtcggatgtggaaattagccatcatctcttggaatcctttgtctatgaattgggtcccgttgtcggtgattacttctccgggaattccaaaacgagaaattatatttctttcgaagaatttttgtacccgggccgacgtgatggtgtttgacggggccgcttcgatccatttagtaaagtagtccacggtgactattagccacctcatctgtccctcagccggcttgaatggacccaggagatccatgccccacttataaaatggccatggggccgagatggattgcaattcttctggcggggataataaccttggcgcatgcatttggcagctttcacaggacctcacatgttttgtggcgtctgcgctcattgtcggccaaaaatagccagcccgaagtgcctttcttgtcagtgcccggctccccatatgctgtccgttgattccttcatgaatctcggataggatatagtcgacttggtttggggccacacataccaacaaagggctatgcaaccccttcctgtataattctccatcgaccatcgtgtacatggccgacattcgtgtcaggcgtcgggcttctaaatcgtcgtctggcaaattcccctttccagaaaatttactattgggcgtcgccaatcctggtcggtggtaatcatcattacgcacgtcggttgcatcgtttgctgttgaattactgttcggttgttcccgggttttttggtgctcgccagctttgataggatatctgcccgggtattctcttctcgaggaatgtgattcactgtaatgtcgtcgaactcggacatcaattcatttactcggctcaggtatttggccaacaaaggccctttcacttggtatcgtccttcgatttgtgccgcgactagctgtgaatccgtgtaaacctttacgctcttggctccctgttccttggcttgcaccagtccggcgatcaaggcttcgtattcggcttgattgttcgatgttgggaagcctagttgtaatgaaatttcagttgctacccctccgagttctcgattataatcccggctccactccctttcttgttggaagacccgtccacaaacaaggtccaccactcgtcgggcattgggttgtgaggggtgagttctcggacgaagtccgccaacgcttgggacttaatcgcgtggcgggcctcgaatttcaaatcgaactcggacaactggacggcccagttggtcagcctccctgccaaatccggcttgtgtagcacctgtcggattggctgatctgtccgtatgacgattgtgtggctctgaaagtatgggcgtagctttttggcagcgacgatcaaggtgaaaactagcttctccaacttttgatatcttaattcggagtcgcgcaatgctcggctcacgaagtataccggcttctgcgtggactctacttctcttactaaggctgcacttacggcttcttcgcctaccgacaaatacatgatcagtacttctcccatttccggccttgatagtaccgggggtgacgctagtgactgcttcatgttagtgaaggaggcttcgcattccgggttccattctatggcggcctgtttctttagcatcttgaaaaatggcagtgctttttctgctgactttggcataaatcgggtgagagcggctattcgacccgtcagttgctggacttccttcttgctcgtcgggaattgcatgtccaacacggcgcggcacttatccgggttggcttctattccccggtgtgttagcatgaaccccaaaaattttccggccccgactccaaaagtacattttaacggattgagccgtatactgaaccttcgtagccgaccaaaggtttcttcgagatcttcgacgtgtctgttagcatctgtcgacttgacgatcatgtcgtctatgtagacttcaatatttcgtccgagctgtggttcgaaaactgtgttcatcatcctttggtacgtggcccctgcgttcttgaggccgaatggcatgacgttatagcagtaattagccctatcgccgatgaatgccgttttctcttggtcgtccgggtgcatagggatttggttgtatccggagaacgcatccataaatgacaatactttgtacccggatgagttgtcgaccagttggtcgatatttggcatggggtaggcgtccttcgggcacatcttgttcaaatcggtgtagtcggtgcacactctccatttttcgttcggctttcgcaccattacaacgttcgacaaccaagtggtatattgaacttcgcgtatgaaacctgcttgcagcagttcgtcgatatgagcccgcaaagcctgtgctctctccggccccagtttgcgttttttctgttccaccggcttcgaccccggatacatggctaatctgtggctacagaaagcagggtcgacgccgggtatctctgacgccttccacgcgaatatgtcgatatttttcttcagacaacggatcagcctgtccctttgctcaggttctaatgcccccccaatgttggtcacctgaccggctgaggctccgattacgatctgttcgactttcttcacgggttttggtctccattcatctggggcttctcgcatatccagctccacgacgttaacggaacgtattaggttggaaatgttgttgtcggtgtctttctcacttttacgaaccgtgtcgtaataacactgtcgcgactctttctggtcgccacatatagttactactcgtctgttgttacccacgaacttgagtttctgatgtttagtggacattaggatgtcccatttatggatagtcggtctccccaatatcatgttgtattgggatgggaaatctgccacgacgaactccacttcttcggacttgtaagattctctcgttcctagggttaatcgtagacggatggatcccatcacatttgtgttgccgccgttgaaaccgatcagcatcgtcttgcagggctttaagtcttttacatccaacttcatcttccggaacgcagtcaacatgataatatcggcggagctcccattgtctacgtacattcttcttaccctgcaatttcccaccgttgccgatatgaccagcccgtcttcatgtccgggtaccactccctccatgtcctgttcggtaaaatacaagagaggaggttctggcttttcgacccgggctttgaatctgggttgtgcctggaccgacaatacctctttcaagtactttttcctttgggtggaagtgtcgccgccaccacccatacctcccgagatcacgttacactcgaactcgggctccgggaactcgtcattgtcttcccggggtttctttccttcgtcttttcgttgactttcttctcctttgcgtttattctttcttccttgtgttcggatgacgtactgctttagccttccttcccggatgaacttctcgatcgcatcccgcaggtcccagcattggtcagtagtgtgcccgggtccgttatggaactcacagaattgtgacttatccaatccggccttgttgaaaacggggcgaagacgttccactttcttcatttctgtaaatgcaacttccttccaaatttgtgaccgggacacgttcagtggagtatacttctcgtatttgttttcatatcttgctggtcgggattttggttcattattccgagttcgattctcggaataccctctattctttgggggcggactcctcttatcatgacgttcttttccacgtccagggttattgacgacttccatctgttctagctccaaatatttcttcgcgcgagcacgaaactccatcaacgacttcaccgggtccttatatatggacttggcaaatcttgatgaaccatcgagtccggctgatattagatacacgtggactctctcctccaacccctcaacttgcagagctgcttctttaaacctatccaaatagctttgcaaggtttctccgggtagctgtctgactttgcccagagtgaactcggacttcggctgctttttgctggtcgcaaaatttaacaggaacttctgtccgaaatcttcaaaatttttgatcgacctaggcggtagggtatgaaaccacgtctgcgccgggcccgtcaaggtcgtgacgaaaattcttgatattatgggctcgtcaatcccccggacacacatttgcaaatcgaactcgtcgatgtgcacttgcgggtcctgtgttccgtcgtattttgataggaaagatccatcaaaatcgtccagatatcgggccttcacaatgtcgtccacaaaaggactgttattttgatgcccccgactatacttccgacggtatatggggcccgtcttctgacagaaattttgttcgcccttcttatcgtgtccgtcatctcgcggaatcttctcattacttacccgtcgactaggattgtcgtcggggatctgtcctacgtcgacctcgtcacgtagctcgtctcgactccgattcggttcgtcattcctcctttgatctcccgggtcggcgtcgcgtcgatgagttatctgagttctcaaatcttgtggctgctccatccgcctttgaacctccgagtctgtattccttctttgattcaggtgcgtcctcaaatcctccgtctcgccctcaggatttgagagttgcacccggtcagctatcattcgcagctgttgctccaattgcgccgttcgttgcatctcggcacgtctccattcttcattatgttcttcaatttggcgagtaatgtttcggatgtcgtcttgtctttgtaaattctgccgtttctccatgttctcaattcgggttaggattgaattgaggacattgctaactaactgtcctccgagctcaccctcctggcctatcctccgtgctataggagtcttctgttggtctgtctgggcgggagaggaagcttcgtcggaaacagcctcggtcacgtgtacttcttctctccgcgccacattctggttctccggtaggtaaatctccctgttcggcatctccaaatgcggtacggaatgactgtttcttgtgttaaccattgttgaaaggtgtgagactcgaaatttaacgttccccacagacggcgccaatgttctgtatgtttccagaacacaaatgtataacaccgaagtgctatgtggttgctgtttgatcactctaactctggagttcaagggagtcaatggagaatgacaccttgaagcagaagatcacagagatacaccaatggaagtggggtgtgtgctctgtgtaattgaaagagatagagtcagagtgtgtgtgtacctttcaccaacgagcaagccatatttatagatgaaatacctaaccgttggctaactgcattgtgcgcgagtggcttcctatatttcctgcctccacctgcacgttcataactacctgagtggactgagtcttggtccacgtatgttgaatctcaataacgcatcgtaactaattgggccttaacataggcccaattatgactccagaacaataagtaagaatctcacatttataagtgcagcacttaacctcccagacatgtgatttccaggacttgttaatccatcaagattaggtgctttgaattcaaacttcgactatgttgtaatttctatttagtgctttgtccaatcataggtgggtaatgaatgggtaagacagaccacccattattgaatcatgcactatggggagattttaatacttacatgtagccagacatgagacaccatgaccactgtaatgcttacaattgattagtttgaattcgctcaagagaaaaccctagggatactcatagctccattcactaatacacaatccaattacaaattagggatatactcaatccttgggattggttgaatgaaaatacagactatataatgtgaatgaacacactttttcaacaatatactttcaatattttctttttctttttttaatcctataattaccaatacaaatctttttcattcatttcaaaatattattagtatacttttatttttatttacatgttcgatccttttaattaataaatatatttttgataatgcaccaaacattaagccaaaaaattataaacagaagagacaggcaatggtgcgtccaaagcgatcccaatccattacatccaaatcatcctccaatctgaaccagcgtcgccacctccgtcatcgagccaccgacggactccgaccgcgccatcgccttcgtctactactccccctccgcgccgtctgcttcacctacgacgattgtcacgtcgttcgatccatcctccgcagcttcttcgtcaccaacgacgagcacgaccgtgaagagctgcagcacatcctcggctgccggatgaagcaacaacgcaaccaaacgcacaggatctaagtttatttgttcagatctgagtttctttgcacgcacattgccatttgaacttcaaccgctcatactttcgcaaccttcgtgactctgttttgtgttcattgttgttcttgtgttcatagctgttggtgggtatagggggttagggttgcgagcggaattggtgaaggtggctgtggtgcgtgcccgcgacggtggtaaggggtcaggatggttgttggtgtttaggaaaggaaaaaggttagagattacgatttttttttttttaaataaaataaagatagtgatgattaaaaattattactgtattaaaataattatttaaaatttaaaatactaatgaaattaaatgttttaaatgaaaaactgaaaaaagtattaaaatgatatatttcaaaaatataaaagataaaaatgaatttttaaatttaatggatcattaagtctatttttgagttgtacccttttagataatttcttatgctgtaataactataaattataagttgttgcaggattttctgcattatgatcctaagccttagtacacaaggtaaagcaggcacaacctattgtcgaagttgttatcaatttgtagaattcaaatgttgctataactattctgatgaatgatgaaggcattattgtgacaagaattaaattcttgtgttttcataatgagcacgtcaagaattctaagtgctgttcaataagtatttcaaactgcatgcaatgcctaatttggatatggaaacacaagtgtagttaagtttagcataccaaagcccggttttcagatgtatttggtgttggtgaaatatttgtggattgtggttctctctttccaaggcagtaaaaattgagataatcttgtggatgatactgataagagagacctgctttttcaagggcatcagctacaatctggtacatcatagacattgtctgtccctatagtcatccaaatttcaaatacatgggttgtgataagtacacttcaatcatatttgttatgccaaagaataaacgaaaaacgcagagataaaaagaaaagaatacatatattattgtggttcagctaatgagacctacatcacagacaatgagtctcaaacattgaaacaatgaacatccctatttttactctaacttgcaagtcgataaatccatttacattctaaggaagtacataaaaaactggcctcataattcaggacaactcgttaacaaaattccaggcctctcaacgatattcataaatttgtgtcacttatgttatgtacatctattaaatattggaatatcaaaccccagattcatccttccccttatggtttgtgagttcattttcttcaaccaattgaaggcgaaggaaaaaaataagtctatgccaatatataaattgaacgaaaaaatgatttaggatggcagtagaacagtttgaaggaatttttttttgttgtttttttttttttggtacatagtagaattttaatgacaataagtctgttgcatttgacaagtttgcagtgattgtggattatcattaaccacattgcactcgtttccctcaaaaaaaatccattaccaggtaataatatataagtttgtggaagaaacacgttctaccaaactgacttcctaatttagacagactcacatgaaaagtactgaaaatgttcatctgcaaattttaacaagggaatatacagaatagaaattggtctgacctgccagaacaatatttcttgaacagcagcacttgttggaacaccctctggccacattggtataactatatatacacaaaaacgttcatttgcaccaatcttaccggcaattttcaaagccaactccatgggaaccaatggtttgcacctgttaagataagaaataaaaaccttacacttgcagtgtatttgtaaaaactacagcaatgtgtatctcacaaattgacttaatattcaaatgctactgaaacttaggatcaggagagtgatatagttcccttaaatgttagcaagaaatatgaatttgtataatgtatgcaggcatttgaaaacaatattacaaaaagagaaaaaataaagcaataataagcccttcaaggtgcacaccatatttacctaataaactctaagataagaaatctaacatggaaatgaatgcaaggttgcagacttatgtctttatctcctccttttatctcgcacatgaaccatagactttattgacttttactgaaaaaaacaagtgtatccttctttcaattttcaacttcctctcttaacatccaaaactccctctaatgccaagtctttatcttggatagtgacacttaacaggattaatatgcaaatgatttgttgtatattcatgcacctcccactaacctgtcatggttattccttcatagatacacaattatatgttctgggtctgagacatatatataggtacattacctaaacgccagaattttgattttgtaacaacgcaaaaactagcaaatgccttataaagttgaagatactgaaaaattaagtttatctacctgcattgtttttatatgaaggccaatgataggaggagcccaaaaaatactgattctcaatatatacaaagtgctcagcggatcttattgctctcacataagcagtatggatgctttgatctactttcaaattttttccacaaaaaagattctgaaacaaattaatattaaaagttaaggactaatttatctcaatataacttgaaaccacaccccaatgtgaaggtaatgaaaataacaagaactcatagtataaaggggcatcacgtataactttgttctcacctgagccttagctttgtcaacatccttaggaaatcccttcacggatcctgaatctatggacctaaatatctgtattaaatgtaaattctagttcaaatctttacttgattttatcaggggcacgtgtacatcacagttctatcaacatatttccatacctgcacattccaactctcggatcattttcatcggttacatgaacagatttatcgccgttggaacaaggagaaggtttgacaatccatgaaatccggtctagccttagcaaagcatcatcatgccaatttgtcacctttttgagcctgaagtcgcgccattttttggccttcctccatctttgttcaaaattggtcaatatatcatatgcgctggaccttcaattttgcaatgtaagtcatgccatggctgccttggtgcacacgaatttgaatgtaactgtttcatatagcacacaatttcagcaaattcccttatgttatttttttctcctttatttggtgctgatgtgtgcatttgttttccttctcactttcacccataaaaccgtgaatatcaaaccatagcatatactatgtgtatataaacattgacataattgattttataatgacatatgaacactctcataaggcaaaatcaccatataaggcaacattgaagaccaacagataatctagcaaatgaagtttatcaaaattaacagacaaagaagaagatttgggaaaactcaagcaaaatcagaaataaaaatttggttttgtttagagcacagcatcattctttaatctatttaccaagcccaccccagtgtaaggctctcgcttcttgttgtcattattgttgacaaaaatcagaacacagaaaaagccagaagttggtattagtatctttattccactgtatgcacataaagatatgttttataaaattccctagtagtataataaaagagaaggcatgctatattcttgtgaattcttcaatgtttacaataaacacttacttgaaatgtaggattatgaaaatcattatgaaacactgtatctagatcacgaaaaagccgatgctcaggtgtatcatatctaccatcacatagatccaaaccaccaatgaaagctgttattttccgattattcccagaacctagactgtctacaagaacacatttctggtgatgcgtaaagagggttcccacaacctggaccagatgattcaatcaaattagtattgttttaagttatagctaaagtacacaacgtgacctcattatatctatgactactactaaatgcaagtcttccagggaagaaataatgacattgatggtgacatgaaatagctagtatctttatccaacacaattctaaactcaaatgcaagaactccgtgcctgttgcttgaaaatactgagcttattgcttgcatagcgtggagatagcacacaatgaacagtagaatgtttgaaaaacttcttagtttcttcatcatgagtctgcatgacaccatcctgcaatcaagaaaatcaaatattataatgtacattaatattaaatcttagtgaacaggagtaagtacaaagtttttatgcaaccatatctacattacaataatccatgaaggaaatatctgctaaaacttatattttaggaatcttgaaagcctagcatctcattactgaatgttaatggtgcatatacaagatagtctaagcaaatccaccccataaagaagatacatcaccactatcttttacttcagaacccacccaattttatgctaaataggacttttactttgtattactttatggtatgaaagtaatataatgaatttatttggaaagcagtgcaataattaggacaaataaaaaactaacttccctagaatttgatgaggaatcaatgacatcatgtttatttttctgattagggtaatgagaattactgttttcaaaagaaacttgtcatgtgaagttctgtcatcccaaatcagcataaccactcggagcccttcttgtgacttgtacttcaacagctctccaagtgaaagctctcccccagaaggcaatggttttgttgcctctctcacaagcctcactgggtggtaaactgaccatcctataatgtatatcaggtgatgagcttccaaaattgcatggcatatgtcctcccaacatttattatgctgaaacacttttccaccctcaagtcgaatttcaggtagcataccatcaggtaaatgtgcatcttgatatagagtcacactccctcctttcctgagagggaaatatgttttaggaactcctaatgcttttccatccccactactaatactttctgaacggttcactccaatttgcctatactgaacagaaatatgcaattcaggataaggttttaagcagtttccatactgaccaatgataggaaaccaatcattaacagtatttcctgcaattatcttctgaacaggtatctccaccactccaatgagttcagccccaagaatatcattgtccttcacaaggaactcagtttttgagcagggtgagcaacaggcacaataaattgctcatcccacaaagggttctcacagttagcaatcactctagtctgagcaatggtagccccagcaatgcatacagaaacataagggtcactagttatcatcttgtcttttccagagtgtgtctttagtccttttataaatggagggtggcacatgttgcccatagtgatgcattttctaactgtttccgtggataaatctaaatttggaagagacttggcttctattatcaacagatccaagtcaccatgtaagaaaaccggtccattaaggccttcatgctccctgtttggaaagctttgggaaataccaccatgacaatccatttcaacctgagaactcaaaaaagatgcatgttttctaaattagaacactttgttttcaggtgctaaaatccaaattctagatgcaaaaagcattatggaaaatggtttaaaaatatataacatgcatgttgatcaccttatgatcctttcagttatttcacatcatcatcttttggttgtaaggaaaccatgcctcttcaacaaattctcagaggtcagatctttacaaagagaggagagaagccaatgataagaaataaaagtaaaaaaagggaaaaaaaagaaaagaaagaaatttgtgtgtatatggattcatgtaacaatgttgcagttcaagcatggtccaacaccacgtccacaagaagcaggagaagtttttaggccgaaaatggtggcaaatctcgtggaattagaagtttggaacccatctctctcttggtttttcatttcctgaattggcatattccaaacgaaatccatgcatggagacaaaatgataaacaaatatataaagaaagagattggtgaggtggaagctgatggagagaccgagagattggagacattttgcatggaaccaaggaacttcgtgctctcttctagttacccctctctctccgatacacgtggaaatgtttaataaaaggaaaaaagattaatctatttttaacatcatgacatttttcacatttatgttttttctccttaaactttataaggacacttaacattttcaattttcttccattatatttttagtaatttttatctattttattattattttaataattatcacatttattaacttattttttctttccatctctctcttactcttccattcaatctcttttattttgaccatcataattttcagtctttttcctatgttttgattttaaatccttaattttttttgtctttgctctcaagtaacaacaatttaaatgatgacttaacaagacgttgataatttattaacttgtcatgttatgacaaatagtcatacaagtttattttaaaaaaaatgtgtttgtatgtcctcatatattcaaaattgtggacaaattttatatcataactaaattaactattttttttataaagagtatgaattacttgaaagagtattgtatgacaaaagaaataataatatggtgagaagatgtgaattaattgaaaatatatattaacattgttcctatcacttctcttgttaataattatcagatatggttcacccatattttgttcaattactatcaaaacctatacacaaaacattacaattgggctagtcatgttacttgccaattgttagggattttcttactttaccatttgaatctcaaatgcaccattcaaattttgtctaatttcaacattgtccttttgtacttcttcttccttcctttcgttttccatttcttcttacaccattcagtttctcttcttattttgctgacctcctccttccattggctcttggaggtttgttagttacattgttgtggtggtttgtacatgttgcattcacttcgtcgtggtggtggtgggtgttgcggtgcaacatcagagtaagtttttacatttgcaaaatattagatacatgtcatacattgaatatgtatgggtcatacagattgtcaatctgtataggttcaaacaaaaaaaaattatagttaatgaatttgtattatattaacacttaaattttcaaatataattatatcatttggataaacaatttaattaaagacttattgaatagtactcatgaaaataatttaaattaattgtttcatataagttgtaagatcttttcaaaagctattatagagaatttattgaaataaatttaacatagcttaacatattataatctattttcataaaaactttcagatatttacacaagtgtttgtcaaaaaataagttcaaataaattcttttaaacagactttaaataagagatttgaaagtacaactatgtgatcttatcaaagatacaactataatttcatattaatcttttagttttgttggtacatgataattattagttccattaattaaagattatgatctaggaaaaaaatctcaagaaggaaaaagactaaatactaaagacaattatcttgccacatgcttaataaataattttcctttgctatttttgatgcaattttagagcgagagaataatatttaattaatgatagaaaaagttttcaaattgaaaaaatatctattaaatattttaagaaattaacctaaaactcgtcaaatatcaaactgtattttactatgctcgattaattatttaacttaaacttttttttactacatttaataaatactagtatgttttattttcaatttaagagtattttcttgaagttgtgggttgatttgaagtattagactaatagtgggcaaatttttagattatgattagaatgagaggattgcatcaggctttaggcaaaggttagtggtgatgaggaagaagccctcaacatcgaaggctacaacatcgacacgtaactgttgtgagaatattagcatgtggatcatgctgccaagagcctcacaatccagttacggaagattaggtgttattcataggtttttcaggcggccctaagatacatcagtgttgacatcatatgttgatcatgtagcagctaaagtgtggacatggaggtagttatttctttaattataacatttaatttttttgtcattttaatttacctaattaattataattatttgcagaacatattgacttgaagttggcctctcatgggaggaaggttgagaaattaggaagacctgcacctaaattgaagatttagtggttggttcgagcttaagttcttattacatgttcattggagacaagagaagagacttttgtctgcttttgcgaagagatgacacaaggaaactaatattttcatctgcccatagaagagatgagtattacctcgatgatgtgcatcgttgttacatctgccattataagtgcttccatatctatgatgcaatagatgtagagcaggttgtagattgttagttgagttgctaggagtgactacacaagaagcataagatgagaccatcaatgtagatgagacagagcagactgtggagttgttagttgagttgcttggagttgttacttctacccattatatgtgccttccataccaaatgacatgcattgttaattttatgcatccggttgttccaaaatatatcacatacatcttcatccttcatctatgccaatgaatatatatatcgagttcatgtacttcattaattgttacatttagtattactgtctcttatagaagaagatatgcatatcttgcattgtagaattgcttcattgctgtacaattgttggcattgtggtccttcaaagttaaagaatattttttgttttgaccatcgactttgtcatatcaccaacaataatcttttcatcctcattaatcgaccaacatatagatgtcactcaatgacttagtcaatgcatgattatgagtacacatattaagttgatcatccaccttcacctcccaggattggtttcgctcacagcttgacaaccacatttttagtgctagtcatcgtctgtactaaatctatcatgtatgctctatatttttcactcctctcacaatcaattaaaacaaatgaggtctttcctctctttccagttgatgtgtcggacctcattatcacaaccacaaaacaatatcatacgcaacaatacgaacccattgcaatatgtcatcatgggtagggaacacctacaaaaggacaatacatgtttcgtcttgttaggacatttatttacttactttaactaaatagaaaatcatatcaatacttgagacattagaacaatcaatattgtcaaccacaacagttcctctcccctatcttcattcatattaatttcttcatacataatgttctcatatatcactcatctttgttcatcttaacaaaacattaaaaaaaaaaaattcaatgacaaattaagaaaactaatgaaattcgatactatagcccatacggattgacatataataattgatacttgtatatacatataaaataatttatctcttaataaaatatatccattgttattacttttaattaattctaattattttaaaaaaatccatatattttaaaaacttcaatgtagaaatttattttaaaatcttttacacttgagaaaaaatatcaatgaacaatgaaagatactaatgtaacatgtatgtagatatatcaataaatatatttttaagatatagtatgacacaattttattatttttttggtacatcaaattttttagtttatacatacaatttgttttttttttgttactagaaaaaatataaaataaactattcaaatgtatataatatagtaatatattatattgaaatttataaaaggcggtggcgtacacacacacaccaacacacacacatatatataatgatttatatctaaatttccatatttcattattattttaaatatattataaataactattttatacttttatatatttaaaaatcaatataaaaatttattttaaattttctagacttgaaaatactatttatataaatatttaatgttattatgtaatatatttatacaatatataaataaataaaattttcttatacaatatgacctatttttgtatttaactatttttttaaattcattataatttttttaatttttataatgcttataatattggtaatctgtatagtctttacatattgacaaccatatggactttatggattgtcaattgtatggacaatacgaattagtagtatttcacatatgtaaaaagctatgccgtcgttgtcattgcaacacccccatgacaatgacgatgaagtcaatggaacaagtaacaaaccaccacaagccaacacaaggaggatgtcagcaaagtaagaagaaatgaatggtgtaaaaagaaatggaaaacgaaaggaaggaagaagtaaaataaaaaatattgaaattaaacaaaatttgaataatatatttgagattcctggtgcatgaagaaaattccgatcgccaaaattaaaattaaactcttattccaccccgaccattaaagaggaaagaaaaagataagaaaaactattgtgcataaacagtaagaaaagcatcatcaaactaatgaattaaggtgcaacaatttcacttgttatcgcaaatatgacaaagtaataaactcacacttcatgatttcagctagctaactagccaatgccaaatcactataacaaaataaaaattgaacatatagatagaattagaatagcaatggataagattacatcatatatatattgatcattcgatctctccctccttgtgtgtctcaatgacaacgtctgacctaggttgagcaacacaggtgagaacccagccactttctatttggtcatcatcaaggaagctaccatctgactgatccacgttaccttccacaattttgccaacacaggaaacgcaagaaccagacctgcacgagtagggaaggtcaatgccttcgtcctctgccttgtcaacaatgtaaacatcatctgggcattcaaactccactggtccttctggggttatgagcttcaccttgtacgaggccatgcaagtgacacgaccacctcgtccacttttcagaccaaaaagagattcaccaacgttggggaatgtctttaggcttgtggtggtcataggttgcctcctcatgaaggaggtgctcaccatggttccggatagagctgctgtggtggccattgaatgcacaatgaaatgaaaaacactggaatatgctatgcacttggtttgtgttttgtgacaacttattaagggtgtgggcttgtggaaatagtgtgcttgcaacacataacaaggtgaagttgcatccaaccctatctgccacgtggcagcattgtatgcatgggtttattatctcctttatcaccacgcaaatagtggttggcacaaccctcgtatcattaatgttcaaatggaacaagttttttgtatggttctgacttaaacaagttttagccattggatgcaagaggtctatctacttgaatggttttcaaaactccacttcagtaacaggtagggaattacgtacatatgagagccacaaagttcagaaagcaactcatagttgtcacagcagcaacaagatcgaaccattgttaattttataataataaactaaacggtaaagacactacaaacattatttatcatttaaaagttaaggaagcagataagaatgatattcagatgttcatacaaaattcatttccgagacttcatcccctctttacatatattgaatagttgaaacccatgttgggaattagacatcagtccttcaagggacccctattttataaggggatgaaacagtaaccacaagagttgaatattgtactacttatctaaaattatgaagataatcaattacagccggggaaagaatctcagggcttccccaatatagaaaaataatacatcctcattctcaaaaaccctgtggattctacctgtaaacattgttaggttccctacacatgaccagaggcttcctccaaaaatttattgtcttcagcaacaaacctatggaagtgctcaggtctgactcagaaaaccttaatcgcacttgatatttctgtagatcctcctcacgaacaaatttgaacctagaaaacccacagctcctgcacatttaaagataaattataacccaagtggggcttaatcagcactagatacgatatccaatcacataagcagggtgaaaatctaaatcaaattgaagaagacttaccacatagaattcctagtccaagagaaaacattaaagtgtatccaaaataaaagctggtctggaagaagcctgacatcttcgtcttcacatagaagtagtatattgagtacaaatacacataaacagctgttgaggcagctgaaaagaaagaagtccattgccagtggtagttctcagcatttaacaaaaagtatgtccccacaattgtcacacaaacggtaacgatgataagaatcagaaagactagcagcataaagccatacacatagtacacctgtatgccacaaagaaagaaaaaatatataagccaatgtgaaggttcacccagcttccactaaaatttacacatttttttacttaaaaagaccagtttctagtattattttccttgataatgctctgctcttttgacatgcgaataacttttataaccaaaccaataagtaaaaaagaaactttatcacagaaacaagtcatagtagtgccgtgattcaccttgtaattccagaaggaagtgaatacaaaatacatttcaatgaatatgctgccaaagggtagcagtcctcccatcagagaaaccacagagggtgtaaggtaccacttcttttcaggaatgggacgaggaatagtctttacgcgacagggattattcagagcaccactccagtttcttccaacaactgtgccaagaagtgctagagggaaggagatgaaagcccaaatgacaaaaacaaccaccattgtgccaaatggaattgctgctagagacccatagaatatagcgattgtgttcaatataaatccaattccaaagcacatgaatgggaacagagaagctgtaaggatcatggatttaatccagtgtttacctaacaaacagataaaaattagttacataatcattgaaaaccaaaaagagaagaccgagacaaagccacccaaacacacttggagcaatatacagaaaattaaagaagattcttacccccatttcgggagtacatccccccactcacataaccagaaatgaaagatgtgagagcataacacacaataaagtagtgacaatggctcctcgcctgagacaagcaacgaaggaaacttacatgataatcaatgaaagagaaaggagcaaacaacagaaagtattccaactagtatgaagtagaaatagccaactgtgcaagcactgccacatgcttattacatctagtaacattagtacacaactaggttccaatgaattcattattcaaacttatgcttaagtcagttgaaggttatgcacatacccaacatacaacatcccaacaatagccaacaagacgacaagaagaaccagcaacgcaagctgagcacctgtgccaacaacagctgaaagaataactaagttgcgaggaggccgaaaaacatcaccatgcacaagtttccagccagattcttcactaacatctctctcctgtaagcatggaagaaatgaccaaatatttgacaattagaaccacaatgctttctctaggaagaacggattcatattccacaaataattaagataaaagtcacgaaaccatcaccagactttccaaatcatcatcttcccgagcatactttgcatagtcatttctcagagttcgcatcaatatcattgacaccaaaccagtaaggaagatgaccatcatgaaagagttaaaaatggagaaccaatgaatctagggaaaaagaaaacaaaggagcaaaactctcagtgacagagctatggtaggaccaacatggatgaatacatagcaattcacaaaaccataaacaacaccatttcaattttaaaagcaaagctgtacctgatgctcaaagaaaggatgtccaggtagacatcaaagcgacgcccgaaagtgatattggtagaatcccatttgacagaatatgtcatgtccaaatgttttcctacttccaaaggctttgggatatcctgagtgagattaacatgaataatctgcaaggaaacagaccttaatatgaaacttaaaggatccataacatgtcataagatagcataagatatttaagtaacttctaacctgatcatggttgtatttaacaataatgtttttgtgtgtataaatgacatgcttgccattatcactgttcttatcaggatgtaactctccaacatatccttaaaatgaaaaaagaagtgtcttagataaatcactaacatgttaagtacaaaatcatattaaataaagagaaaggagaagaggcagttctggacataccccacaaaggtagatcatctgaacttgtgtttagtgcatcacatagcagaccaaaagaaataagaacagatgctagtaagtaattcagttaaaaaagaaagagaattcaataattattaaattatttaattaaaaacatacaaggaagatcatcctttggaaaaaatcctcacaacattatgacaatcaagacaaataatatcgatgattaattaacactaagttattgaaaatacttaagaaattacttcacacagagttcttaatttaatactttcagttgtaatagtgactatattatagaaattaacactcactaaagtattctagaatgcttatgaaaaactataagggcttacttggtagacaagataaaatataagaataggataggctaagaccataataagcttatatactattcaatgtttgatgtgcaccaaataatctattatatgatatttatgctaccctttgctatgtttgaggtgaattagaaatgataaaaatataaatgtaaatgacaatattaccctttgcaagatactaatatataatttatatatatggcatatatttaaaaatacatatatatatatatatataatattataatataatttttacaataatttttatatagaataagcataagatattttggaaatttccatatactttaggtgttttctggttgcttctgctatacattttgatgttgtgtttattttattcttcatgttaccgtactgaccaaagaaataattttctgcaagcttccaacatttcttgaaagtacaatcattctacaagttgtcaattgtcatagtaataagtgaaacacacaaagcaaaacatacccatgaagaattcaaaccagtaattattctctattgcatccttgaactgtttcacctttgcttcatcgagatctatctggcaaaagacagtcttatccacatttcctgaaaaacaatagcatccattaaagccagtttgccaaccgactgctcttctatgaaatacatagtacgacagaaaccttcatactttggaacttaatttcaagttggctatcgatgagctcattgccacccaggacctcaccaagaccaccccatttgtgtgcagcacttgcactactagatggatgacaaaatgggaggctgtaatagttgtatgtttcttgtggattgttataaggaccaactttgttcacccaaaggttaactggttcatcatgttgatactgcaatttttttttttttacaaaataaaatatataatgcagtacaataactaatacatacaaaaaaaaacatcttaaaaaacagaagcgttcaccatttgatactacaaatgaaatatacatatttaatctgtttcaccagctcagtggggaaaaattccaggataacaaatatagtataggggtggggataagcgtcacaactgactattatagaaagaaaaaaaagaaaaaaaaaaaaaaaaagaaaaagagaagaacaacatatactaagttattgacatgattaacaatttgatttcgttcactgaatgataatcaattatataatctatgatagtcttctgggagaaatattaagacaccacacattggcaaagcttaaaactctatattttaaaccttctggcaaacatgtaatgggtgtccacatcaattggattcaaatttatgttagaaaataaaatccagaatctttgtctaggaagccagttgtattcagagaaccagataacaatgttattagagtaaaaaacatgcaactcataagatgatgcgctgatcttaatattacttaagtactctaaatcaaactgatccaccattaaaaacttcttatgttagggtagaatttgatttacaacctgcccagagaatcctacatattacatacattcaattatttacaatcaattttttttcatcagaaccgttccagttctaaaaagaatccatcagacagcagatatgactagcaactgttaaatttgttttaaaaactttgaatcttaaaaatggggtacacaaatagggctataattctccacatcaatcttcacaatactgaaaatagtacagatagataacaaaaacctatatagcttccatgtgacatcacaattataaccaaagacttctaaacaacaccaaaatttcttttctgttctgtccaatttcagccaaccctcttttcacacatctcttaatggatccttctatggattcaatgacaatggatgcacacaacaacaacaaactaggtaccaaagcctaatcacaatgtaagctcttcccacttcccacgtcactagtcacaatacagcctctcggtatttcaaatcccctccaaaactagctcagcattaattattataaccttaaaaaaaaaaaaacagatgatccaagatcatgaactagtaaaaggggacaaagaagtcaaattgaatctaattagcagagaaaagccaaacaatgaacagcaaacacccacattgcaaagacacctaggtgagcacaagccaaaaacccagttgagatctaacactaggaaaacacaaccattacattacaatcttaaaaccggaagaaaaaaaaaatccgaagctaagagattgaaattgagtgcaagtaagagctaaaaacgcacgcggtaggcagatccaaatcccaatgcagcaaagagagtgtagatcgaatcgaaagaagggaaagggttttgggaatgaggaattaccttgtgatctgactctgaagcgaaggcgggagaaaggaagagagagaaaaggagcgggaagaggagggatcgggattcgaagaacatggcagtgatgaactagaagagagaaagagaaagaagagacaacagaacaacgcaacaacagaggaagcacgaacggactataatggtaatttacgttgtcgacgacgaaagagaaaataaggttacgttacgactacactgaaatgaaatgaataatgacgatgagtgcaaattttttcatttcattacggtttttggggtaatacggtgaaaccgtgttctgtgactttgacggtgaagttaatcttgggctatttggtttccaatctatagtccagtacgtgagttacattatggcccatgtattcagtattcacaccccctcccccaccaccaccctttttttgtctttccactcctcactttttttctattgtgaatttttcattccaccccattcttcacatttccctcactctctaagcaccctatcaagtctcaaccccacctccttatcttcttcaagcatattctcactttctcttctacaaacacttctcttccttgttcctcattctcttcttcatgtgaggtttcgctaccttgtacttcttcaacaacgttccctttcttaaatttttttacgtgtaattgatttgataaaaactagtttcgttaaatatcttgacaaacggagattaatttcaatcaaggatatttttgtaagaaaaaggttggggtgtaaagattaaaaataagaggtgccaatgacattcacccaaattgtatgtttgggggaaggaaagtgatctctacctttacaggaggggaaagttttttcattttatgtttgttggctattaaaaaaatttagataatttttttaggaatcaaaagagttatgtatattttaattattttaccatattatataatttgtaaaaaataacatgatatttctatcatagtaataaaaattaaacttgaaaaaaacaagattctcgtcttccctaatggattttttttttgagtaacttgttaaaaatatttatgagaaacatcattttctatgaatgttagtcaaaataataaaaacatgagaaactaagtttcccaacctattgttcttagaggatgtttgataaggaagaattttttcatacccaagaaatatgattcatataaatgtaaaatgcctgaaaattaatattaatataaaatatgtaactaaaattttttctccacttgaaaaattggattcttagccccccccccccccccctcccctcctctttaagaatgtttttgcaagaatgagaatgagatgtaaaattgattttcaagaattgtgacaaacttttattaattgtatatcaaacatgaaaaacataatttatactttaagattatgaaaatttttaagaaattcactaccaaacggcctaggaaaacaacatctctagaaatactacaagggtattattcaaatgttataaagtttgtatcaatgaaaaatctaaaattaattgacttaaagtcttgtatcatgtctcgatggaaaaataaataaaaaagacactaataatagtttttgcatcgagtataatttaagtgttaaatattttattatagagaggggagagagaaggaaaagagggaaggagaagtatagagaggagagatgagtgagaggagagaaaaaggcacgtgaggagttaaaataggagataggtaaagaaaatgagcataaaaaattcaaattattatattttgcatgagaattaagatgttataattttaagtaatcaaaatattttaacaaattattagaatttgaaatatttttaaggatctcattagtatgcacgtcaatcaaatataaaatcttatatctttaaaaaaaagtttaagttttattttaattactttaaaaatcacaattatcataaaattttaattgaatgataatataatttttttacacttataccataatgtataacaattaaactcacattttaaatatactatccaaataatatatcttaacaccacaaattctaaattttcacataaattgaattactcacttcaattaatcttatctaaacacagctgattaaaaaaaatctatctaaacacaccaagtatttatagtaaaatttgattagagaatcaataattaagatcgtaactaaatattttatttttatcacaattcttaatttatgattttttatcaaataattacaaatgcctttatcataactttatctttagtttattagatttatctaaaaaatcttcgaatttagattattattcaattgattttcccattatatcttgagtttgaaacaacttcatcactattaatatatatatttgcaccgttttttaataatttagctttataactttgtctcaatttaaaaaatctcacatcttcaataaagttatattttattatccgttttcctctattaagatacgtgattatatcactattatctaataataacgataacatttctatctcttaactttttatttatattcacactttggaagatttatattgaaaagtatctctctaattaatgcgcgcttttcttcccgcaactgatcatttaacagtttggctatttatctatatacatatatcgattagagtttgattgatcagtgatttgtgctagtgcctagttagtagttattggctgatcaagtgtggtgtttgaagtttgaagaagaaacagagaggaaggtgtgtgtgaacatggagaagtaagaggtagtgaatcaggacataggggttgggagatacgcggtcgtacggcttatgcgtcacaaagaaaccaaagatctcattgccgtcaaatacatctgccgggaagacaaggtacgttgctacttatgtaaacacctgtattttgttttccaaatgatttgatggtggaaagggaaatcataaaccctaggagacgaattttttttattattattaataatattattattattatatctcttttaattgtcactaatatttattagaacttactgatatttttaatgaaaattttcctttttaattatattttttttcatccacaatatttgaatctgagactttgtttaagaaattatttatttatttctcaaatatgggttagaaaattttatactcacgtttattagttggtaataaataattattgtttgatatatttagtgttcttaaaatcggtccgtctcgacagtttggatcgaaaattaatggcctaatcggatcgattttcttattgaataaattgtgtagttgacttaggatgactcggtcaaacccgaccaagaaggttaccgaatctcaattggaccggtttaatcctgtcaattttataacttttttattttttaaaaattaattttttttaaaatttggattattatcaattgttattttggattttagaatatagatagacttttcttactcaaataatgttagttatatatttataatatatatatatatataattttaaatttttaatatataccgagataaaatgagtcaaatcaggttaattaatgacccaccgattagatcactggttttctatctggatcaatgactgtatcgggtttcacaactatgagtatattattcatttttaaaatatttaaaataatattttcatgttatatttttttaaaaaaatctcaaaattaaagaaataatatgtgaaataaaatgtgacttagatctcttgcttttaaaaaatacaaacacccattcactttaataaacattgtttttaaagcaaatttaacacttttttgcatattattgagaaggtggcaagggaaatcgtaaaccttagatctcttcgtcatccgaatattgttcggttcaagtaggtatgatctgtttttactctccctctcttctttcaaagtatttgtttggcttctattattataaaatatgagttttaggttaattttcataaaagttaataaatttatcttaatagattgtgattcagcgataaaataaaactgttttatatataatgtctgactataatatattttttcataaaataatagcattgggtaagattacaaataatataagtgaaaagtataacagtgaataagttaaaattttaaaggaaatcaataatacgtgaataatattaattggtcattaatgtctttaaccactcgttgttaatatatgtgtttatacagtacattagtattatgttgagataatttgttctatatggaatttgaactttgaaggtggccttgacttcaacacatcttacaatagttatggagtatgtagcgggtggagagctgtatgaccgacaaatttcacgtaaaatggttatggagtatgttctagattcattttggagttagatttcacaaatttcacttctacaatgctgtttttttaaaaaaaaaagttagaagatttaatatattttggagaattttaaggtgtattttttctaactattttattctgattaaaatgacaaaacatagctcctatgtatcataaagttgaaatcttttgatatcattgaatttcatgtttaatttgacatgaaggaacatgacatattctacaatgtgttgagtgattttgcatctattgttgaaaatgtgtatgaatatcaatgaattaaaagatgacgatttttataaagattacttattaaactctttaaatcctcgtttagctatgacttatagtgtgtataagattgcaaaggagatatgagatcacttgagcactcaattttaaaaataatagagactttctaagattcttctaacataaagttctttgactttaagtttaatatgaattcaaacatcacttctcaattaagtgaacttgagaacatgaggaacaagctaaaagaggacaattttgatttgtctattaatctttttgttggtcttatgttgagtaagttacctgctgaatgaaattcttttaagactgacatgcacagactaaaaaaacatatgagattgaatgaacatatgggattggtcttgtgttgagtacctactgaatggattatcaggtaaatcccatatgttcatccggtctcatctgttcttttagtctgtgcatgtcattcttaaaagaatttcatttagcaggtagcttactcaacacaagaccaacaaagagattattagacaaatcaaattgtcctcttttagcttgttcctcatgttctcaagttcaattaattgagaagtgatgtttgagttcatattaaacttaaagtcaaagaacttcttcgctagaagagtcttagaaaacctattttgtttttgaaattgagtgttaaagtgaacccttatctcttttgcaatcttatactcattataagtcatagctagacgaggatttaaagagtttaacaagtaatttctacaaaaatctttatctttaatccattgatattcatccacattttcaacaataaatacaaaattaattaacacaatgtagaatatgtcacattccttcatgccaaattgaacatgaaattttcaaccatgaaattcagtggcatcaaaagatttcagctttatgatatcataggagctatgtttttccattttaatcaaagtaaaatagttagaaagagtgcaccttaaaatcctccaaagtatacaaatcttctaactttttttttttaaaaaaacaacattatagaggtgaaatttgtcaaatctgacctcaaaaatgaattcgaaatacccaaaaaaccttaggaacgactttttttggtcgtcggtcgctagaaaacgaaccagtcatcggaaaactgtagaaacttccaacgactatatctccttcgtctaacctttgttttacgcaagtgaccagtcaaaacgatcgtctcgacgagtagagcaaaatccacaaggttttaactcatgaaattggctgaaatttttgggatctggattcaaagattgcggagagaaagttttcaaactcagatcctggtcaatcctttcgtcaaaacatgaaagtgatatcacccttgagtttctcttgatgagattttcgaaacaacaccttattctctcaaatccgacacacgaaactaatacttcaagattgttagaggtaaagggtttaagagatggatttagtgttgggtgcttgaagtgttacactaagagacatcaaatatgtaatgctcaacagtgttacctccagcaaagggagaaccttagtgatatagcaaactattggactccagtccatatggacccatataattatacattaacttattatgcttgaatgtgaacatattatttattgtttaaatatatatatatatatattaaatatattcaactaaaagtatattactgtatttcatattatcaatgcattttcataatgagtttcgatattttttatttattaatggtataaccatagacagtgattaacaaaactgaattagaaataatagtggggtgaaaaatgctaaacattcttggattaattaatataaaataactagagtatccaaaaaattgattttaatgggtatgttcggttagaataaaaaggttttgcacagttgattaattagataatttcaacgaataataaagaattagtttgaaagcttgtctggtagcatttctcttctataaaagtataatataataaataaattccaatgttcacaagtcatggctactgttcgtaatatgcaattttttctcattcttcttgtgtatacatatttcaggctcgatatttcttccagcagttgatttcaggagttaattatagccacagcatggtagatgaaatacacattagtacattactctgagaacgaattgtaatttgttttcagtgtgtgttggtagtgatatgtttttttttttttttatgaaatatgtcatcgacacttgaagttggagaataccttattggatggaagccctgctaataatcttaaaatttgtgatttcggatattctaaggttcaattgacaaaatcatatataccaaccttgaatgcttaaacaaataaccaattaaatttaaatatacattatttgataattttttcttctgacaagacaacctttacttttctagtcatacctacttcattcgaggcctcattcaatgattggaactccagcctatattgcaccagaggttctttctgggaaagactatgatggaaaggtaatggaaaggtaatactacagtttctaactttagatcatgaaaaagactagaagattcatgttgtattaattatagactgatacaattattcagcagtcacttagaacacgcagtgacatttcctttttagagtgaaatagaaataacatattttagtgactactatgaagcacttaaaatgccttagagttaactgattctgacttgatgagtttctctgtattatatggtagttttgttcattttttggctgatgtgttactgttttgtacctgttcagttggcagatgtatggtcctgtgtgttggagtttttgtttaaactctatgagttatgaataagaggcggttaacaattcaaaatagtaactacttataaccgctcttgggaaaggttagaaaaataactactcccaaccgctccgataaccaacggttacgatggtttatcgccaagagtcgcgatggttcatcgccaagagtcgcgatggtttactgacaactcttcaccagggttgtttgttgtctataaatagacacagagacagtcagaaaaaaggaaggagaaaggaaggaagtagaaaactgatagttaacttttctgatagtctcgcttagacactagtgcatttcatatcacataactctgtggttcctcaagcattgtctttgttcgtttgggctgttgatttgaagtgccatcaatcttcagacgtgatccgttctatcctgggagacaattgttcattaacctttggcatcaattggagggaacaaattgtcttaaggagacaacattgttgggctcggatcctttcatctctttgcatctgtttctgattcatacttatcatacaggttctatttaaattgtttttgtacagttgtagtagattatgttgttcctcttgactactcagattctgacccttgtgcaattggatatattccaattctaaattaactaatagttccaacaatcttaagacaatttgtttttgaatctgagttcagtatattctatctttgtgaattatatactgttgtctactctctgtactttgaacgattaatctgtgtgattaattagtgtttctgtttgtgtaacagaaatgacttcgacaagtgcaaacttggtcatcaacaacaagactccctctgtttcaactcttgctgaaaagcctgaaaaattcaatggggttgatttcaagcgttggcaacagaaaatgttgttctatttgacaaccctatgtttggaacgttttctcaaggaagacgctccgaagttgaaagaaggagacgaacatgataaagagaaggttgttgcggttgatgcatggaaacactctgatttcctatgcagaaactacatcctcaatggtctagacaattccttgtataatgtgtatagcactttgaaaaccagtaaggaattgtgggatagtctagacaagaaatacaaaacagaagatgctggcttgaagaaatttattgttggtaaatttctggacttcaagatggaagactcaaagaatgtgatgagtcaagtggaggaccttcaagtgttagtgcatgaaattcatgctgaggggatgaccctgagcgaatcatttcaggttgctgcggttattgaaaaattaccaccatcctggaaggatttcaagaattatctcaagcataagcgcaaggagatgacacttgaagatctgataataagattgaggatagaagcagacaacaaagttgctgaaaagaaatttggcaacaatcctatggtctctagggctaatgttgttgaagagggatcaaagtccaagaaacggaaatattccgatattggaaatgctaaacaaggcaaaggtaaaggcaaaaagttcaaaggcaattgctacaattgcggtaatcctggccatcgtgcaaaggattgcaaaaagtcacagaaatccaaaaagaagactactcaagccaacttggttgataccgcttgtggagaaattgaaaatctcaacttaacagcggtggtgttggagtgtaaccttgtaggggacactaaagagtggtgggtggataccggtgccactaggcatgtctgttcatccaagtggatgttttcctcctatacccctgtgaagaatgatgagaaactttatatgggtaactcttcttcttcaaaagtggaaggtattggaaaggtggctttaaagatgacttctggcaaggttgtgacacttaatgatgtgcttcatgtgcctgaaatttgcaagaacttagtgtctggatcccttctgagcaagaatggatttaaacttgtatttgtttctgataagtttgtacttactaagaatgatgtgtatgtaggaaaaggataccttagtgagggcctttttaagatgaatgtaatgactgtaaacagtgatggtgttaataataatgttacttctgtttacttgcttgagtcttctaatttatggcatcaaagattaggacatgttaattttaaatcaattaaaagtttggttaatttagatttattgcctaaagttgaatgttctaatattaaatgtcaagtatgtgttgaatcaaagatttcaaaattacctttttcttctgttgatagatcaactgaattgttagatttaatacatactgatatatgtgatatgaaatctgtaccatctaggggtaataaaaaatattttattacttttattgatgattgcagtagatattgttatgtctatttacttaatagtaaggatgaagcacttgtggcttttagacaatataaaaatgaagttgaaaatcaacttaacaagaaaattaaggctataaggagcgatcgtggggagaatatgatggccccttcgacgaattctgtatagaatctggggttatacatcagacgactgctccttatgcaccgcaatcaaatgggattgcagaaaggaaaaatcggacattaaaagaaatgatgaatgctatgttaatcacgtccggtttaccatagaacttgtggggggaagccattttgacggcgaactatattattaatagagttcctcataagaagacaaagagcataccatacgaagtatggaaaggaaagcaaccttccttgaaatacttgaaagtgtgggggtgcttggctaaggtcacggttcctaaacccaaaaggttgaagatcggacctaaaaccgtggattgtgtattcattggttatgcacttaatagtagtgctagtcgatttttggtttataaatccgatgtctcagatatacatgttaatacgattattgaatcaagggacgctaggttctttgaggatatatttccgtataaaaaggtatatgaaccaagcggcaatgacaatgataatgttgtgagacctcaagagactacaactagtgttaatcctgtagaggaagaacctagacgtagtaagaggcaaaggactaccacatcctttggacctgattttctaacatatctgttagaaaatgagcctcagacgtataaagaagctgtaacgtccccagaggcaccattctgggaagaggctatcaatagtgaaattgaatccatcttgtcaaatcacacgtgggaattggcagaccttcctcctggcactaagcctctaggaagtaagtgggtcttcaaaaggaagatgaaggaagatggcactattgataaatataaagctaggctagtagtcaaaggctataagcaacgcgaaggtctcgactacttcgatacctattcacctgttacaaggattacatccattaggatgttagtcgcgctagcagcgttgtatgggttagaattacatcaaatggatgttaagacaactttcttaaatggagacctagaagaagagatctatttagaacaacctgaagggttttctgttccaggacaagaacggaaagtgtgtcgtttaattaaatccctttacgggttaaagcaagctccaaaacaatggcatgcaaagtttgataaagttatgttatcgaacggttttagtattaatgaatgtgacaagtgtgtctacattcaatatactgataaagggtttgccatagtttgtctttatgtagacgacatgttgataatgggtagtaataatcaaatgattaaaaccactaagcaattgcttgccagcaaatttgacatgaaagatttgggaagagcagatgttattttgggtatcaaaatccatagaacatcaagaggtttggctctatcacaggctcactatattgctaaaattcttgaaaaattcaagagtttaaatataactcctgtgaataatcccatagactctagtcttcgactatcaaagaatactggcaaagctatagcacaaaaggaatatgctcaagtattaggcagtcttatgtatgttatgaattgcactagacctgatattgcttatgcagtgagcatgttgagtcgctttacgagtaatccaaacatgtatcattggaaagctatgataagagttttaggatacctaaagcacactcaaaactttggtttgcattatgaacagtatcctgcagttattgaaggatattgtgatgcaaattggatcaccggttctaatgatactaaatctacaagcagatatgtgttcacccttggtgggggtgctgtatcttggaaatcgtccaagcagacttgcattgcaagatcaactatggaagcagaatttatcgctttagataaagccggtgagaaagcagaatggcttcgtaattttgtcgaagatgttcccaattggccaaaaccagtaccagctgtaggcatacattgtgatagccaagctgccattggtagggctaagaacatcatgtataacggaaagtctagacatatacgtcgtagacatgataccgttagacaactactctcgaatggaatcatctcaatagactatgtgaggtctaaagagaacatagcggatccattaactaaagggattcctagagagttagttgaaaatttgtcgaaaggaatgggtctaaggcctatcaattgttgatcatcgcggtaactctaccttgatgagtggagatcccacgaactaggttcaaagagacaactaagtcatgatcgactgttaaacactgtggagttttaaactcatactcattcctatgacaatacagtgtatatgagggtaagcataatggcttttaatggtttcttaatctgatgtgttcagatgatatatgtggaggtatatcacaagaaatcacctatgtgagtgtgaagtgagggccgcttcaatgagaacttaaaaaggccgattctctacaacacttgcagaaccaggaaggtgtccacggccaaaatggacacaacaatgaggacgagcaatgctagagaagcaattgtgtgactcctattgtctcggtatacaccatacaggttgacggttcaaggcatcacgaccaccgattggcctagtatacccgataggtttacactagagaaggttcaaaggtaacccctacctatctcgatgcaattgtttctcgccgaggaaccacacttgcatacatattcatatgcatttagtcatgttgaattgatctcttattcatgtgggggattgttggagtttttgtttaaactctatgagttatgaataagaggcggttaacaattcaaaatagtaactacttataaccgctcttgggaaaggttagaaaaataactactcacaaccgctccgataaccaacggttacgatggtttatcgccaagagtcgcgatggttcatcgccaagagtcgcgatggtttactgacaactcttcaccagggttgtttgttgtctataaatagacacagagacagtcagaaaaaaggaaggagaaaggaaggaagtagaaaactgatagttaacttttctgatagtctcgcttagacactagtgcatttcatatcacataactctgtggttcctcaagcattgtctttgttcgtttgggctgttgatttgaagtgccatcaatcttcagacgtgatccgttctatcctgggagacaattgttcattaacctttggcatcaattggagggaacaaattgtcttaaggagacaacattgttgggctcggatcctttcatctctttgcatctgtttctgattcatacttatcatacaggttctatttaaattgtttttgtacagttgtagtagattatgttgttcctcttgactactcagattctgacccttgtgcaattggatatattccaattctaaattaactaatagttccaacactgtggagtaatactttatataatgctggtaggagaattgccatttgaggacaaagaggataccaaaatctccacaaaaccataaaggtaatttgctttatttttttaatttaatttttatatactatcagtataaaagtttttagaccgtcaagtgtcaatcaatcagaaattatcttaagtatgacttaagataatcattatagaagtgaacaaatttatgtgaaatctctaatctctttacactatttagtacatatgctattttactttttatttttgaactagctctgttgatagattcatcaatcatcatgtcttatatgtactctttctgactccctatgtgtgtgtgtgtatatatatattatccagagagttatagctgttcaatacaagttccctgacaaagtttgcatatctcaagacagtaaaaatctgatatcccgcatttttgtggcaaatccagcaatggtatgtatatgaacatagtcatttaattattttttggagggaacattataaaataaaaacacttataactgtagcatgatattacttggtgtatgttgttgtaactctgccttataattatgttgtagagaatcaccgtgaaggaaataaagtcactacatccatggtttttaaagaacttgcctatggaattgagagaagcggctcaagatgtttactacagtggagaaaatacaaaatatcctcttaaaaatatagaagagatcatgaacattgtcaacgaggccaaaactacacctgcaacttccagtccaaatctataagagagattgattggggaatggaagaaatgataatgccgaggtacatgaaatcatttatgagaagcgagtcaaggaagcaccaaccatattcaattttttggataataaattagattttttgttcacttttccccctaacttaaggtaaatgttttgcctgtatctatgtatcaaattttagttttatgacataaagttgaactgtacatttttgttgatatggtacaaggtttgtagttgtgagctgtgacagcattattgtgatttataagtaagaggtcttcgttttctccctctgaatatgatgttatgttcagtcttcaaagcaatgagctatgataggaatagatgacacattgttgaattgtataatttaaatttcaaattatcgttaggatttgttaggttgttatagtttgttcagtttgttattatcctgtattattagcattttgttgaatttctctctcttatataagtacctcatgttgagggaaaatatagaagagaatggagtgaatgaatgaatgaatgaaagaggaattattattccgatttatgcatatctgatttttaacatggtatcagagtcatggttcccttcatgaatgagagccatggtatcctccatgaaaaaaatcatgtgttatcttccatgaaaaaaaaaaattttcgctaccttattttttagagtctgtcttcttcacattcccattgctaatcaaagtcatttccggaagagtgtctgaagaaacaattggcaagttgggcatgactgatattcatgcaccaacttgagggggagtgttgcattgtataatttaaatttcaaattattattaggatttgttaggttgttatagtttgttcagtttgttattatcccgtattattaatattttgttgaatttctctctcttatataagaacctcatgtttgagggaaatatagaagaaaatggagtgaatgaatgaatgaaagaagaattattattccgatttatgcatacttcattttaacacacattaacacatcacttgcctctatcttgcacagtgatttagggtcaggttgttatctttacatttatttggccttttcttggtttttgatttctttgagaagaaaactatataggggtctaattactagttgtggatgcaagtattatgattgttctgttaccattttagaaagaaatctttcatgaaagaaaatagaatgaagtaaagtcaaacgaaagaatttcattttttttcttttattttatcacaaaatcttcaaataataaaataacaatttaattatatttcctggtgcattttctcattttcttcaatttcttccatcattaaatatccaaacatagcctttaatgcttgtttgacatctaaaatgcaccattataattataatttcagaacaatttcatgaaattacaaaataactaaattgaattactttcaatttttaatcaacaccttaaaaattgttcattgcatgtctcagaaatagtagaggtggataaaggttcgagcaataacctgacttgattttttatttttttttgggaaatctgacttgacttaaagcttgaaggatagatgaggtagggtaaaaaataataaaactcgtttagtttcagtcaatatttaaacctttccaatgaatattttaaaacctttatttttatgcaactacaccctattcagactaaacattaaaattcccaaaaatcaacctgatcctaacctgcctactttaatttaattggtttggaacaaaatgttcagtctgaccttgcttttgtcccccgaattacttctcaggttcatgcatatttctccatgttagatagcattgctagtccaactatagtactatacctatgtgttcatcattcttaccatatatcaatgtaatttagtcacacattaattctctttttcatggaagctgtaaattgtaattacatacatggtcaagattaatctcaattcacggcaagaaataaaaggaaacataaaaaaacacaagggaggtggtggtacgctatgttaggacatttgaaacgtcaacttcctttggcacatacaatgtattttcacgaaaagtaatcactaatgctcctatttttacaacgcaaatgaagcactttttcacaaattttcaatggagctgccacggacgagactttgatagtgacccttattgataaagacaagcgtattatttacaaatgaatattggagtcgacattaggggattatgcttggatctctttgtgataactgattagagaatatgtcatatctattctttcatgcttatatttgtttttgttatctttaatccaaggtaatcatcatactcctatttttttataacttcttttttatttatcattaagttcattattatcaaattcaattaatttaagttaaagatattattaatgttgatctttaattcaaaattcttttgagtcatttatgcaatttttaaatattatattttttatgaatttttaaatattataattaaaccttcggttattagctttctaaattcgaatttcagcaagaagaaaaaataaaataaaaaaatcactctgcaattgagagttcgagagttctttttgcttcatgcaagtaataattgggaaaagattaactataatcgcgcaacaaaatctttgcctgctaattgttgatatatatataggtgggattcgactttaagcattgcagactctatactagatatttttaacttcgttgtttaacgagttatttatttttagatgttattactttttattattattggggatgatctacttattatattatattagattacttaaaattaagctaagatagtttatgagtaaaaaatattttcttgttatttagagattctttaaggaaataattttagaattgcttaaaattatataattggagtaaaatatgaattgtttattaactatgatgtgatattataagaataaattaatataaagtaaagaatttaaaatgaattatttaaattatatcgattaaagatgttgaaagtaaactatttgacgcactcgaacggaattgaaagccaagctaattaatatcctaatcttgaggctaaaatactaaactgtcttcattcgttgttgttttatacgagttaatttacttttctgtttggatttccagcattatattactaaagtttgattacgagaaaaaaaaattatggcctttaaaaagaggaggttattaaaggtgggcaattattaaaaaatcaataaatatatagtatttgtaatgtaaaagttttgactatatcatttagtgcatatttggttagaggttactattggttgtcttccgtaattttggagaagcatccctttattatttctatgctaaagtgcattggtattcccactatttaggttttaataggaatctaaacatattcttaattattgattgttatgcattataagattattaactcttataatcttataatattacctctagactaaaatataagaaaaaaataatatatgctagaaataaaactatcttaattataaataaaaaattaaagaaaattctaacaaatttatcagtgcattaatattaaaacgtgatttttttccaaaattataatcatttatctacttttttccatttcattaaaactacaattttttcttttttttatcatagcattcatcatatatatgttactttatttttctacctttcctcctttcttccaatttttctctatctactcccaattcattccatattaggatggataactattcttttcattaaggttaaatttgacaaatattttagttagtttttaatttttttactagctaaaaaactgttgattgtcgatgaacaaacttattttaataacttcttaatagattctaatatttcttgaaatgtcacttaagtaatattttttaaaatgctagtttctaatttttattttttatatttttttcatttttatcctcaataatatattaaattttcttataccttttttaaataaattatgatttcattatttttatgttattttacatgttttagctatttcaacaactaattttaaacttagttaaactaacttttcaactaattttgtcaaatataattaagatgtatgtatttttgggaagttacaaacttgcctcggtgataaaagaagagaggaaaatataatttattcaatttcttttattaaaaaaaactaacaattaatatttttcataaaagttgatatttgcatttttattccctaaagtaaacctacactttaaaaaaggtaaatgtagagaagaaattcctttcattccccgaccgttcaccttaaacatgataaatgctatgagtactagatttcccccgccgaacgttattaaactaaattagcactaggccatccttactttaaagtaaggaaattaattgaaaaacagtagaaaattagatatccaaaaaggaggtgaaaagagattgtcaaacaaggtgaaaaggaaagtttgctatttcattaaaatataaatttgttgtctaaggttctccctttgtccagtgagcagacagcacaatcctattttctatgttataaatcattatcatatctactttcttcttttcccagacaatcaatttaactttaacagaggaagatctgttcttgttgttgagttatcaaccacccttgggactagaaagctttatttgaaaggtagatttcacatagtacttcatatttttcggctttatatggctgtcattcttggagaaagtttttctcttttgtgtcttatgtcttaaccatgtctgcagataccgttaacctttgcagaaaggctagattattttccctacataattctgtttctcttctttacaagctaaaaacgacccatttaaagacaataatacaatatagcaacacgtttatttgagtcatgatctttaaaaatgaaatctaacaaacagaaatttctttaacctgcagaatagcatgtatattcgggtaactgggtttttacaaggagtgaatggtttgagtacatgaacgtgcggtgcactatggtttattggtccaaaatttacttacatttaattgatttttattgataaaatctgcattatgatagaatgcaagtgagagtaaaaagtctcatattggttagaacaacatataaatgacaaaaatatatatactgatgcttaaggttttaagtaaataaatgttaagtattcaattatctgtaattgactcatgattcattaacaaaatttcttcaatatttatctccttgtattccgtaacatattctttttatatatctaatgtaaaatacagatgaatctgttcaaaatattgaatatttcaggatataaaatttgtattcaatattggatattgagtggaaattctcccacacaaagatagtagaagcatattgatctctaattattcttgacaaaagattctacttgactccattgataaagaaaaagcatcatttttattatcaaatatcatctagtcttttgaattctatttttttttttatttctttcccatgtacctaatacaggaaaagaatactactactctgtctagaaagacgtttctcttattacttgaaggcattggcattttaaaattctggtttctcatgtatgacgagagtaatgttgctttacttcaaagcaagcatcacattctcttttgcaatttttttttctcttttctttgcttttcattggaaaagcttcttcaaggcctcaacaccatcaactcagcaaataaagaaaaaagggaagaccagaaaaaatttatgacattgcttgcatttttcaacataatttttcctttttattttcccttaaagagcttcattttgctctcaagtattttccacatttgctatggcttcactaaaccaaattatatacatctacttatgactacacatattcaacaacttcttccttccttccacaatttcatcaaagaaatcatcaagttgccctgttatagtctcaaccccacatctcaacaacccaaagcaacgtttcaagttgtcaacttttgcttggatctcatattgtgcatcataacccaccattctctccaactccactttcaattcctccatggcaatcttggcttgtttgaattcaagaagcagaatccctggctggacattattctggtcaatctcttgtgcaactttctgctgcaatcttgccatagaagccataaaacctgagccataaaccacgtgctccacgtgcccctcatacccttgttggtcaaagcatgaggaagaccaacaatatgcaaccccacatagcaaaatcatcagaagcaatgagctaaccctcatcattgcacaaagaacacctcggaagccattgaactcgtttaactttgatttcatacacatgttctgatttagacattgagacaatgcctgaattctattttccatcaagcttttattttcctctaccaatcctagactctccctttgacaaatatttatggccctaataacctgcaatatatgttttctagaagaatttagtgcatgtttggaaactcataaaaaaaacaaaaaaaatcacatcaatttagcttaatgaaagctataactattagcttctgattaaacatgaaaaatcacatctgaaacgtgcaatcaaaacatgctattagagtcattaattaaataaagttgatttagttttgtaaaagcactaagcttttgactaaaaagtaattttgaacagaatttgaggtgtatatatactatataccaacctgatgtgaaaactctggagtcaaatgatggtagccatccactgaggaagctatgttggagccagttaaggaatagttctctattccagaaatggctgatttgagtacatggcagatatcccaaagccttgagctttcatccatgtattcattcagccattttcctccaactgacaagcaaagcctttggaccaaaatggttaactgggaatggaaggattggagggatgagaagacctctgaaatgaattggattgacatgaagtcatgggagggaaggattggtgaagctcattgagtccttgagtgaggaagatgtagaagccattgacagaagagtttgtgcatgaagaactactcatcatgaaaggttgaagggaagttgatggagattgatagatttatataattggaagattaagttgaaaagagattaagcaatcaagaaagtgggtagcttagaggattctaacttcttttttatggtatggtgaaagttactattgggtgtaattatggctgtttcctatagagtggagtggattttttttttttttttctttccaatttacactatttatcttcaaataattctcaatttacattacttttaatttaattctcgaaatacactatttttgagaagtcatgttttcaggacttgacttcccatctaagtttttttttttggtaaatgttattttattaaatttaatttaaaataataattttgttatattatttaatttaaaaatgataatattttttggtttaataattattagtaatcttaaataattaattaatagtgttaaaataaataaaaagaacaaagtgattaaaaaatagattgattaaaaaatagtgaatatatacttatcaaatctcaattatattatataaaaaattaaaatactcaaataacaaaaaatactaacaattagagagataaacataataaatgaacataataaaacaaaataactaaatgtactaagaataaaaatgaaacacgaaaatgacgatactaatcatagtttgaaagatattatgcatcagacatgtttcttccatttgaatcattctagcaagttgtttattatgcacaacatctgcataggttattgcaacatgttgatcgataattgaggctggtttggttactagtttgctaaaaataactaaaatttatattggacaaaacacttctggtagttggattccggcaacatctttaacacgtcttcatcatcattctattatttcatattcgatttttttaatattttgtatggcctaactgtcgaaagaacaattttctaaccacatgtgattggtgacttccataaggggaatctctaggcacaacttgcttgatgacatccttaagtttttgatgttgcatattgaaggaattttaaatcttttggtttgtttcagtgaaggagtaacccaaaaaataccttgtcgtggtatcttgcacttgctattgtattacaacattgcatcatgagtaggaactagtgatggtgaatcgaagtaggttgagtatagtatcgggtgttctattgatgatacataataattctataaggtcaacaagcaggtattgcttattacacattaacattggggatatttgtgcgaataagtcaagtgtagctgaacgacttgattaattgtacaaaaaatattgggtaaccagtatccttggttaattccatgttcaaaggcacaaaaatatttgtctgtgtcattgtttgttgaggagacgtattttaagaccacaaaactttttgttattagaggtcgacaaatccaaacaatgatcaactccggctcgtagtattccaaagtcgtctctaaggcaataaatagcggtcaacatgaatcaaatacgcacattgttaacaaattgacaaacacaacaacacatttattgtaacagagactcaagtcccacttgaaactcctatatcacctggaaagtttagggttatgttataatcctagaattgcgaaagtggcgaatttcagactaagcacttatcgtgttttcatataatgaatgcctataaatctgttaatgttgatcccataaactatgtgccgctatttactttacaaaacatattgcaccgtctacgataactcctttggtttactgtcacacgaattaatatgacaagaatatgaaggagatcaatgggtcatgatccaaggaaaaggaagagtgcaaaggtagttcagtttcaaattacattcccactgaaaatggatgaagaaattgaacaagatataaaaaaaatgtgaaatatatcaacaataatgtcataattgaaaaagttgttattattgttcatgtattttatttatgatgtattatggataaatataaaatattaaactaaaaatattatcatattctaaaattaaataatataaaaaattaattaaatttaacaaaataacattaaacaaaactcaataaagaagttgggttaagcgaaggtggagaatcggatctgaaaacagaaatttttaaaggatagtatagttcagaaattaaattaagaagtaatgtagattgtgaattattaggagataagtaatatagattgataaaaaacctggagaggatgattgggaatctgctgcaattactttttattcctattgaacaaacaaatgtcaagagagagaaagaggcaaataatcttaagaatatatagtactgtggatcatatgtagagcattaaaaaaatatgcattatgaaaactatataaatagttccccccgaccccaatttctcgtacttgatggtttttctatttcttttgttattccatcgaatcgaggtttcagtatgagattggattctgctacttgttggagtataaaagattgactactttggcttaagattctgcttctcattcttctatttggatttggctcgctagctgttgcatttaaagtgcttcccttcggcttcttttctattttttattttctctttcttctcggcccatgttttaacctcttctacacgagcacactgcaccttttcgttttggtattcttaaaaaacgtggtacgtcgtccattttggtttttctcatcctgtagagaagaataagaatgaatatatcaactgtgatcctcaaattaaactcaaaactattgcggcttttttttttccttttcatattcactacaaacaaatgtctaatgtcatatactaataaaaaatattgatcgttaagcttattcccattaatatattttttagttaattaaaattaaattgttaatcaacttaataaataaatatataccacagtagttttttttattcagtgaaaacaagaacggaacaaaccatcacttacgaataccaacaatgcctaactcatcccctaaaagaagggattaaagacctcaattggaagactataaccgcagtataatacaactatacacccataatataaggtctatatttaattttattttctgataaatggatattatattaatggaggtaagttaataactttgtctttgttaatatatgtaatgtttttgtaatgactataatgttcacattatgttcttgctattgacgttcacactttgaataacaatttaaggttgacttcaatttttctgactgagtttttgttgtgtagatttattttcaccaaatcattgcacacattaagaatagccatttgaaaggctaagttttaacgaaaggataatgcaccaaagcataatcaaactaatctatctgaaaggacaacacttatatatatattgctttttcccacagtttatctgattttaagggtgcaggaaaccaaatcaaatattcatagatattagtcatgtattaagaaaatttctcacttataatcactttttccttgagagtattcaagtatattagtgatgttatttctgatattgactcatcgtcgtcctaggtgtgtggctagttctacgtataattgattcgatttgacacataaattaagaccatattcattttatttagatgatctataacaacattcctatgtagatttgtttttgttggtgtccacacaattgacttgtctagatcttatacatgatttcttttatttgacattgtgaagtctgttgcaaggtatttattattcttgtaattgtcactttccatagttcatgagcacatcatatatacccaaaattgcaaaattagatacacgcgttttcgatagtaagataacctttttattatacaagtgagaatgataaatatttactattaaatcttattataagttatcaagatcaaaatatataaatcacgtgagttcttttttataaaaaaaatcatgatttttaaattttttacataacatcaaatcttaatcattataattgtataattccgatttactgttcttctcacttttatataaacatgactttctcactagatatgttcctatacagtcaacattcatttatatttttaaaagtatacatacactaaattaatataacgaagtatcagataatttttaaatgatattaaaatttatagatttgacctattgaataagaatttttaatttaatgattgaattaataatgtttaatatgtacaatatttattaaaattactcttacagtaagttgaaaaagttgactttttatactatgaataaacaataatcaatttttggttattcttcaagagattatattgtttcattatgaatgctacagttatattgggtctgttttcatctgatcataatttctttattaataaaattatgaatataaattaaagtattttaacagtgcgaaagtatagaaaaaggaatgggtgaatgaatagtagaaataaaaactatttttatgaaaaaattgcacaaattaagtccatgagcacaagattgtttgagcatgaatgaaaaagaattcgaaaggattatgacatatagacagatacacaagtcacagaaagaaaagatttagttcgcaataaaagattatgaaagctaattactagatatcagttagctaataacaaaatagtcttgggttgatcagaatgctctgcttcaattataggtagtataccaagttaattttgaaacattgttaacgtagaagttcactttattatccaaatatattgtcttgttacttaacgtgtttgacaatacataaaaatattaaatccatttaagtaatataatagcgtattaatgtgaaaacttttcatcgatattcaagttaaattataatacaattatagatagaatcttattatgaatatttattatgaatatcataagataacataaaaaaagttatgaataacccaattttacatattctaataaaaatcttttatttaatcaatgctatttaatcaagaacactaattagcatttgccttatacataatatgatgtggttatatgataataattgactttcgtcaaaaattggctggataagagaggttgacaaattcctgtaggtgcataactgtataaatagaaatcatagacaattgtttatagaaaaatgctacatagctatacaaatgataaaataaaaccatagaaatttagcaaaattcagtcaaaatttatcaagagtcgcggttaattattagacataaaagcaggaaaaatacattcctgtaagaattagggtgctgaaagcacaaattcagtcaaaagtaacatgtttcttatattccagtctttaccagcaattcagcaccacaatgtgaaacacatataatcaaaaaaatgttgatgctgtaagcaacttgtaacaagttaacactatcactgtaatatttgacattccaaatccagcattcttcccattgaattaaacaattatcctgagaaaaaaaggtgaggttgattgctgtatataacattaatgaatttagatggcctaataggttactatgtccacagtcatcaaattgaaggtacgattcaaattcactaaagtttcttctaatcagatctcctttgagaccttggaattggcactgtttggatggaaagaagtcatgatgctacatggtgacaaattgctgcaaggatcatagatttcttgaataaatttcaacttgcacaacatctgtcccttgttcataactcggccctggattccgtgtcctcatttgatgaatcttcactattgaagtccttggattgattagggggttgtattgattctgattcttgatcatcgcccaagatttgtgctgtgaatcttcttgcctcaaaatccaggtctggccactcagaaactattcgtctagcaccctaatgttccgagataaagtagtaaaaaaatggacatagaagacagaggagtgcaaaaacataagttgtgataggaaacaagtttccatgaacacaacttaaaacagcaaaacatttacctgcagtttgggttcttttgtcatgggattgttgcacagatcaatggtttttgccttgtattttgtagcattaccacaccatgattcacaccatagccattcttgcggcaaagagaaaataggcacggtatgctgagcgtaattaggaagatcctagaccatttcagggcaaattttagcaaaaaggcacctcaaaccaaaaacaaaagcatgcattcaaaagagagaagaaggctacattggaagtacataaagattaatcttcataataaataatatgaaatatactacgaaactagtaacttgattttacagtcctaagtatccaattttagcccttcatacaatttatgaaattgactctttcaaattctgaaatattttttcaaatttcaaatggtaagaaggaaagacctgattccaacttgcacaaaaatgatattgattcaacactaaggtagtgtttggaccagcttattttgcctttttttctccttaaaagctgggccaaacactcatatatatatatatatataaaagtccttaaaattataagtagcttatttttaagactaaaagatgaaaataaggagcttattaagaagctccttggagtagctttttatagcttgtgcggagcttttctagcaacaaccatccttcgaatcccatctaccggcctttcatgtatttccttttctaaaataaattcatttcctcctttcttatatgtgcgtgcccctgcagcttttctgtggaataatgatgctgctttttttattcttcccataacattgaaatccttatgcttaacaatatatttttgttgttgagaaagtttctataagttgtactttcgtttgcaaattatcactgaaataaaattatattaattgaagtaatttcaaatttttaatatatttattttaatattttaatttacttttattatcattaaaatgatttaatatgaattaaattaatttaacacaatatttttttgttttataaatatactttgataattagtttcaaataaattaccatacaacttttaacttaaaaagagcttttagttagaaaagataaaaacttccaaacaacttttaccttttctttaaagttcttaatttagctttaacttgaaagtaacttttaagaaaaaaaaaaaaaaaaaaaaagccgccaaacataccataagccttgccaacaaggacatgctgtacatgagcagtctttaccagtaaattttttacgacagtgatcacacaatgtttccaacaaatacggaaataccatcttgatcaatgggtataaacatactgaaataatcaaattaaaaagtttctattctctaaataaattatacaacctgttataaatttataatatgatcactcatcaatagtcaccaaagacagattcaaagagcatatcataaagttgctccctagttttcctttcatttttggttaacggattgaagaggttacatattctttaagaattcactttgataaggcatatacatcaaaagttaaaacaactattctttggcccttgtttaacagcatactgttttaggttaaccgttttgtttagagcagtgttactaatcctaagtttgttggtcatgggttcaactccagaaacagcctctttgcatatgcaagataaggttaggtacaatatccttcccccttacctgtgcatagcgtgaaacctctgggtaatgggatacgtagtagtgttactaatcgtaagtggattagagatggttccttatgcctccatcttatgaagttgttggaaagtttccttaattgcggtcatccctacgccaaaaagggctacctaagaccagaaaggctgagtttaacatggtagagtgcagccactaggatgcggctcttaggggattgagatccccattgattagagataaggcctaagtagtgcttataaggcttgggtaatcctcaccttgcaagcaagttttatggggttgagttatgccttaaatccaaattctaagagaaatgttggagataccacatcaactagtgataaggccaaagtaatgtatataagtgggggacaaccctcaccttacaagccccggtcttgtgggttgagttaggcccaaacctaaattgttaaatgctattgagtgtatcctagagattatagttaggcctacctagccatctagtccttggtgaggggtgtgtattggagatcccattgtgggattaagttaggtccaaacccaaattgtgtcccaattctatgggaggattttaggagatacttacgtctttcacttagacaaaaatgatgagtcgggtattgatactcatgaccattataattgttataaagcctctctcccatagaaatatcactagttattggagttagttagacttagctgctttgtattaaaatctataactaagggggtgtatacaagttgatttgattttttctcaataatacaatttcctctatgatttctctatctttaaactctctcaaatctaacaagtagcaaccaaagaaaaccttgcatttaccatcaacattgtatctcacacatccacacttctgcttcttcctaccttcctgtgtacgattgttaatgccactgataaagtgagcgacgtttccacgtttatcagctcagataacaagactttgagaactttctcccaaaagaagaattgatttcttcgggatttggagggagttctggtgatggtaatgacaagcatccttctcaggatgctaagtgtcggaaaaattcacgacctctgatattacataagaaacagaggagattgttaccatttgttcctacaaaagatcctgcccagaccttgcttctgctttaacagcattaaatatggaattcagtgatcacctcaaatgcttgcctggaaaggctcctagatctgtgaatcaagccacactaaaaaacggtggcatgaagattctttccaaggaagacatggagaccatagaacactgcattgctatgtctaaaagaggtgaattccctccctttatggttgtttatgattcgtgtgaaagttatactgttgaggctgatgacctaatcaaggatatgacaattattgctgaatacattggcgatgtggattaccttgacaaccaggaacgtgatgattgtgacagtattatgtccattcttagagcagaaagttctcaaagtgttgttagctgtgctgataaacgtggaaacatcactcatcgctccctttatgagtggcataaacaatcatacacgggaaggtaggaagaagcagaactgtaaatgtgtgagatacaatgttgatggtgaatgcaaggttttttttttgtggttgctactcacgacatttctaagggagagaggctttattatgatcattcaaggtgacagttttaataggcacaacatgatggaggatgcactcttcttatgctggtcttggcttagaaatttagaggacggtttcactctcccttttcacttttggtctactagtatgggagaggcttttgtaactaggggaggatagaaatgagatgttttttgtatgtagacctagttttgatagcagaactcaggggcttttatcatgcttcaatggttcaagcttccttagttctgttatgttattctagggtattgatatgcagtacttcttgtaatgcagacaattcttttgatatatatatatatatatatatatatatatatatatatatacacacacactttattttgctggccaaaaaaaattatgatcataatggtcatgagtatcaatacccgactcatcgttttgtctgagtgaaagacaaatacctcctaaaatcttcctatagaattgggacacaatttagatccttgagaaaggagtctatttatattcttgaaaatttcaactcattgttgttgcatattccacaagttttgatataaagcagtcatttataatgcactgggttttcatgttatattgggactacaaaaaccagtcaaacttgcttaacaacacgctcttttaagtaaggattcatttgcaggtaaaggaactattaacttaaacctcttacctgatccaagttggctagactatttggatccctgcttagtgtttcataaataactctaagattatctccagctgcagtctctcggaacttcttcagatcaacaacatataaagcactgaaaaccgaaattgaaacagtaagcattgaaattatatttggcaatagaatataaaagtagctactaacctaatatggtatggtttcccccgcaaatgatcactccagaaaccctatgacacagggaaaaaaggttaacaaatatttatagccaatactgcattaaaattacacgggcgtaacgaacaccaagagtatcatatagattggaattgaacaataattagaatttcgacagtgacatttacttgtctccaaaacctatatccatccatctccttattattatcgcaaaatggggtatatgccaggggttttcctcttatatccatgtcatagagtactcccatgtctgccctaacaacttgatcagcatccacaaaaatgacctgcatatattggtagattttagacagatttcttgtaagggattttgattcttcattatctttgtcataacattgttattgggaaaaacccaagtcccacattggctagagataaacccaagatagaataacaagtgagaggcaacctcaccctatgagctagttttggggttgagttaggctcaaaccaacatcctaagaattgtgtagtgtgacattgaaattaattgtacaaaagacaaaaaccaaaagtatggaacttgatgcagaagaagaaaccatgataccttctccaaagaaagggggaaaatgacatctaggaataagattttatatgcccaaattattcgctgcttttctttctgcttatgcaaccatgtgggccacttgtacgtgactagttcatatttaaaaccatattctagggccatgtgtggaattaagtcctgtatgttaagtcaaccaaaatggttcaggatgtcaggcaaactcatcattctactttacattccaatatacaaatgaattaaaatgtaagcatatataatttgggtggatatataaccttaaaaggaggagagaggtagttctttatgaaccagaatttaactggacgatgagtattctttagaacacttagaatcataatcttcataaagcgttcatatctggaaattgacaagaagcacaaagtgaagattgcatccctgatgacaaataaaataccaccaggctccaactaaatatgaaaaaatattatagaatccaagtatggagtttaatagttaccatgcatttggaagtgtataacatttgtttgaaagattgtgcttagtaaaacttgcacaagaaattaacgtccataaatttcctattaattacaggcacttgaaactgaaattgtattctgaaatggaaccccaaatcccattccacgaaatctgaatcaacatacatgattgaccccattccatgaagaagcataaaacatcagtaaatgatattttctgctgtacaagacaatttttccaacatgatacgtcacatatagtaatcactgtttaaatttcgaaataaaggaccaaacttgaacaaacatatgttaaaaggcaaaactaaaaggaaagacagaaaggaaaattgtaacaacttataataaggaaccacttacaggtgcccagaagcaatagaaaagatattaatagtttttccatgccgtccaccccttcctttctcctatatgggaaaaaggttcaatctgttcaactttggaaatgatagtacaaagataaaaatggaaggacaaagcacagggtaaacacttaataaggttcaatctgttagggtgtgtttggatacgcgttgaaaccacgttgaacggagattttgtgcattccaatgtaaaaatgccaaatcattacatcaattaaagcttcaaagcctaaaagcaacatcaatctgataaaatcttttcatataacattaacttaagtaccaaaagctaataaggttttcaaggaaatataataaatgatgatttttgtaaaatagacaggtggaaaatgttaggaagtcttacatcgtctgccttaattctcggggtgcagcttatatatttgttgagcaactttacttagtgccaattggttttatttcagctgttgatgacattaattctgtcttccgagatgtatttgtgtcactggaacttgcttctaatttaatttcggttgggcaattggtggataataattgtaatgttaatttctcccagactagttttgtgcaggatcaggtgtcggggaaagtgatcaagaagggacctaaagtaggcagattgtttccatccagtttacttctcctatttttcctcattttcttgtactgctgtcccgtcctcattcaaggattggcataataaactaggacatccaaattcagttgttttgtctcatttaatagagaatggtctgttgggcaataaaactcttgtttctgactcatcctttagtgttcagtgtgcaaacttgccaaaagaaaaatctcccatttccccataatgctactcgtgctaacaaatgttttacaattatacacactgatgtgtggggtgtgtctcctgtcttgttgcattctaagtataaatactttgttatgtttattaatgactatagtcgttttacttggatttacttccttcgttctaaagatgaagtttttcctatgtttaagaatttttttgcttatattgagaaccagtttcagacaagcattaagattttgcgcactgactctggtggggagtacatgtctcatgcctttcaagaatacctacaacaaaaaggcatcctttctcagcgttcttgtccttgtacacctcagcaaaatggcattgcagaacgaaaaagtcaaaatttgcttgatgtctcacgctgattatttcttgcagcctctgtcccagccaattttgggttgaggctctgtcaacagctgtctttctgataaatcgttttccttcccaagttctcgagtttgattctcctttctttcgcctctttcaagttcatccggattatattgatcttcaaccctttggttgtatttgttttgtccacttccacctcctaaacgtcataagcttggggcccaatcagtcatgtgtgcgctcttaggttatagtatcactcacaaaggattcttgtgttatgttatgatgccacctctcgtcaatttcatttctctaggaaagtggttttctttgactattaaattttcttcccatgttttaagtcttcatctaatgatttgttaacctccctaatttttctgatatttctcattctatagaacgtttcaaaccaggtcatgcttatgttagatgtcagccttctttgtcccttttggctgctgatctgccacctgtgcctgctccactgcaacgctcgcctcaggtgtctcgtgcccctgataggtatgaatttgggcctatttctcttacagctactctatcaggcacatctgttcctacatgttattcacaagctattaaagatgcttattgggtcaaggcaatagatgaagaactcactgccctccaagaaaatttcacatgggacattgttcctcaaccccctagtgttaagcccattggttgcaaatgggtctattcagtgaagctgaattctgatggtactgttaatcgtttcaaggcttgattggttgcactaggtaacaaacagaaatacaggttggattatgatgagacgtttgcacccgttgcaaagacgacgtctattcgaactattctttctattgctgcctctcaggcatggtcactgactcaaatggatgtgaagaacacctttcttcatggtgatttggcaggggatatttacatgactcctcctccaggcctattttcctcgtctactggtgtgtgcaagctcaattgttctctctatggcttgtgacaagctcctcgagcatggtttgaaaagtttgactctactctcctttgattttcttttactcagagccggtatgactcctccttattcattcatcgcaaaaatattggtattgttcttatttatgtcaatgatatgaaattactggttatgatcatgccgccattcaacgtcttaagcagtaactcaaagcctcctttaatatgaaagatcttggttgccttaagtatttcttgggccttgaagtttatactgattctagaggtatctttcttcaccagcacaagtatacaaacgacttaatttctttggctggtcttgcttcagccactccaattgatactcctctagaggttaatgttaaatatcattgtgatgaaggagatcttttgtcggatcctttattatatcgtcagctggtgggtagtcttgattatttgacgattacattcctggacatttcatttgcagtccagcaggtgagccaatttatgcattccccatgtcatcttcatttggccgttgttcgccccatcattcgttaattaaaaggcacttcaactcgtggtttattttttcctactgggaagtctcctagtttggttggctacagtgatgcagattgggccggttgccctgatacacgaagatctgtcacaggttggcgcatgtttcttggtcctgcgctaatctcttggaagagtaaaaagcaatcacgtctatcgaagtcctccattggatcagagtatcgagctatgtcaatggcttgttctgaaatcatttggcttcgtggactcttagatgagataggcttccctcaaattgcagccacacctctctatgctgacaatactagtgccattcagatagctactaatccagtttttcatgagtgcacgaagcatattgacgttgattgccattctattcgagaagtattggacgctcatgttatatctcttcctcatgtcacgccacaacttcagcttgcggatatcctcaccaaggttgtacctcgtcctcgacatcagtttcttagcagcaaactgatgcttctagattagccgcatcaatttgaggggggatgtcaataagggattctgttattatgttgtttcttgtaatcagcaaatctgtctattcattgtatattattagctttcctgatttaggttgtataaattaggaaatagaattattgtgtcttaatggctgtaaatgcgtctttaatgacagtaaataaatctgtattatttatggatgaacagcagaatgaagggaaagcattcgagacagaaattctgacagaaaactaatggacaagtaaataaaagacatacttgcgaacttttttcagcctttttagataatttgttgccgccaatgaaaccagaagcccattttaagaagttggaattcaagccacttccctataaaaatatcatgaagatatctgttatggattgcactagctttagcctttaaataataatgtttatcattttatgcttcaaaacatgtttttaaagaacaatttttaatagaaagcactcactttcttctcatcttgtgcattgtcatcaggaagaagtaattcctcatgctccttgcccttttttttcactacttccatatgaaatactttaccccgtaaatcattaatagtaatgagttttgatgattgtttatcgtaacttccatcaccatcttcctttaaaatgtaaagctcggaacttcttccaggagcaagctgcaagtaccaaactccaggtgagactttcatttgccaatatcccaggttggccatcacaagggtatcaactaaatggggagtagtctttgtcccaaggatcagctgaagtccccgaggaggatcgtgatctttctcagaacagtgacctgattagatttcacaagagtgacaatagattagtacacagtgctcattaatgattgttaacatagaagagagacagaattaggaatataataattagagagattttaggaaaattgatagagcctctattagttggtttgggtatgtttagtgaagactggtagaaacaccaataaagatgtttaaccagatggaacatatttcattagttagaggtagaaggagaccaatcccatatttacagttaaacatatgacagtaatttatggcctcgtatgatccctttagccaatccacctagtgggaaaagctttgttgttgttgtgtttgtaattgtaagctaacaaggagaaaacagaagctaatgttatagacataactacacatattaaacatcctaattgcacagaagtgtttaatagaaatttaaccagtgacatgctgctggttcacaggctacaaatggctatattcattttcccttactgtgtaatgagcagagtaggttccccattttcttgttcttaaattgttctgcatctgtttcttcatgaaattgtttgtttcacatttcagtgttgggtgtgcctaggtccatggattagattttgttgactagctttaattgttatggtagaagtaaagaagccaaatttttatggtaatgtgcaatctatgctacactttgatgattatgcaggagcattatttttgtttttaagggatccctttggacaagcatattctttgggataagattaggcatttgaattgtagtagttgtagggacttttaaaagtggtgtcaattacaggaatgttaaggttgggaaactttgcttcatttttttgttgttgtcatttcttggctgttcttttttttttttttaaagagggcctctaaaagaaaaatttcttatataactttttttcttaaaaaagcgttaattatgctaatgaactagactactacacaaatagatgtggcctagcattctaacaagtagcaatgattatttaataatatcactaactaacagcttgtatttctaataaacaagatgcaatcttaccagtgaggacaagagcttcaagctcaaaaactgcttgcaatgtcctcgtgtcaccaaggttctcaagaagaatgttatccaggtcatggctgcagcatgagagatattactaaggactattaaaattcacaaaaagtagtcattacatataaaaactcagaaatgtattacatagacctccctcaaggcatggaaaaatcatatttatttcccccattcccgaaatatcaaagggaatgccttcgcttgacagaaaaatacaaagcattcagagtttataatttaattcaacaatttaagttgattatttatctaccagagttggtgtgtgtcactaattatgagattcattcaaatttagatgccaaaaactttattctttttaaatgttcaccccatttttacgctattaattcaaatttataacatgcttctttattaacaaagacaagggtacatttggactaacataaacattgacattagaatggtttaacgagtctaacagctacttaatggaataggttacggttactataaattttaaatgaggaagaccagtgtaatttattcacaataatttactcgtctccagttacattcaaacaaaaaattgataaaagaatcagtatattaacaaattctaaaataatacatacaatgcaataacgggctcaacaagccaagactcaggaacatcaagattcatggtgagagtcttagacaatggcatgtttgcaaagagtgcttgtgggccatttattgcagagtcagtgttgctaaaatcatcctgcaaaaatcagaaaccctgtgagacctagcatcaaatatcatgtctggaattatcttagagaattaagagttaaataaataagatataccattgttggtaccacatatctgtagtagctcttcagaggaagatcagcaagagaactctgtcataagatgaaaacagcattcaatacaaattagcaaatgtataaagaacttggcaacacattttgctggacgaaaattaaaagaaatatatcttgtagaaaatctcgcataaactatcactagaaatcaggagttcaatccttgttgctccattcttctaaataaaggctaaatttcgatacaagatagattgggccttcacattaatggatcttgcaagagggagtgcaatggatatcaaactaatcaagagccttcacctaaacagttaagcatttgggagagttggctcttggcaggttacaagctaaaaatatttagagtagaacagatgagggatagatgaattaactcctacaagcctattgatcataatgtgaatggactaatacatgcacatttggtttaagtgtaactattgcatcaaggagttcctttggataagcagctactttgggataagataagatcagacaattggttttacttggtgtaaagccgacatggttttttatactaagtttcatttacaactcagttgagggattggatagattttctttctttgttctctgttgtctgtatttcctttttattttaagaaggattttaacctcctgattctttgtaatcatatattctgtgtcaaaaataaaaggcctaaaaataaaaggcctaaacataagactgaataacagaaggccttatgaaagccaaattaggggaaattcacagttccacaacacaagggcaacactttggcttgtctcatccaatcacaatgagagagaaacaatttttttccatcttcttttttattccaaatgcctaaaaagaatcttattgaaggaacaatttcagttgcagaaaaaaaattattatataattatatatgtttgcagaacaataatagatttgaaccaaccactggattcagtacaattctcatgctgggctgaatgtatttccacaaaactcgaagaattccagacaacctctggctggttggacttaaaggatcaagaaccgcatcaatatgaatacttgaatttacattatttagaataatgacactgcacagataaatgatggaaaaagaaatactgacatcatataatacatataaatgagcaatccaaaaatgactaaatcataaggaaaaaaatgtttgagtgcattgtaactgataaaaataacctatgctgatcattcagaatctcaaaacgagcactttcagaattccgctcccgcatggccattgaagatgataaggccatgacaatatcactaatgaatttgctgcaaacaacataggcaacattaaagaattgttaaatattcagtaaacagaagtgattgaacaaaaaatctgtttaagttactataaatcagaggacttatgcacacccaacattctccaaaaatttcaagaactcaacaaatcagtagtagcagaaaaatgtaacaatagatgagcttgcacagcacataaacacatatgggagtttgctatttaaaagaaaagaaaatcataggcatattgaactgaaaccgtgtgtctgaatacaccatggatgagagtttatataggcttatagtattcattgcacataaatagaggatattcagtttcctataaatcagagattatatgcctataaactacaattattacaatgaattcagaaattatattctgattcccacatgcttatgtgacctatcacctatgcactttttaattctttaatttcttgtttctaaacttactttctattcaactgattcccatattcatttgcttgaatataaattctgcagaaattggtctatagctagcatggtttctcaatcaatcattgggaaacaatacttatgattatctcatcactttattctttgtatgatctttgcacttgcgttgtgccaaaaatgtcatgtaacacctcacttttaggctttggttttccagaccctccctccaacattttttagttaaaagaaagcatgtcataggaaggtgatatatgtaatgatccatagagaaatcaaacaaaaattaaaggtgaatcaaacagaacagaaaagttcaagaaaccttgttagcatgtcggggtaaacatcatgccattccacctcttcaataatttccacaatgtgctttgtcctttgtttaaattctattgattccagaagatgcagatcagcactcaaaaatgtgctttcgtcaattggataagttacctattaaagatagatattaaggaaagaacacaagattaataaggaaatttaaggattggtgaaaattcatcagcaaattttgagagagaatatttgtaaacaagcaatggaacaattattcatcagaaatcgttatactatgaaatagctgaagacaccaaaacaatattacccttccattagtgaagacagcattgacaccagattcaagcccaagcaccctatacaaagaattctgcacctgataacaagacgtctaattaatacaaattatcatgattaacagacaaaaaaatattagtgaaaaactctgaaattgtttaacatagtgcaaactaaaatgaaatacataaaagaggagcagaaatggaaaaaaaaagcagcgggaaaccatttccttcaggtattagtatcaaatagaaaaagtaaaagtatgaggcacagggttgggttgttaagaactaaaagcaaatgtccaaatggcaagataaactagaagtaccttagtcaaatgctttctcacttcaccggcaggaaattctaggagggcagacctatagcccttagatggtaacccattggcttcaccaagctcgcaaaccatatcaacaaatgcttgagtgcttcagcttccataggaggtgtaaggatgtaattcttctcatatagtgagcaaagctgatccaagaagtccaatacattcgtcttatgactgcacaccatgcgttcaaacatttgatataaaaatggtgcttccactttggaaaggaattgacaaaatcacagaattgaaattaaacaatctattaaaattcaaccagcttttgaattaaaagcaaaatccaaacacatacctatacaaggatgcagtaatttcaaagaccttaacaaataggaggctaaacaaattaggattccgattggcattaaatagaagacctacacgagcatttttggatccttctatctgtagcattatgttcaaataacaaaaacatcaaatatgcttaaaagcatcaaataaattgctccaactcataataggcattaggcacaataatttaaaaagaaccaagaagatttaaaagaaatgcatattggtattaaccagataatgtatgccttgttgaagtaatttcatcccattccttgaagtgatatcaacagcaagaagatgtgtcacagccttcgtatcatccattgctggtttggatcaaaacaatccacatgtgacaacaaaagaaacagactgtacaaaagaaattaaagattctaatatttaaacaacttacttccaggagaatgcaagtagacaatgtcatttagtatagattcctccccaaaagtaaacattgacagagatatgaaccttggtttgctgtcagaaataatctacaccaaacgattagcattagaaactggttatgagtatcatataaatgttcccaaaatttaaattattaaattaactactataccttaggattataacgttgtataccagcttctgatagaaacttagctaatacatcagtgtcagacattatttgtccaaaatatattgttcctgtattcttggagtctcatcattcaaggcatttataagagcttcctggtaaacacaattgcatagaaataagtagaggaaaaatttattctactaacactattaatacatcacagttatactagacaaagaaaaattgggcacaacgcaccttaaactaaagttgagcacatgcagaatatccaaaattaaacaacacactaacgaaaactacaacagtatggataagtgcaagtagtcaaacaatgataagtatacgaaggggatcttacaaatttatagatagctgtgagtttattagtgcattgtaagagactcatctgcattttactacataaagtgtatccagtgctatttattttattttgttttgggttgccatcattaagaaaaagcacatataaaaaacaaagagaaagaactcattttacaaagaagaccacaatattactgttagatattattacagaaagtagtattagagatcacctctcatgcttgcactgtaattttctttttctgttttgggcttcagttagtggtctgggtcaagcttatcagctagcccatagtcagcttctatcagttgtaactgatttttacaagtgtcaaagatgatatgttttaactacagcagtttagtatgagattatttccattattactcattattttgttttcttattttgtaaacctccttcattataaataagagtatttcgtgtggtctgatacgacaacacaacagtaaataattcttacatggtatcagagcaggttattattgacaaagaaataatgaaagtcgttcttcattggggacctactatcatcggtggacctttatgctcactgcccttcttttgatgaccctttctcctttcttctacacgccaaacagttttggttccattatcactgcagtgtgccttcgttctcgcatgaacagtaccagtaccgcaagctgctgcaaccctctattggcagtcatcgcgccttctatctccgacacaaccatacccccggagtctccacctcccggcgaccagcgtgcaccctgtcatgtcgccgttcaacgacgcacgcaccaccactctccagcgtgtgtgcatcacatgccagctacagatctgtgcatgacacctaccgccaggctgtccacatgtgcaaccaactcaacacaccgccacagcaaccccacgcagggcccttttccagcgagaaaagttcacgcacataacgtgtgacgtgtcacactggaaccgtatccttctgcctcagggcatgctattttcaaaggtgaacaatacccatcaccactacaggctttcattggttgcctccgaggtttattcggcacaaccccatgatcggaatcgtcttttgtttctgttgggtttaccacatttgtaacaagcttggttcatatgatatatatgctccagcttgaggggagtgtcaaagatatgatccgatatgttttaattagagcagtttagtatgggattatttccattattactcattattttgtttccttattttgtaaacctccttcattataaataagagtatttcttgtggtcagtatgacaacacacaacagtaaatcttacaacaagaatcaataatacagtttactttcagttgcacaaatcttttttctctttctctgaattctatcagaattaatgtaaacagagtgattataggtgattatgtaattagtgatatcatgtaattacagtaatcatgtaactataaatccttgtacggtacttattacactctgtatatataatttgctctttaatacacagcaattcatcacatttttcattttctctttctctcaacacttatatcttggccaaccaccttgtacaatataaaatattgtgaattgacagcagaattgaagaaaaagtacaaaaaaaaagaggaaataaaattttaaggcagtggaaaatattaaaaaaatcattacctcagtgggatcaataacaaggccattcatcaacaatgaacattgaagcttagacaaaccaagcttaaatacaaacttggaactttcttgtgacaattccttcaacttttgattcttatacagctttagtaatatctcttgaggtgggaatttacctttgatctataaaatacagagaatatttaattcatgtttaaaataaattagaacgtaatgttactgctaaaatattgaagcactacattagtcaaatgtcagaaggatactaatcaacaaaaatactataaaacttacaagattgtttccacaaacactccttcaacatggtgcagttcaagagcatcatctgcattgccatctgactcgatgtgtaatttgttaacctacaaaaatgtacaatatagttcctttaattgaattgaaaataagattagttttaaagtctcaaaacaactgctaaaatgtgtttcataaaaatcttagatataatagcatcatctatttgtgtatgctaattccaacagcataaacatttttatttttatcaatataataaaaacctctaaacaaacctttcagatttatttttcccttttttgtcatgttaatggggaagagatgaagccacttaaaaggttgtcaaatgttacgcataggttcatgattttttttaaaataaataattgaattcataggaaagtgattatctagaaatttgcatagtgatagacaaggggaaaatttaaaaagaaaaaaagattatgagtcataaggttgaaattcaaagttaagtcaaatcaagcacttggaaggttcaaattttgaactttaatgaatcaaatagatatgtagttaggttcaagatgggtggagtaaaatgaaagaacaacataacaatattaactgcatctgccacttttctttcctaattttggatttaagtcatgtgcttctggcatatgaagttttaacttttaaaccagtcgtaagtaagttcatggaaagacattgaactgaagatgacactaatgactaagtatcacactcatacattgctcaaaaaccggtaagccatttcagcaccataattctcgttgatataactgaagagacatataatctgaaaagagaaaaaaatgatgtcataaacttgccagtgaaactataacatatagaaaatttctatgacatttatcacacacacattcctgaacaacaaaaggtaaaaattaccgtagttgaaatatctcatcgctgtgtcttttgtagcatgattttctaactgtgtaacaaactcgaagaatacaacacaatcccaaacctcacaggaaaattattttcatacaatgatatgatcatatcaatggactgcaaaattccaaacaataaagcaagtgactaagattttgcttggaaacatatacaatgaataatgtgaaaatgttaagcttgaggaaaaaaaacttgcctccagaccacaacgggttgctggatcaagaacaaagacagcatggaaaaggtttttacggatgtaacgtagctgcccagggaaggctggcatcaagaactaacaaaataaatgtaaaatatgttaggttaggctaaatctttacacaaacagtacttcagtcagaaaaatctcttgaacactttgattctatattttttaattaaaaaaataaagctaatccaaacacactaattcacctcttctaaattgttactccaccatttatatttagcatcttcttccaagttgttgagataatgaacatgactagaatgaaaatcaactcgaaatatactggactctggaggaggtgaagttgagagcaatttcttcaaagtgcttgaggaatctgcaaatagtgagaatatcaacaatacagttcaggtgtatgtacatatcacaaatgagttttataaagagaaaaaaatggtagcaattaatagaagtttaaaaaattaagggcttgtccagtttgagaaaaatttatgtttccataaataattacaaaatgccaccttggtaattatttatgaaaataggaaatgaaaaccaaaacattttcttaatccaaacaggtaatcgtgccattttttctatggaaaaaataccattaacttcttcacctcccactcatcttccctcctttcaatacaaattgttttcttgggagactatccaatgttacttttgaaaacaacattttcttaggtaatatgcatcagatgactatttttcatctgtcaattactaggtcagtgaatagttaaacagaaattagtgcaatagtaaaaatatgacaaaatgaaaattagatggcattcaccttcaattttgagaactgatcagtcaacaagagatcctgacggatcaagtcaatcaacctaataaagaataacaggaaaatagtatcagaaattcaaaaatttcagcactgccaaaccaggatcaaaccactgctaaatatttacattcttagaacctaaaaactattctcccaaacataataacaattagttgacaaagcatttacaattatatataggaaatgactttaatccaacataaaaaaaggaattccatacgataagtaagatactttgaataggctcaactcaaataaacacaaaaccaaaccataggtatataaatagacctgggtttggctcttccaatcttgtgctaagtgctaactaacatcaaaagaaccataaatatgagacagcaaagtcttaatgtgctggaggggattgaaaaatactaactctagctataatagaggcacaaacatgaatacgacaagataatgtataaattatcagtaggaaaaaaagttattacagatagaggtcaacatcttcgacattgactaaagcaccattgagagccattaaagacttgccaggtgggaccatccgctggtttgccattatttcatctcgaacagaatcatcaagctgtcatgagaagcagttccgtaagaataatagacatttttttccaaggaaaatgtctaaaaatatgtgagtgcctaacataaataacaattaacaagattatgtaccttcatgcgagacaaggaagaaactatgctagggaagttttgattgatttcctgcattgactgcagaggatcagaagcacggacaattctctgtacagtttgatgtcctagatctgttaccatcagaaagaaggggaaaaaacatagaacactgttcattgaagccaactgcgataggattcagcttccaatctttccaattatcagaggaaaagagaaaaatattttaaataccctttaattcccaaacatcaagtgtgtctgatacagttgatgacaatagataatcccgaaaagccatgacctcagatgttaagtcaggtttacgttcctgtgagtaaacaaaaacaggtaaatttattggtaacactagtgtctggataattttgaggtggggcaataaatatacttcactataaatattaatatacttttataatgttatgaaattaaccaaagcaaataatgagttgacaaccatatggaagcagaaaaaaaaaattaatcccacaaaagagactaggaaataaatttctgattcaaaactatgcactcttttctgttcataacaccacaagtatgcaaaaagtgggcaatgccaaaggatcttagcttccttcatcctgccaaaacctttcatattaatcgattaaaaggcattaaataatatcctacagtaaatatatcaagctgcaaggcagtgagaaggaaatggacacaactttacattatatctcgcaaagcacataatattatcacatttaacactcttttataaaaaaaaaaaaaagaaatgctagcaacacaatctctaacacacatcttctattattggttgaaatttattgaaaattacaaaattctcattatcatgtgtgtgtccaaaaacaaatgtgagtttacacaccagaagtttagagaatatgaatcctctgacttcctggctaagatcttcagttcgaggatcctctaaagtcacacctgcaatcctcactgtgttaatgagagaatcaatcatttaatcacaagtaatctttcttgatgtatataaatatccaaccattttaattggattagcaatatacaaaacaccaaaagaatttgtgaatccagaaataatttaacactaagaaatgtacttttcaattatctatttcaaagttataattaataaaatcttcaaacctgaaactcattgtaggaaaacaagatggagagtctttaacgaacgataaacttataaatcaatgcattgaggtaaggttggagaaggtcaatgctaactaactcaagtaaccagatggaaagaccataaagggtaaggaaaacttctttaaatagcagaattagaccttgagaatagtacatattaccatgcaaaatgaatgaaaggacattgttggaaactgcaacaaatctattgggaatagctgaatttaaagcttagattcatgaaattttagattcatgcaaggtgctttaattcaagtacttaggtagttgcacttgtgcttattcttcttgtaaatgtaatatgcaattaattaattcaaaagtgtgtgtattaactctgctagtgctaatcactcaagcatgtcacaggtttcttagtccaaatctaaaattgacatcgtaaaaaaaaaaaaatgcaagttcaaagaaaacttacataaagagtattgttaggatccaattgccccataccttgcaattggttcctaacaaggataataaattgtcaaatcctaggaatagcaatgcaagcatggaggtcatgaagtcaaagaaaattaaagaaagaatacttttataatttctcgaaaaatatgacattttaaaaattacaaaaattacaaagagtaaaaaattggaaaggatgatcaggcaatcacaatttcatgtactaactttcttctacaattgactcagtatgcaaagttaaagagaactagaagccttcactcaacatgtgtcaatcattctaacctttttttactgtactgtcatccatggccttatattccatattcttcagtgcaagttccacaccataaccacccaagttcactgattcaccagcaccaacagaactacaatgattgatatttgattcacatccagcaggcaacactggccgtacaacatacttaactttcccctaaaattattcagtcaacatattaatatagttgcatgggaaatatattagataagcattacatttttttttcaaattccaatcttaatatatgggacaacaatataaatctgtttaatgatttcatcgtttcacaactccttgactattaccatatcttcaaaaaacattagtgttgcatacaactaacatattaatctaaacttcacttgaagagatatataatatctgggatattttataacacagaagatggacatctcataattcaggtgcaattcaaataatttacattactcttatcagttttaaaccttttgtttcacattcttctctccattgaaatctcctggggttttatcaaaaaatgattatgtttacatcatttgatacttgaaagcaaatccattttggaggcttgtacagcagaatgctaaatgattataatagctgccaaaaactacatcacattatattttctaaagagttaggcaaacgctctgttaagtaaacaaaagtaaaaaagtttttataagaaatgagagcttttattatattgggtaatacaaaaatcattttacatgtgctttttaagtaaatagaagcatttagaaatgcctaaagggcattggttagcaagatcctaaattcctatagttaataccaaaacaagaaataaaagttaaggaatgtacctctttggcagctttaactaaagcaacatgaaactccttaaaacaattggttccaagtgcaccgtaaaggatagcaactggacttccaacacttaactcataatagacgtggtcaaaatcaaatatttcaggtgtctgaaatgaatcacctaccctgaaggcaaaagtttacaattgacaacaacattggaaaatttaaaaaaaataaataaaaaaaaaaaaaaaaaaaacaaacagaagtgcactaatggcaacaaagtactcacagctcagcagagccctgaagccactccagtaattcataaacatccaaaaacaagtgttcaccggtatccacccaacaacattttcctccatggcttttcaggtttacaccatgcaggggatctaattttctcctttcaatcttttctgttagcaacttttcctcagtctcatcatctgaataattttcatcacctaggggaaaagatgcaagagattcttccgctaattgctggtagagcatcagtctaggggatgctgatctcagcataagagagaactcaaataatgattttaatggttcccttagaagagggcgcccacattccaaaattttcttcagacaatctttagctgtttgagatctaacagcatcgttatcagtattaagccaaatctcaacgaagtcccagaaaaggtcctttttttcgttagataataattcactgtttccaaacaataaatggatgttataacatggaaattttacaattggccaaaaattgtagacagatttaaaaaaagaaaaatagtgtatgataatgtaaaagacaatatgtgctgcagtcgaatgctgcatatgaagtaacaaggcatttaactcggttgaaaacagtaatatatgttgtacataagaataagagggaacgacacaacaaaagtatttcacactcatcctcataagtcataactaaccacatgatgtaaagataaatcaaattccatgattttcagttcagccgaatatttccatatcatccatctatatgaatcataagacgagcaccatgtgccaaacttaataatctgatgatctttttgtcatctaaacaatctcttccgaccacaaaagacttcagaaagaaaaacaatcaggaaaagtatcacataatgcttcaaaattccaccacctgacccccacacactactaaatttgagttggaaattctagttttagacactacagtccattatgtcatgtctaactcaaacaaatgacaatgatatcccatttcacactcctttacacgcattcgtatacttcaacacaatttcaacaaaacattagaaacaagtctaaaaataacaccaccccacattacaaaaacacataaaaatgtttgaaaaaggaagagcaaggacatacgcagcttccaaaagcaggggagttccagaccacttagcacggagtgcagtttgaacattcttgggtctctgaggagtgtcagcaatggctgaaccaatattcacaacaccaacacaatgagaacccaacatcgagatctccaaaggcaccccatttgaatttgtggagcgagaatgaatgtgggttcagaattgatgccccatttgcacgtgcgacagctgaggaagtgagaggagcttcgaaagtttcgatctttgttctcacttcgaggactcgcaggttttttgggaagagacgaccaaaggcgacgactgcactaagtacgttagtgcagcgatcccatgttacatcttggttacttttttagataataattacatttcggttactaaaaataaaaaggattttctttataaaaaaaaaatacttttttgcgcctttgataaattaataacaatattagaagttattcagaaaaatgtagtattatattgtttatactttatatattataatatgtcagtttcttaactatttaaatttttccataaaaactatttagagtttttaaataagttcatatatttcagaaaaaaaaatgaattttaacttataaatattttttaattgaatttttttactccagccagcgatgaaaagttcttaatgttaagttgagtgctgaactcttcaatggattggccacaataatacatgttgcttctcctaatttcgcaagtgatcatttcaaaaattattttttatttaaagttgtataactaaatggataaactcacactagctgttaatttggaatcaatttgattccttagaagatatcataaaggaatttaggaatgtaataatattatttggttgatcattttttgagtcagatcatctattggtaagttattacctcacaaattagctaatcaaacacgagctctttttcaagtgaatttcttttttactcctcaatattaatagtcttttcagttgttgttcctcattggattctattaagtataagaaattgattaaaattatagtttaattttgatatattttttttaaagatttttatattatcaactaaaaaaatattattaaatgtgatttttttagtaattatacaaaagtaaattttattatatgtaatagatgacaatataaaaattttaaattgtcaatgtattttaattatttcttaattttttttaaataattcaagaaacctatgaatcatgtcccttgaatctttattctccatactattacatgcttaactcatgaggctgaactttgatatcaactgcaaaacaagagagggaaaaaaaacataagaaaataagaaagaatttaaattatgtttttgagatctcttaaaccttttgaaattgatcaaaagctttttgaaaaactttagcaaccaatgtaagaatgaaagggttttgtgaactaggagatgattcaaatgcaacaaaacattttataaaagcttttttttcatgaaaaatgtttatttcatataataactccttcttcatttgtaaaaaaagacaataaagataagaataggagaaattaaaataaatgattcatggaaaaatcttgaactacatttaattcttgattacttagtagttcatttacgaaaatactaattgataaaaatcttaatttcttacaagatttaaatatgtttttggttttaataagttagcattttttatttattttaatcttttctcccaaagttgtcagaattattcataaaataaatctcaattcactgaatatagctttttataatcaccttaagaccaaacaacttttgtttttccttttagcttctcccaccacctcaatagccacaaacactatgtaaaaaatctcttgcccaagaagcacttttgcctttgatcaataacatcattaagtactttcttcaagtgtaacacttttgtcagatcttgtacatacatcctactaggagataggtctaaactccccaagccctgtgggtcgtcaaccttgggattagagctatggatgaatttgagcctcttgaaaaaataccaaatctatgaaattcttccataaacctcatgatgtcctccttcaagatatgcaaaaagctttaatgaatttaatgtagattcattaactcggcttttagcacttccacattgccatattgcctcctttacctccttctccccaacctctcaaccaaaccaacactatcaatttgtgtgatttggttattttatgtctttcaatatttacaaaactaaatgccaattaaatcttgaattactatattagtattttagtgttaaaagtttaaatgggagctagtgttaaagttgtaaattatcaaaatatcacgtttacgtttctaacaattaatatgttgttaattagaattcattatggatatgattcatgaattaagaaggtaactgaaatatcttattcttactaggtgatattcttttactagtaagaataagatagtgtcaatttcttaaacaaattaatttaaaatttgaatgttatcttatgttatttttttttttcatgtttttttattacattatgataatgatatatatatatatatataatatatatatatatactatcaaataaatttaatttaattattttataaaatgattatgatgtacagtctatatttatgtaaatttagataaaaaaatgatttttttataattttaacatgattcataagaaaaatatttaattttgtaattttttttatccactaatgatcattattatcaaaataaatatcacgtttagtttagccttctttattagttctctgatacgaccgtttaacggcgcttcaatttattcattcttcttagttctttgacgtgaccgtttcgttctttctaacgacgcttcaattattaatctataaatacattgctattgtgtctgattcttccacaatcctactttcatcaaaacaggctttgcattgatttatggttcaggatttctattcaagaaggaagagaaaaaatctaatagagggaagaagatgagagaatactgattttttcttttgacatgcatgcatggcagaaagcatgttctctgcgtcttccttcttctcttatgttttctcttctttctcgcactctttagaacaattgcttggactgatattgaaggtaaggttttatctaatatgtattcatcttttaaggcagagttcttgattgcattgataagatatattgcaggaaattattaaagaaaatgaccaaggtgacttgttctaaagtattgtttttcaagaaggaagtattgttttgtctttagagtcatttgagtcaggtagaacagtttcagtgggtgcaacatcgaaagcaaaggctgggaaatcaactgccattggtgtttcaaaacatggaaatagagctgtatcttctgcatgttgatttttctttggttaagtacttttagatttgttttgatttctaactatttgtttcatcatctcaaaagagagttgtggcaacagagggtgccaagtctgatcaatatctgttcaagatatagcggtccagtctcaagccttgttaagtaccaaggattcaattaaggtattgtaggctgaactggagtataccaaacgttgcttaaaatcttataaatgtggttggactgtcgtctggattttcttggaagcaggaagatcgagagagattggtggtttgaaggtttaagattgaggaaccacgtattgagtaaaatcaagatcttgaggtgggaattttgcattatcaaataatgtttgaaaaactgtgaattttactgtagctttacaagatcatgaaggagcataagaaccccaaggttcttagtgagggaattttgcggatggtttctgctgttgaagattttggtgtctcacatataaagcttaaggtgcattatctgaatttacaaattttttagatattttatttgttgttggaagtttgtatggtttattgtaaatcctattttgcaggacttaattgatttgcttaatgaaattgggctgcagtcaagtaatgctgctactagaaatgcatcaattaagttcttgggtgttctgcatagatttgttggtcaaggtcactttgcattaactttcaaattttgatttctctcaattttgttttcaaggctctaaggtttttctccttgcagacattaaagggtttcttcttactgatgtaaagcctgcactgctcagtgccccggatacagagtatgagaagaatccattttaggtatattatgtttgttgaggttagttctatgcagggttttaaatagaatgctatagcggtgtagcagagcagagtgatcccttcccgctacgggtgctgctgtagtgaatcagtttagtgtagtgtccatagtgaagcaaatagcgggttgaatagtgtctgtagtgggtgctatgtattgattccaaaaaacccctctgaatagcgacattagggcttgttcagagggctatttgtgggatttaatttcctaaaatcatatttgtagatgtaattatagtgaaatgataaagaaggctttgatttaaaaaatgattgttgatgatatatataattcctatctaggaagctcgtatttaacgtttgttggtatttacttgtatgttttgtataagacgtctagactttttgttgttaatgatgaatgtcattggtttttaataatttttattatttttgagaattgatatgtatacagtatacttatataaactataaaaatttcaaaatagtggctatccgctatatgcaatctcgctatagtgttttttgagccagccgctacgctctgctatccgagatttaaaacccgggttctatgtagtatcatgatttcctaatgcggtcatttattttattttgtttcccctgcttcagggagcatctgtagttaccaagagaattgtcagggaaaaagacccatcttcaactgcagttgctggtgcactggatagcttgcctcggaggacatcagtggaaagatctcaccaactctcctgaagagcttggaaagccctgattggaaggtttggttgataagagctagcaatttgcttttaattttgtattcaaggttgcttttagctttcagtatttgaggaagtgtattatggtgctattgcttctaatgttgcagtgcattacttattataggttgtatggaatctgttgatgctgtaaacaaaataatggaagaggctaataagcgcattcaagcaactggaaatgacactccattagcatttttttttataatttttttaaccttatgctctctctctctttactctcccctttcatcaacttcctccccaaatggataagttgcatggtatcttttggtaattattctatatttctagctgattattttgttaattttcctaactgttttattaccaggtgacttgtttggggctcttaggggacgacttgttgataacaacaaaaacatttcatggcttccttgacagcaattggcaatgttgcatcagcaatgggtcaagctgtagagaaggcaagcaaggtaagaggattctgttctgttttcgtatccccccccacccccccctccccatttggtgctgttttgctgtttgaacatttctggaaatggtttgttgcagggtattctgtctgatatattgaaatgtcttggtgacaacaagaagcgcatgagagaatgtgtgctgaatacattagacgcttggctggctgctgtccatctggttgaaatggtctgtattctgtgctggtcctgtgttctttcattcttttgtcttggtatctgtgtccttagcatggttttcctataggttccatatattgcaattgctttgatggactctaaacttggtgcagaaggacgtaaattttttttattggttatcgaggcaactttctgtgttaagtagttttgctgaagctgcacaactgctgaagcctgcctcttctgcaatgatagtatgatctggttactctgcattctgctttttcattttttataccatttatcgaattagttctaatgttccatattcttggaacaaaatgtatgatgacttcttcttaggataaatcttccgatgttggcaaggcatcagagcttgtattaatgagatactaagagctagtagacatgaaatggtatgtgtataagaagaatgctgctttcttcccttgtttccttaatattcttgtaatatcaagcatcttcattgtttacttatttttagattgaaaagatggttaaagacattcatggaccagcaccgacactaattgttgagaagttaaaaccataaggagcttttcaaggcatgttctttggttcattcttctttgcgaatgttggtgaatttgtgcttatatatcttcccttactcctcctttttatggtctttagagtcatttgagtcgggtagagcagtttcagtgggtgcaacatcaaaagccaaaggctggtaaatcaactgccaatggtgttttaaaccatggaaatagagctatatcttctgtatgttgacttttatttggttaagtactttcgatttgttttgatttctaactatttgtttcatcatctcaaaagagagttgtggcaacagagagtgccaagtctgaatcaatatattttcaagatcagtctcaagccttgttaaatatcaaggattcaaataaggtattgttggctgaactggagtataccaaacgttgtttaaaatcttataaatatgtggttggactgtcatctggattttcttgcaagcaggaagatcgagagagaatggtggtttgaaggtttaagtattgagcaaattcaagatcttgaggtgggactgtttgttgaggaataatcatgcataacttgaactatctataagtattgaattataataaatgtgcctgcaattttcagaatgataaagtatttcagagaggaattacataggagactcttaagtgcagattttaagaagcaagttgatggacttgaaattctgcagaaggtgttgttcttttaaccttctgaattacattcttttgaagtgttgagtgcactagaaattgtacaaactgctattgcatatttcaggcacttccatccattgctgaggaagttatagaagttttggacagtcttctgaggtggtttgtgttgcagttcttcaaatcaaacacaatatgtctattgaaagttcaatttatttttgtttttgttgtgatttcagttttcttcttttcctttccttccttttcaaggagatgtctgctgttagtcttaactttattcaatttaatttataggagtatacttacttgatagagtcttatcttttcttaattgcttaggtgctggaatttcttcctgaactgcttgacactttgaaggacgaggggttctcttgaccgaatctgaaggggcagtgtttcttctgtgcctagtagagaaggtttatattagcaactttaatatttgtggcacctgaggatgttgttattccagtgaatctttctgatggtatggttgatttcagcaaatttttggtttacatagataatactagtttgactagtgtacttccttgggtgttacagatgaggaagtcacaattcatttcttattttaatgttgcagttagggcataacattgagaaagtacgagaaaaaatgcgggagctgacaaaacaatttgttgccatatattctgcgtctaaatgtttcccttatatattagagggttttcgctcagagaataaccgaactcgaattgaatgtgccaatcttgttggatttattattgatcatcatggtgcagaggtattgttactagtgctttttaatgaattcttttcctattcagtattttccttgcatagttactccttgcattatgtggacagattagtgggcagctaaagtcgttgcaaattgttgcaagtttgactgcagaacgggatggtgaaactaggaatgctgcattaaatacactagctactggttttaagattctaggtatgccatacactgtagaactccatctttctggtttccaatgtgcttgaaaaatacttgtgcctagtgatatatatatatatatatatatatatatatatatctttgaaaaggaaacttgttaaaccaaaagtacatctgtgttattttgttgaattgggttgtgtttttgcatcagtgtgtaaatttcaagagttcaatgtcctttctatggatgaccacttgaggaacttatggtagagcagtttcagtgggtgcaacatcaaaagcaaaggctgggaaatcaactgccaacggtttttcaaaacatggaaatagagctgtatcttctgtatgttgacttttgtttggttaagtacttttcgaattgttttgatttctaactatttgtttcatcatctcaaaagagagttgtggcaacagatggtgccaagtctgaatcaatatctttcaagatatagcgctccagtctgaagccttgttaaatatcaagttttttccaaatctttataaaataataaaaagttaatcaatttattcatactctgacattttaaaactatatattacattaattatgatatatatatatatatatatacacacacatatatatgaatgaaggcatccaataattttaaataaatataattttttgtatatataatttttaaaatttaaattcagtaattttcagatgaaattattcaaaaaatattgtaaaagatgtttcccgcgtgtagttttcaaccaagacgctgcacgtgaaagatcccttagatttgtcaaacatgagatgaagaacccatggattggatatacaacaacccccttcgttctttacttttcttttgtattttttaggtagaaagtctgcatttcactgctatcgtgcttaatatatatatttactaatttattaacaatataaaaggttgttcataaccataaaaagagaaaagaaaaagaaaaaaggttgttcataattaacaagtcgcatttcactgctaatgttcttgatgtgtctttgaatggaattgaatcatcgaaccgaaaagttaatcttcctttttcaatatataaaacattagttaagaatcaagttttttttttaatgtctctctcggcgtcttctcaattaaattctacaaactcgttaagaaatttaaaaataaagaacctttactgagatataaatttgtcacaaagaaattttttatagaataataaatatttaattgaagaaatatagaagagaacaacgacaaaaaaataaattaatttcattctataaaactattgtcatgatagcaaagttaatttagttaacaaataattgtgtatctcttgtttataacaactgacttgggtccacgtgacttctaaaattgtattcaggcaagcaagcaagctttggtcatcctaagactaatcgtgatattcttaattaattcaaggtttttgtttcaaagctatactaagaataacgtagcaaaattttgtattctacttctacaagataacattccaatttctaaagaatgaagagaagcaggttggagaaaaggaacaaatgacgcgtcaaagggctgctgctgtagtcttaattggccaaattggcgaaacgaaacaccgttggtttagaagacataatcacaaatttcataaaaaaaaaaaagaagaagacatggtcacaaattgggaaagttattgagactcctatgttgaatggactcaggctgcttcattctaattcttctgttaggactgtagaaaggtcattcgagagtaccctggaaaaggaggcagcctccaagaagacaagaacagaagcaaaagattattttttccaagattggtgctattgacaacagatgtactaattcgccgcaaacatgataaagataacaaaaacaccttcactaacagtttaactaatttactagtattatgcatctgcttcttcaacaacaccaataagcgccaccacacaggaagctcaactagcagatggtggacgctgctgtgaaagaaaaggtgcttccaccactgttcccttgatgttgtcaccgacaattacagtgtctccttccgaagcagctcgcctcttgatgtaacctaatccaaagtgttcagattccttccttccagatgtgtagctggttaactttccaacctgcaaaacttgcaaaaaccatcaatttctttccaactcgttaaggagaatgttaggattacagaaagcaacccaacatcacaagcactgggctactgactcagggaaccactattagttatccattttttttacaagatggttctccagagaaacattgtaactggagttttcaccacgtacctgtcatctttagtttcaactgggaattacgctatgcaaatttccatcttcctttttaacaaatacataaggattgaagaaaaaaatagtgaacatttttcaaaagaaattatatagcacctttttcccatcaactgtaataatgctgccaggttctgcagcagcagaaagatgaaatccccataacctctgcttgattccatcatatgttatgagcctagatatagtctcctgacctttgtaacaacctgaaaaattcatagtcagactaattattcagcaagtttcaacttttacgcagatgggtagcggcaaaagaacagttgcacacccttatttagagaaaccgagttccaaagacaggcctccaggacattgaattcatttgtaagctccattccaggagtgggccttcctaagaaatcaagttatgatcaaattagataaaagaatcatagggagtgaaactatatacacaaaaaaaaaaaaaaaaattactcgcatttcaaaaaacttccagtttcattatccaatagaatataccattcaacccaaagcaaatattaaatgcttacaaatcttctagtagttataaaaaccagtcattcattttttggttttacacaaatatcctccataggaagaaatttgcttgacatatgatcaaacacaaaatgagaacctctcccaatagggactgaaactgtagttcaccacgttatggggactatcttccattacttccaaccctcattggtaatactagctattcttaactagaaggaaattgtgcactccacaattgacatctaaatgcatttgtattctttcttgcaccaaaagtccgcatgggcttgaagcattttttacatacaccggaagaattaggttgaaaataacatgatgagaattcaagtaatgtcataattcctaattccagtgtgcaagtgtgcaactgtgcaacctcaattttcattagtggaaaattggatcttggggaaaaagaacaaagatttatttatgccagtatcattagtctccaagactactcctaaataattcctaaattacgacagaaacaatatgcaggaaataagttagtatgctatattattcaactgtagaaaccaatgacagacatagaaatatgcacacaatctaaacaattcagtacctcgaataatccgtaatttattccatgcattagaacccattgggattgctccttgagtaagaatagctttccaaatggatgcagcagccgctggagacatcaataatgaaaaaccatcttcagaaatgatgtttccaacccctatagttacaggctgcttatcaacctacaaattacaatacaaatatatttgagagaatttgttcacaataataacaaaagactatacaggtctttaagctttcaacaaaagggctaaacaattggaaaaaacaattactaggttttggtattgcagttgaaagtttactactttggaagtaacacatatacacatgagaaatgctaacaatacaatctctagcacactcttttgaatacactctctactcttggctaaaatttaatgaaaatcacaaagattgtgtaggttcactacttcactccttatttaatgaagttcattcatgatgttttagttttccataaattttaaccaataagagagatgttgttagcactccttttcaacacattctaaattttgaagttatgtaaaagatgcaaccacaatccatgggaacttgttgccaaaacaaaatttgcaattacaaaatatatgctcgttaaacaaccaaaatatgcatttctgacagtaagaaagttatcagtgagaaacaaatacatgaagcttaaaactagcaaataagacacgattgatcatgtaagttgtttttggacaaactaaataaataaaggcataaacccatgcagtcatcatcaaacacacaagaccatttgtatcttgtagagagaaaccggtgatgaaaaagacaactggtaattagtacacatacttcaaaaaagccagtttcatccagcttacattaaaatgtagatgtgtgccatatggttttccgacaagatcaccaaggttcaagttctccatcacctgcccattcattatactgaaaattaccaactctgtcattctcaacacaaaataggtataattatgtaacttacttggccacttttgggtcccaccaaaacaaaaaaactggtttgcttagttatgtcttgaatctctaccttatcagcaaaaaatatgtaccttaaaatcattacatgtaaaagatttagttcatgtatttgataatattcatcaggaaaggcaactatttggtttctctctttttccttttagttttacttctgttggtaaatccttacatcacaactaacaagaaattacctacttgttcagcatttcagtaatggatgtacaggtctctggtgaaaccactaatgttatcgcatttttctatcaaaaaccaacaagagaaagtggtcagctacatgataattaattatattgtagaaaagacaaacaaatgaattttgtgagaaggataagaaaagaaaatcaccatgagccatgcatgtgcgatatctattgttcgagctgttggtgttacaaaaacagtgtcacatccctaaggatttcagttagagatccaattacttaatcctgtattataatatgaaatataaaaaagaaattgacaagaacttgccaataacacataaatgtagaaacaatgctactttctttcaatacatacttgtccttcatgtagagattcgaagtttgcagtactctggttgtgaaggaactgaatgcgatcttctccactgactttgtttcaggtgagccaaaacatttgcatgtaaaattaagaaaacattgaaatatgtcaaggaccaactcttaatagcctaagaaaagcaagtacctcttatccgaccgaagtgtgaaagatccacaacctatgccatcagatgtcataaagaattaatttaagcaaacaaataaatcctacattatctaacaatatattaatatacatttataaattggtaagcatgcaattataagacttcaaatttgtattagcttttacaaaaacttgatagcaagctatcacataatattttgtagaaactctagaattacaattcaataatctacaaccttgagctaatccaagcccacaaaatacatgtaggttagttcacatttactgtattacttctatttttttaaaattacagactgaataaaagaagttccagagtaagtaatagaagttacaggctgaaaaattaaagtctgtaatttttatgagtttgtaacttttataactcaaaccaggaaattttataagttcgtaacttctattactcaatgtgtaacatttgacataaagtcttcaatttcaaaaaataataccaagcctgtatcttttactatttaattgtagcatatgatataaagtctactgcaatttcaaaaaacaaatagtacagtactcctttttttagagggagcaccaaagtgaaccaccaaagtaaaagagaattaagaaccaacgaaataagcagtgaagatttaccatattttgtttggccaatatgacaaagcatctctagaaccataaataaatcaattcaaagaagcaaacaattaaaacttgcattgattcttgtggtttatattgtttctaccaaatgaagttgttcaagcagagataatgaggaagcacattaagctacaggcgttaaaaaaaaataaaaaaaaaaaaaacactaaataaattacataccacaaccccgttgtccacagcagccagtgctacatcatcattatgaaatgtctcaatgatcccttcaccagaaatctctgcgcctgcagttttgatagtatcctgcaatgagtaaaattaataatttgacagtaaaaaaattgcacttagccacctgatttctcttctctcaagccatatcataagggtattccaaaaaacaagagttattatatatttttagtccttatatgttacactcattttaatttggttcttatatgacaaactttcaattcagtccctacacatatcctttaaatttagtaatcactgtctgttgttgatatgatattgtctgtcggaggtataactcaatgtagtgtagaaccaaataaaaaatgtagggatcagaaatactctatttttttgtagtgacaatcattttcaactcaattgctaggtaaacttattcgtaaatccataccagtctcagtatgaagtggcaacaaacagcaagaacaacattgaaatatattatacaaatagagactaaattgaaagccttttacaattaggaagccttttaaaagcaaaattatctgttttttcttaaaaaaaattgtaaaatcgagttctctactgccataagttatcaatcacaaataacagcgcatagtggctatttctaaaaatgctatagcagcatggtcactattctgaatttttttacagtttatataatgtatatccatataaattctcaaaactgataaaaaaaattactcaaaattcatgacattcataattaacaataaaaattcataggtgtcttacacaaaacatacaagaaaataccaacaaaagtcatggtaattggtaaccactatccactaaggtttaagcctctaaggttagaaataactaaattgtctaaacgtattcaaaataaaagttttctagatatgaatcatcaatcatcatcttctaaatccaagtcaccgtctttatcattttcactactgttacagctgtagatttcttcctcttactcctcttgaacataatcaatttctaattcttctgctgaaggtgcagcacctctcctcagttttatttgatgcctagtgcatgttgaagtctcacccacaccagctaaattggcaacatctcccccaatcaagttgttgtcacagtcaaaatccaaatcatcttcagcatcctcgccatctcctcatttctcccactaaccattcatcactaccatcaatatcatcaaggacaatgggatgacatcacgagtgtcaaagtgttgcttaagagcttggttatatttaatataaaccaagtcttgaatcttttgatgctcaagcctacttctcttcttcaagtaaatctatattataattaaaacaagttagtttcacaatcattgtatgaaaactctatatatttaaaacttctaatattgacgtatgtgctcaaaagtactccaattacgctcaaatccccatgaactacaagttaagctcagtactttaatggcaagcttttgaagatttggagtatgcaatccctcctccaccagtcagctgtaatgcagtgcaacaccttatttattagggcaactaacttaaataaattgtagtgaaattaaatttcaaaaaaaagaaatgcagttttgcacttaccaggagctactgtagtcctttgccttattgccactttatacgtagacaactcgcttaaaaccttatctacaggtttgttattttcactaagcctctcaatgcacctataaagtccttccatcacttcaggatcaagatcaagtcttggatttttgtagaagaactcgggttttagaaaatgacctgctgcatgcaatggatgattgagttgacatttccatcttctaatgattgcaaatatttctttgtacttttcttcattccctttgaaagaactttgaattgtctccttggctctatcaattgctttataaatgtaacccattgcaggctttttctcattattaactagcctaagcacatgcacaataggccgcatagccttaaggatgtaaacagcatcattccaaaatgaaggcataagaacaatgccagctgccctattcacctcacgatctttagcaatattagttttcatccattcatccgaagtgaacattcttctaagattatttttctgattatgcagcctttgcaaagtaagaaatgaagtaacaaaccttttcactccatgtctaaccaattccatcttgtttgtgaactttctcatcatgttcaaagccaatgtgtggttatagataaaactaacaagatagatgcctcttcgtatagcctttttaacttcagccatcttcccaatgtcctctagcatcaagtctatgcaatgggaagcacatggagtccaaaacaaatgctccctcttgatttctaaaattttccccaagactgaaatcaataaacttaatatgagtaacaaactaacaattaacaattaaaattgtgaaattaattaataataattcttacaagctaatacaaaattacttccattgttcgtgatcacttgcaccacattttttctccaatatcctcatcaaaactttccaagagctcaaatagtctcacctgagtcacctcagtcttcatgcacctagaagcatcaacgctcctcacaaacattgatcccccttggaaaatccaccaaaaaattcatcaaggttctattcattctatccgtcaatgcatctaacataacggaacatccatacactgctcgttcttcttcatgactcttaagaaatcgctttgtgtattccaactcctttttaaggagtggacctctaaacacatggcagcaccattggttacaaaggaatcccgtttgtaaccaagaatcgtactatatattgctctagctttcctgtcagaagcaccactggttacaaactttggcatttcgggtcttctttgaagcagataaagagacctcacctgctgttagaggccttttccctctttggagattcgaaatttcctgcatatcttccatctcatgttgcaactcattcccagcaggtaaagagacctcacctgttgttagatttcttttacctcttcggagattcgaaatttaccgcatttcatccaagtcaagtcacggtacagaaactcattgccagcaggtaaaaagacctcacttgatgttagataccttttccctcttcggaaattccaaattttccgcattcttccatgtcacgttcatgcatctcattcccagcatgtaaaaagaactcacttgatgtttgaggtcctttccctcttcgaaggttccgaattgcccgcatttcttccatgtcacattcatgcaaccaattcacgttgcatgtaacatcttccccttgttgaggggaagacgctgatgcaggcccttcctgttgcgaggacgctgccatgacttagaagaaagaggcacgagtcgccggacaaagaaaaactcgccggaacggagagaagagaggcaaagctaggtcgaggctgaaaaacctttttcaccgggttttatcagcaacggtgaaagccctaaaatagccgcaagaaaaccctaacgtgagggatttttcggaatgttacgggtgcagcgcgatagcggcgttacacaccgcgattccggcgacgctgaatcgcgccgggaacgacgctgtagcgacgctattgagaagagtgtagaacaagaaataagaaagggaagtttacaagtgctggaaaattaccaggaagtcatggtcgatgggaggaggagaaaggtcgaaaggtgaggactgggcacaaattgaccaagacattagcttcttcttcttctccttcacgagatggtggtgggaccaaaacgcaacgtttcggggcaacacagagagacgccatgttaatgcttggtttggaggatggttccaccaagttgcagctgctgccaccggcaccaccgttgttgtcattttggattagataatggacaacagaacagagtctctctgtctctctctctctctctctcccccacaaacactactctgttcgggatttttattcttggaacccgtgcacggttttttttagtaaaaaaaaaaaaacgagcgagagatacaaaacaataatataaaatgtttaaatctatagagtaataaaactacattttcctaacctacttcttgcttctccttacttcgcaggttcggttccttacctgcttcttgcttctccttgcttcgcaggttcggttctgcttctctttgtttcggtctcacttttcccagcttcggtccactaccatacctcagcttcgttattttttcttctacaccagcattccaaacctttttttttatttcaaaactgcctctcctctctctcctctgctctgtgctctctctccctccctctgctctgtgggtctctctccctccctctgctcgtggctctctctccctctgctccgtagctctctctccctcgctctgctcggtgccgctctctctccctctgctccgtgcctctctctccctctgctccgtcgctctctccccctttgctccgtcttctcctctcttttctactctttcattctctctcttttccttctccgttccttcctcagcttcttcctttcctttcctcacacggtgctcagctattcctttccttttcagctttttccaaaactcccgcttctcacaagtatcagtgtttctcttctacccatctcctctgtaaatagcaagattatttttctgtttcaacattttttggggtttttgttattcttttgcaatttagaaactgattgatgttgaaacctgcaggtgcatgttgttcttctgcttcactttatggagcatgttcacgtaagcaggtaataacctttggtatttaatttctaaattttagatatttcattggttctactgactcactcctatcatgcttcattggtttttgtggattattttggtaagatttatttgctctctaatattgaaaaaatgaaaaatgcttggtgttgtgtgctgaaatgaacagtcagtttttctttctcgaggaagttctgatgagcagtgacagtgggaatctcacttattagcaagaattgcatttacacaaaaagattttgataaagaatttttccgatgatttttatttttactttttttctgtttacctggaaacactttttggtcttaggttgtgttgaataaaagaaatatgttttctttttcggtttagtgatgaaacaaataaaacatgactactaaagtccatattggagtgcacaaaacaaatcatagttgcatagcttaagtccttaagtcctcacttggttgaaaagcatgttcattgttgcccagtttcatccccaattctttctactaatcaaaacaatgatactaaaggtttagacttttcattcaatgtgaattagaaaatgtaggctgttgttctgagtggagaaaaatttgtttctaattggttttatattcggtgtgaatgacttctataatactatgagaattaggtactgagttgtacctaaatcttttggtttgcttcttctataatactctttgggttccacactctcaaacctctataatattaaggttggttataatactattagaattagatactgagttataagacaaatgatcactaactttacacattgtcttaatattgttatttaaatttatatatagttgatatattataattttatatatagctgatatattattaaaaactcaagaagattttacctctttcactacatttatccagaggtatgattatacatttatacttgctttgaaggtgtgtcttggttatatgcttttgcaattgttctagcacttagccttcaaatgtatggttgctgtgtcatccagaggtatgattatacattttacccttttagctgatatgtatatgtttgaccctctgtaattttctgaatgtcttataatttttcttttgctctttcaattatgtatccctctttacaagactatttgatgctgctgtggctgtttgccaagattttctgcaggttgcattctggagagcaataaatggctttggcttggcaattgtcattccagcactccagtctttcatcgctgatagctacaagcctacaaggatgaagtgagaggagctgggctttatctacttccgcattatggcctatttattgaataaagctagattagtaattcatcttcaaacctctttacgttaaataaagtgatatctgttttaatgaaatcttgggaaattaatttttatattattttcgcttcatttaatttggattttatacaaatgaaatcccactttttttttccttgcaaatgtcttaatgttcggaaggacttacttcccagtgaccatatttaggtatgttctttgacagggattttggtggttccaaattccaattctttttaaatttcaaatcccatattgaatgcaaagctgatattttctttatccatggtcagatagatgcaaacttacttcatctagcaagagtggcaatgcttgattgcagtcaacataaaaagttggatgtttctagagctaaagctgagcttgatatggcaaagaatcatttgtataattccataaggttcggattagtttggcactccagtctttcacaactacttctgaatatcagaactcaatcaatttgtcatgtttgtttcttttttcagtggaaatcattctttcttattacaatgcagtttttatcagagttatttctctgtccatgacatgtggacaggtggaatttgatgtcatacatacaattgttcaatcttatcatgtacaacatttagattgggttggttcacttaaggaaaggataaaaaacatatttacttagttatgaaatagattgattttattattccttttttaacatgattcatattaatgaatcaaaaaacattaattatttctctctactctctgctaagattggatttgtattagtttttaaatttgttatttatttatttttaggaaaatttcacatctgtttatgttgaagttgaaggtatcataatatctcccatggttttgctgtttcggaaaagtttattttttagcttggtttgtgattttttgtttttccatttttgtttgcttatggcattgtttttccattttttaaatctaatgtttaatgggttagatttataatttgttaataaaaactgagtgtagaaatggattcattctccttcattctccattttattgttgtcaagtaagaaaaactatagcaatccattatttacttctcagcaataattatttctttttttatgcttattatttctttcaagatatagcaatccattatttcgagatatagcaatgttgcaaaattagcaaaattatacttatcaacaatataattatttacttctcttttttgctgtatttttgtgctgttagctttccttcacactgcatatttttttcaactctcacaggtgttttcttgagttgctaaagagaagcaagaattatattgtaatagagctatttttctctcttatttctcactttcaacttttttcttgagtggtctttttctcttcttcatatgttagaaaaataaagttcaaatctaatcccatgtgttttttaatttcacacaaatatgtagcaacttattgggtgaatatgcagtgtttgacaaaatgcctcacccaaatttatattgttctgtttataatctttattatatattccatttcattttgtggtatgttactttcaccacctgagaggtatgttgtaaggaaaagacaaagactttgctctaaaatggtacaattgtatattccattttgtaataatttgtattcttcatgctacatattctccttcaccttacacctaatctctccttcactccctaaaaacaacatataattaaatatatcagcttattaagttgtgggctatcattacatataactgcaggtattattttgtttctcttcctcagttttatttttccacatacatgcttggcacttcagaactatctttttagttgctgatagtttattgagttgaatgtagaccagaactggattcttatgaaaggatatttatgcattggtaaggcatttataatttattccaaaatatttcctttatattttaatcttttctttatatttttcactattttttttcatcatggaataggaatctgtaatttgcttttacattagtggttgtggttaattgtagttttcgctttgctgtgattttttgttcctttttttccatttttgaatcagcttttttttttcctattttgatagcactctgcacaccagctagataaatctttttaataccttatcatctctctaaaaatagaactgcatagaggacttagaataacatggtttaaagtaaatcatagattatcaactgcatacattatatttataataattattatgaactgcatacattatatgcttaacattatgagctccacatattggattatatttattcattaaaagaagctaaaagaagaaaaagagaaaaacttttaattagaaatatattttatttttaactgatatatagcctcattcaattctccaacctctttacttgaagctcttttgtttttattctattgtttcagctctccatcaaggttaacttaactaattaacacaatttattttgttaaattatattctaatatcttgagttattatgttaggtatgggcaacataagtctgtgagcaaaagcaaagaacttgcaacattcaggtttttctctcatttatatggatgcccaagcttctatttctgtagcatattagtttgaattctaaatagataatggctaggatgagtgtggaccctaattttggaattgggattttggtcttctgaaacaaatttaagtggttggctttagtttgtgagcactaaaggaataattgccccacatgttagaaatataatatatagaaatcattcatgtgtcttcatctaacaaagcttttgagatagttaattctgattcataagattgtatcaaaaccttcatgaccaagagctctagagttcaattcttgcttcctttattcttctaataaaataattctaattcagctcaaagtaggtgggactatgcaattatacattttccatgcttcaaggatgaaagggctccttatttttaactctttttatttaattcaattgttatgataatcagcataataatgtttagttaatatatttattagaaaataatagtttgattcttagttataagacaatcaaagttaattaagttaaattagtttatcaataatatcataataaatattttttggttataataaacataaaaattaaaattactttataaaaatgatttttgttataagaaagttttaaattacttactcaccatatcataatataaattatttttgatttcatatttttatgtagaaactataattatcatttatgagaaatgattattctttgagccatcacgagcaaatttttacacaaaaaaagtttttgttaaaaattatttaacacaattacatatcaaacaatcaacaatattaaataatatataatttgagataaagtaatttaaactcctgtatccactttctctaaaggattgtaacccaactataacaaaaatataatcacattatccaaatatatttttttttttaaaaaaagaactccaagttgtggttttgtttgttttttaaatttcatttttaaatgatagaaactacaattatcatttatcggaaataattattctctagaaaatttaattaagatttgaaatttttaaactctttatttagttcaattattacgataacaagtagagtaacaattaattaatatatttattagaaaaataatagtttgattatttattataagataatcaaaatgaattaatttaaattattttatcaataacatcataaataatttttttgttataatacatataaatattaaaattaattttaaaaaatatagcggagcggagcagagcagagctacccgtgcatatgcgcatacaataatttagcaatttatcttttacttttaatttttaagtttgcttatacaataatttttaatcattaaacattaaatattaaaacattgctaaatttatcttttacttttaatttttaagtttactttatcaataatatcataaattatttttataattataacacatataaatattaaaatttattttaaaaaatataacggcgcagagctacccttgcgatacatcagtgcttattgattccattcctcaaacaatgcaatgaaacactctctatttcttagtggagtccttacttttttattagctgatatatttagcaatttatgttttatgttttatattttatttttaagtttgcttatacaatataattcttaatcattaaacattaaaaatattttatacaaatctaacatagcacggcggagcgaagcggagccgtcccgtgcgtatgcgcacgggtcctaagactagttttatataatatgtagataaggtgtcgggaatgcagtaatacattttattaccattttttgtgattttttttaaaattattatgagaaaatacatccgattacaaactaataatacattataatacttgtttaatgtcttttttattattatgaaaaaaatcaattacggactaatatgtgaatatataattattaaactcatttattattaacatgttggctaaaaagaaagattaagatgtcatgctaatgcttgattttaaggagggttcaaccaggttgctagtaccatttttgtcattttggattagataattaataataggctatctcaaacatgcacgttattctgctctgcacggtggacaatccaattttaatataaaataataataaatacaaaacaaaaaaaaaggtaagtgcatgaggtagagaaatttgaccaaatgaattgcacaaaaaggacgcaaaaaaagttgtttgaacattttgatttttttaggaaataattgaacatttgataattaataaaatatattaaattaaattaaatagaatcaagcgcaataaataaaaatcaaatagaatgatacattacgcatagcaaatttcattcaattagaggcataatcacatatagagcaaaccatcacaggaaacaacacattgattcaactattgggctaatagaagaaacagggtgaacagaataggcactacacaattctgcagcaagatgttgatgtgattgaggcataaccactgcaaaaattctccagattttttatgctaacatgtagtcaactaaactatgcactctagttgggtcaaataaataaataaacactctagtataatttgatttttggtagtagtctatacatgattaaaccggatcagacatgccaaatccacctccttcagtggccccgagtcttctttgctcagattcaatcacgcgtgcaatcgggttcgcatagttgtgaaactgcgacaattcacacccaaaaattcaactatttctctattataacaataagcaaaacacgcatcatcatgcaatatttacaaccaacattataacgctaagagcaaggattgaagcaagtccatcaaaaaaattaaaacaataaacttaaaagtagagttcaagcgaaagttgtattggctaactttagaaacttttaaattttaatttttctttcatggaggaagtatgggtgcaatttaaagatttttaaaccaagcatgttgattagatcacgcaggtttcaagaataggataaatggccatttaccgcttcaactagctcttcacatttgcgcactaacagtgccactttaacagctccagcttcttttactgttataattttactacttatggcatcgacctgtcatttttgaagataagaaataacaatttattctttcaccaaatataattgatatatcatgaaacttaaggaatgccacctcagataaaacagcctcgacatttctctgccttgtttctgtaacagatctcttagattcaacatctgattttgtactacttaagtatttagttgcttcttcccgcataatattgcactctttctccaattgcttccatgattcttccatctgctcaactaaggagaaacaagtcgaaaaagttggaggtaaaacatgctagtaacaaatattcatgcttaaagagcagttatatgtggcatgaaagtttccaacaaaaatcattaaaaaaataatgtggcgtacaaatgtgctggttttcaatcaccaaatgctgttaaaaaggaaaacaaaattattggacaaaaatcatgcaggttacttgtgaacaggttttacagaatgtgtttcgtaaaaattatcattactcattcttaaaccatgtagccagaaatggagacacagcaaggcttgcacaagaacatacctttgctctgtttttcaaccaatttggcctcaagtgacttctccaatatttcttcatcactaagtttagccttcaatgctttaagatccttttcaatagatttagcagaatttacctatagaaggcacaactgacatcaaacaaggtttgcacggtaataatctttgaagtaatgtgaagaagtgcttcttgcacatgagtctcaattgagaaatttcacaagaaaaatgttgtttccattgatgttgcaacaacatcctctgctcctctgatttctaatttggacactgctcaagttaatttgaacactgcttaagctaattttgtgcaacagaataagaattctatttctaatcagagtcagtccacaaactactcaaacttaaacatatctgaaagtaaatctgagagaactaaattgaggtgaaagagtattgtattcaacccaaagagaaactgagtccaatacagtttatataacagttacagatatgtaactgtcaactaacttgagtgtcagtcaatttgccaaagataactctgtatattttgaatttcatcctaatgtttgcttggtgaaatctcaggtctccaattctcaaaggaaatctaggttctgatgaactgtacaaatttcccagtttgctgtcaagttcttcatctactgtcaagacaggctctcctaggcctacttctatttttcctaattctgttgtaaattctgtctctgtaaaatccattaattcaagcgcttggcactctaggttaggccattctagtgttgatgttcagaaaattgcaatccaactttgtaagattccatttatcaataaaactgagcttgactttttgttgttcatgctctctaggtaaagctcacagattacactctccctcttctctcacaacttataatcaacctcttgaactaattttcagtgacctttgggaaccagctccctttgtttcctatacagggtatagctattatgctacttttgttgatgcctatactaggtatacctggatttttctgcttaaaacaaagtctgaaacactatatgttttcaaaaagtttcaagctatggctgaaaggcaatcaagtctacctattaaagctgtccaaacagactggggggagagttcagaccttttactgcctttttacagcaattaggtgtaactcatagggttatttgccctcatactcatcatcaaaatggtgtggtagagagaaaacatagacacatagttgagcttggtctcactcttttagctcaagctcttcttcctcttacctactgggatcatgcattcttaaccagtgtttatcttatcaatagacttcccacctcttcccttaattttgatataccctttgtcaaattatataaacagcaacctgattttcactttcttagagtgtttggatgtgcctgttttcctctcttaagaccttacaacaaaaacaagtttcagtttaggtcccaagaatgtgcttttctagggtattcacctggacacaaaggatgcaagtatctttcctcagatggcagaatttacatctctaaggatattgtttttaatgaatctaaatttccctatcctaacctattttcatcttctacttcttcacactcttctttagagtctcatgttcctatcaccactatccctcttgtgtctgtacctcccacacaattacataactcttcctctgttgcttctccagccagtacctcacaaatttcaacttcttctctacctcaaaattctgtctctcactcacagtcatgtcaacctgcccctcccctttcagttgacactcacccaaagcttgacactcaaccagagtctcaatcgtctactgctattcatgtagatgagtctcaatcatatactgctgtaccctgcagatttttctgttcccagttctgacatacagcaactaccactcattccctctattcctcaaaatactcacccaatgcaaaccagatccaagtctggaattgtgcaacacagaattcatcctactcttcttcttgctcacatggaacctaagtctaccaaacaagccttggctgatcctacatggctagctgccatgaaagctgaatatgatgcattgattaagaatggtacttggtcacttgtttctttgcctcctaacagagttcctattggctgtaagtgggttttcaggattacaaaaatccagatggatcggtaaacaagtacaaggccagattggtagctaagggatttcgtcagcaatatggaacagattatactgaaactttctcacctgtcatcaagcccatcacagtgagacttctcctctccttggctgccacctatggttggcctcttcaacagttagatatgaataatgcttttcttaatgccattcttgaggaggtgtatatgcagcaacctccaggttttgaatcttccaccaaatccatgttgtgcaagcttcagaaggcaatctatggtctcaaacaggctcctagggcctggtttgataaactaaaggagattctactgaagtttgagttcaaatccagcaagtgtgacccttcactctttgtttattccaagggatcatccacaatctacatgctagtatatgttgacatcataataacagggaatgatactcctttattacaacaactcattctaagctaaatacagtattttctctcaaagaccttggattacttcttaggaattgaagtaaagcatctatcagatgactctattgctctaactcagcaaatatattagagacttactggccagaaccaacatgtcaaatgtcaaacccatctcttcccctatggtaactggttgtaaactcactaagtgtggttctgatcctctttatgattgttatatgtataggacagttgtaggagcacttcaatatgctactataactagaccagaaataagtttctctgcaaacaaggtctgcctgtcaattcatgaaggagccccttgaacatcactgggtggcagttaaaaggatcccaaggtatattaaaggcactctctcatgtggtcttcatctaaaacatgcttctgccccttttttcatcaatgccttttttgatgcagattggacctatgatcctgatgacaggaggtccacatctggtgcttgtgtttactttggatctaatctaatctcctggtggtcaaagaaacagtcagttgaggctaggtccagcacagaagcagagtacaagagcttggccttggtcactgcaaaggtgtcttggcttcagtctcttctaactgaacttgctgtcccacacaagcttcctgccatccattgtgacaacacaagcactgtatctcttgctcataatccggttcttcatgctcataccaaacacagagttagacttattttttcaagaaaaggttctgtacaagctgctgtgagtggtttatgtgcctgctataagtcagtatgctgacattcttaccaaggctttatctttggggggggggggggggggggggggtattagagtttcttactccactaagtaaaatgtatcggttttttacttggtggaaattgtcaactgcaatctgttagtttgttagatgttactaactataggttctgttgacatggacctttgtaacttggcttgatatttttctaatcaatttctatcagttttacaatttctcaatttctatcagtccataatagatttcatatctctaactctaagacagcattccaattatgagttccatccaaaaaatttataaaaaaaaaaaaaaaacttcttgccacagtatacatggtgaattgatagtaaattttcaatcattatgataaacaccagagcagatgtcaactaacaagagtatgttaatacctgttcttgtatatcctgcatcagcttgtagtgttttgacattttcttgtacacctaagaaaagataaaagataaaaagatctaaattcaagaacaaaacatcatgaatttatccatgagttacagctgtttacattgtagctttccttctgaaataatgagtaaaaaaatgtccagaaaatcagtgcataaattattcaagtattgtagatatgacagaatgaacccacagtatgcatatcaaattcaatcagtcaatccacattggcatttgatcttccagtcaatattcaagggacgatttggcttgcataagcccaatccagcttcagcaccaactaattgacaactcagttgatacatgtgccataagactcactagctcaaggcttcacaaaatttgaatttatgatgcaaattgcaattgcatcctaaagtaaatctcgatggaatatttggttggaagaaaacaaaatagagtgaaagtaaatacaaataactacatattttcttttgtttgattagagagagaaagtgagaagaaaagaagttcaaaaacaaaaattcaaaacttccattttccttttaatttcaattcaaaatctccaatggaaaatttgtgtatatgtgtgatgatataagatcactttaccatgaccaaaaaggataaaatgcagatgaaagggggataaaaaagacccagtctttgacaatgtaccttggaaaaaacttcaacaagggcagtcttctcatgaaaagcttgcattgctaatctttcagcattccttgcctcctcacgagctaatttcttttcctctaaagccctcttcatggaaaatcagagataaaatttacataagtactggcagagaaaaatgagccaatgttttttccaaaactagtatcaggtcaagttgtggaactaacagaaggaagatagtccaataatctccaatataatattcacacaagcagattgtttggagagaaatgcaaagtatgccacatttttgtagctaaaaacataaataaaaccaattaactttgattatgcctacaacataagagcaaataaacaacataaatgaattgggattgctagctacaagggagaaccacataaaagaggggaaaaaatacctgtactttatcaggtgattgaccgatttttgaacgtagatttgcattttcttggacattttgtaccaatgtaaattcagcatttgaaatctgggatacgaaaaggaaaatagaatgaataagaattcacataatccatgcatcaaggagtcaaattttcagaaggaaagggaattgatgttagttagtagacaaagaaaggaatctcaatctccaaactaaaaacagcgctaacaacagtcagaccacaatgtaatatgcacaagaataaagacctactcatcaaaaccaaagccatgtccagtgtctacacaaatgaggaaacactaatatccaacaaaatataattaatctgattaaacataaatttccaattgtcacagcagaaaacgaacaccatgtcaatccattattggcgaaagacaatcactgaccttctcatccgtttccccggtcttctccttcaacttcctcaaagtacttcttagagaactctggttgctgttcagcaccgcaatcatttgcttgagctctttaactttggcctccacctcctcaacaagaggcatctccttctccttcgcctcattgcattccgaaatctccgctttcaactaaactcagcaaaacacacgctcagttaaaacctcaacgagtttgaaattgagattgagatgagatcccaatacaaacctgcaaaatcctattctcctccaactccgttcgctgcgcctctagagcgttcacttcctccacaatttccgagacggagttcattctcgcgtccctgagataaaaaataaaaaataaaaacgattaggttttctcccagcgaggcaataattaatccaagaggttaaaagagagtgacctatcgagacaaaaattgagaagagagccaaggaagagatcggttcggtgaggatccggcatgagaagatcggcgagggtgaatttgcgcggacactcgagtgttgtgagaacctcgttgatctggttgtagagtttcacggcgcgaacggaatccacgtggaaatcagggttttcaagatgctctagagcgtggaactcgagttgctcgttgtcttccctgcggaaaatgaaaagaataagaatctgagcgaggaatgtagaatcgaagaaggtgcgaaaagagaagaaaatagaaagagagagagactcaaggagaatgtcgagatgaatgaggacgcgagtgtagagatcggagatgaaatcagggttagggttggtgaagtcctgctccgtcacgttcgcgatctgcaactgcgctaagattgtgactatttccggccgccggagccttgggtactcgtaattcgactccgccattttcttcttctccaaagtcaaaacgcaacctctactcgagagaattcgggcttcgactcatacgagacgagactataagtacaaccgcgaaattgaattaaattgaaaacaaaattagtggccattttcccgcccagtactttcccatggaggctgattcaacaagttctcccaaaattacaaggaaaatactaaaattggattattgcaaaatataggggaaattgtatttagccttatgctttttttaagaggtaaaataccactctttttattctttgaatgagataaattaacatattgtatgatccataaaattaagtgttttttcaataaaaatgaatttatttcattttattcataataagagatgcaatatatgttagaatgtaatcaaagatattaatgttaatataggatcttgttgaattggcaagaaagttgataagatgatttgaatcattttaatgttttgaataggttaattattttaatatttgtcatatctcatggtttaaaattgtcctattatttctaataaaaatcttttgttttgttagagaaaaaaagtaaataaaaatccaacacatacaattttttataacatcataataatgtgtaagtcgttaatatttcatgcatactgattttataattatataataaattttcacacttttttatatgaaataggctaatgggacaagttgagcttatataaaggcaaagtttagacctaaaaataagctgatgacaagtagcatattcaaactttggacataaaaatataaagtaggtaatatccaacttaagtagaccctgactcggctcaacccttgcctccttaccagactaaccagatagtttgaaaaataagaaagcctatatttacaagctgaaataatggtgtcaatttcagtgctggatggaacgtcgttgttgaaaagcatccatgacggtctcgcaatctaagtcaatctcaatgccagtgactccaaagtctgataggtaactaattgtctacatgaaaccaatatccttcaccttttgagctgggagaactccattgcacagataaatttgaatattgggccataactcagtagccaaacaaacactaataagtaataacattagggcatccaaagaaaacgtgtcagtcgttttcaacacttgattcgcaattaggacaaatattcgggcaagagacacccttcgcgaaggtagacaaccccgaagaattctccatagaatatgtttgattttaggaggaatattcaaacgccacaattgtatccaattactaggaagtttcaaatttctggtatccatagttacctccatgatgttgtggtatgcggatttgacctgtaaaatctagtttgactcaagtttcaaataagcttgtcattttttagtataaaattaagttaaacaacattaatattagaataaatttatgtgtggagtttttaaatctatgtgacattataggattcataaaattaaaataagcaaccctatttaaacaaatatgtactgtggaagcacttaaaagtttatcttaaatgagagaattttagtatttctctaattagaaaagtgatacctgttttctcttctcatcagaaagaaagtatccaaattaattctctcggttttgatgtctcggccaggtcgttgatgcacctaaatccccttattgttgagttcaattcgttgcttgttcatagtttctttctttgattagttatcttcaaatacaaagacggattgagggaagtcctcgttatattttttctccactagttcacaggtaaatacatggcttactatgaatttgtaactacatgttctgatatttaatttgttgtaagataaacagataataattatatatatatatatatgggtgtgtgtatgcgcgggtccactttttgagtgcaagagtagtcttaaatcttaattatagctttggacgtactagatatgaaatttctaatattgattaatgattagattaattgcatgatacagaaagttaagaagcataagttaagttccgtaagtttagctaagggaactaaccatgtatctgcctagctttgagattatcaacctagcaatactagtataacttttcgtttttgtagactcacaagacatgaaagttataattttatgatgtacatgtaatcaaaccggctaaatatatacgttctcatgaatgcctaattttatttcaataagtgtttaaatatctatcacttctgtaaattaatttttgtgttggagtggtttatttagcattacaatttctttaaaacaagtgacactactaatgctttatgatcatgagcaaagggaagattaaatcagtggagttggacttaacaccgaagacaacagaagcattgtttgagggagatggtggaggttactacacttggtcaagttctgaagtgccaatcctggctaagaataatgttggtgcaggtcgccttgtgcttcagcctcgtggcttcgcccttcctcattatacagattcatccaaaattggttatgtcattcaaggtcagacccgcgcgtagatatcatcatatcttttctattttttaattttaatttcccctcccatttctattacaagttatacatacgagtttaatttaatattcacacacttatgagttatgacataccaacgagtggttggtttgaataaaattaggcttagaatttttaattaagattttattttcgaacatatatagacgaaaaatatgtaattaacaaaaaagatctcattaaaaacaacagtcaattaaattacaaaaatatcattattgttgtgaattagtttaattttttttccttttttaattagtgacatccataatataatggtattatgcattgaatcgtacgtgtaataaacttaaatgactcgtggtgttagttttcttagaactttggtgatcatcactgtctcctattaaatttctcaattttatggcacacatgcatgcagggactgatggcgtagttggaattgggatggtactccccaacactaaagaagaggtggttttgaagcttaagaagggagattttataccagtgcctattggagctgtctcgtggtggttcaacgatggagactctgatctcatgcatcattgcttttcttggagaaacttcaaaggctcttgttcctgtccaattcacctatttctttctaactggggctctaggacttataggaggcttctccaatgagctcacaagcaaagtatatggtttggacaatgaggtggaaaagctcataaagccaaacttggggttttgatcatcaaactagacataagtcaacccatgccttaagccacaaatgaacatgaacaaaaagctactctataatatagatgctgcacgcccagaaaatgttgtggaaaatgctggattagtcaaaaccttaacggagaaagattttccttttattggggatgttgggttaagtgtgattagagtgaaacttgaaccggtagcaccctcatacccaaccaaccttacggttcagttgatttacattgccagaggagaggtggcaagattgaaattgtggactttagtggaaagagtgtattaaacactcaagttgaggctggtcatttgcttgtcgtgccacaattctttgatgttgctgaaattgcgtgtgaagaaggaattgagagttactccatcgtaataactataaagtatgacttaatttatacaaaatatattcatttaatccaagaagtagcacatggcatgcaatgacattaaaaatgattgattatattactttaaaatatgacatagtataattaagtgttaacaaaattaacaaaaaaatgattgattatcttatttacaggccattgtttgaagaattggctggaaggggatcaatttggaacgccttttcgcctacactgcaacaagtgtctcttaacgtggattctgattttcaaaagtttttcatatccaagatcaaggaatctaccaatctcatccctcctactgtttagttcgatgcgtgtgatgtacgtactaccgtatttgtttatgtataattttcagatgatgatattgatgtaagataattctgaacttatctttctaaaagttatgtcgttgtattgcttttgttttaaagaaaacattttcgtgagaatacttatttaagttttctatattgagcaataaatgaatggaaggatttgaatgctagtctataatatagacgctgcacgtgcacaaaatgttgtggaaaatgctggattagtcaaaaccttaacggagaaagattttccttttattggggatgttgggttaagtgtgattagagtgaaacttgaaccgggtgctattaaggcaccattataccctacgaacactgcagttcagttaatttacattgctagaggaagtagcaagattgaaattgtgggcttgaatggaaaacgtgtattagacactcaagttattaaggctggtgatttacttgttgtgccacaattttttgtggttacccaaattgcaggagatgaagaaggaatggaaagttactccattgtcacaactactaagtaagctgttgggattttatataaaataatttttatagcatgcaataacattaaaaatggttgattatatattatttgagagtatgtcccagtatgattaattagtactactaacaaaaatgtttgattatattatttgtaggcctttgtttgaagagttggctggaaaggcatcaatttggggtgtgttgtcatctactgttcaacaagtggctcttaacgtggattcagaatttcaagagttgttcgtatccaagatcaagaaatcctctaatctcatgccacccacgtcctactagttagtctgacacatgagatgatgcatgcgtgtgaatgtatttgttttgtaaaattcagatgatgttatacatatgagaaaatactaaatttatctttctacgtgaaaattcttagtttgatgttgattcaagagacagggatggagaagaagtcgatgtgtatgtcattgtattgcttttgttttcaatttaaaggatatactttggtagcagtaaaattctttatatatgttctgttatgaacgaaaagtattcatgaagctagtgattataattaaaatgtttacatgtatggtcttacattgcatagtggattagagtgtagaattgattttgagttaaatatttttagataatttttatgctaaagataaaaatttatattgaatttttcaataataaaattaaaagtattaacgtacaaatcacttcatttcaaaattttaatcaatttcttcaaaatcagtctagacttctcacacaaattaaaatgaattcatccacttcatcttttgaagaatttattgagaaagtttatataaaagtaaaaggcataaattttattttaatttatagagaaatttaatttatttttttcttttcttatacgtttcatgttagataagcttctttaatttatgaaacacttatttggaagaaaaaaaataagaaaataaaatatatttaacttctctatatataagcttaattaactattttaggaaccttagctttttagaaaaatcaaatgaaaataatttttataaaaagtaaatagtacataattaatttaaacttatataaattacaattcatttattttgtatttttttctcttataattatttatgaaaaaatttattcatataaaacttaatttcttataaataatttcatctaaacaatatacataacttatatgtttcaatgtaataaaatttaaggttcaaaactcatatttgataaggacatgcggaaagtgcttcttagaatagacataacatatatgtttctcatttccttttattataataaaaaatttaaatatttataatttacttgattaaaacatattactacttaaaaaaatttgtattctactacggtgaaataatgacagttttccaagaaccatcttaaattcgattacgacttcaatgatgacaaatttacaaaaatcatcttaaaaagctgcgttccataatgattttttgtaaaaccgtcgtggtttcatttctcttccagcaaaaacgaaaacgctcgccactcaatcactcaatcactcaaactcacaccagcgtatagagattagagagagaaccctaaaattcggctgccgcgatggacatgcatcgacgacgacaaagacctcaacctcgacctcggcgacattgatctcgacccgaccaacggaatcatgcccaaccacataagcaagttttgatttcatttcaacttcatctttcatcttcttcccctgtcaatctagccactctctctgaatttgacggttgtgccgcatagtctcatcagtttctcacttgctcgctcagtgactcgctcactcttcttcagatttgatcgaagaaagaaatagaggaagcactggaactgtcacgcgtgaaggacacgaaggagaggatggcaggtgtggagtgcctccaccaacttctagaagcttctagaaagagcctatcctcttctaaggtcacctcgctcgtcgacatatgcatggatctcctcaaggacaacaacttttgtgtcttccaaggcgcgctccaggccctcgcctctgccatcatcctcgccggcgaacacttcaagctccacttcaacgccctcctccttgccgtgggagtagcagagggtgttgaagtgtcgacaatgcactcagtttgtctctcaaacttagaattttgaaatataattaccttcaatggttttgtgagtatatctaagatctggtcttcattccaactcttaattatccatcattacttgatgtctcaagaaatgacatcgggtctctaatatatttactcctccgattgaatagttggatgctttgccaaattaattgcttatttgttgtctatccgtagcttcataggtcttattgtttccaaattcatctctcccaacaaagtttcaagcttggcagtaagacagtgccaccatatactactttttgaaacactaagaaatgtattatgtatccattgcatttgcagcacatgaaaatataacaagttgtattcttttgatcatcctaatctccacaccaaccaaagtccatacatccaatctttacacttctacactgcatctcatttgaaaacagcaacccgaaatcaatcgtccctttgatgtacctcagtatccgtttgtttgttgcatagtgagatgttcttggcttctccttaaatctacttatgaagccaactccatgccagagaatgatcacactgcattcatcacatcaacttcttttttatacatttttcatcacaagtcccacatcaaccaactaatggagttggttattgataactggtaaccactattaaaagtaggatcttggtaacctgtgacataaaaagccttaaagacgttgtgactttgtgaacacaaagtcaaggaaacagaggcttgcattaattgcaactattctaattcaataaaatgcatgttgcttctcatacaaagacaatcctccaccatcaaaagaagcaaaccagagttaacactgactaaataaaacaaaacacacatacatgcacgatccaccttaagaatactaacttcaatgttacattggcattttattacacaccactgcaaatttctttttcactggagacaattttgttccagtaagataggattataccttcgagtacttaacacatctgcataaccaaaaccaagacttaaaatcgagacctttgattaagttggaccaaccccacgccaattgatccacgtgctcggtggtacaccactgcgaatttcattcattcattggttgattcatcccattgatcctctcaattacagagataatcccttgcccgccaagcttcccctgcctattagccactgttctgtatagtttctagaacacaaatgtacagcacgaaagcgctgtatgattactgtttgatcactctaactccgcaactatgaagatatcgatggtgaacgatatcccacagttgatgatcactgagatacacgaaattggggtgaggtgtgtgctcagtgtaattgaaagagagagagagctagagtgtgtgtaccttttaagcgcctatacccgtgtatttataggcacattaccttgcggttagatactccaactgcacgcgcaatactccctatattcttggcctcaacctgcacgttcataactgctccagtagaccaagtcatagtccacattcattgaatctgttaacacacgtggtattaaaggaaattgggcttcgatattaggcccaactattattccataacagttgccccccagcccgagtatcaagttgccttgatggtcgggatgtattatgttaaccgcctccgaccatactaccaaactagtcgtctccgagcagaaaattaatctgaacagcttcatccgagcatcgaggtccaaataaaatcccgcgtttattataaatcggccaggagtcattccgagtaaccaagtaggatctccccagtatatttctttggataagtactcctggtcggttaatctaatactctagtttatcacatcaattatccgaacagggcaatccgagcaggaccttttatccgagctcttgactgatcgtactttgttgagtagggtttgtccgaataaaggcttattttgctattcctttaggtcgcacttgggtggaaaaagtaaatatccctcgagtggcgactggcctccttgctgtaggatcagttactattcccatcattaatggcagcttgggcattaaagacctgtcgtttcattccctttggtaatcattacgaccctagtgtttttactttcttgcccccaaatcaacacgtccttttaccgttctgtccttgcgtcgtttcgttttgtgagtggcggttcatcaggccgttttgttttccttggcggttactgtgggttattattgcatttcaaatttatcctttaatttctggacctccttttctttatattgtctgcattccttctttcctgagttttccccttttctctttcttcttttgaagctttcgcaaacttgcctcttcgtcatccctttcgatacaccgctattcttgctaccaggtacctttctttctttttgctatttttacttgtgcattctgttgcttgcatttctgtaagggtagtgttgctttattcttttccattcttggccgctgtcctttcctctgttcttgtatatcttcatgaaatttactcctgaggaagaggcggagttgcggcggagggcccctagggcctcgtggttgttgtggggtcttcccctccccgatggaatgagcgagaccgaccctttgcgtggtcataccggaggttcttccatctctaggccacctaaaacctccgccgtgactctcccttcagaccctttgttgccacctatccgccaccgcgagtctgactctcgcggtgttcctccaccttcttctatctcttcttctagaaatgactctattccgggtactagtcatcctagggctcctcccattttgggccccaggacatctgggcccacaaatgcaatcagcccaacaatctttcctttgaaggtctcttgtgatccacttgacaacctgtcgtcctcgtcttcggacgacactctttcatcatcctcggataaaatgatgactttttcatcgtcctcggatgaagtgatggaagttcggtacgatgcctgcattaactgtgtttctgatgccgtgtaccatactcagcatggttctgatgatatcgccgactccatcttgggattatgtcggcataaccccatcttctcatccgtcaaaaaacccaaccgaggccgtacaccaaatgcatggttccggtctcgggctcttctgcctttaatgcgtcatttccaggtatgtgtactaactctggttctctctttatattttggtaggtataatggacaattccgtggaggttgtggatgaatctctgtctgccgagtccgagtcgggcgcggttcctgcgttggcctccatatttcattgggttacctacgaaattcttagaaccttctccaccctcgaactatccactatagcctcactccccttaggtaaacaagacgggtttggggtccgggctccctactcgggtgagcccatttgtgcccatagagagggcaatgatcccaacttctttttcttctacgagggggtagtttctcaaatagggtgaccttccccttcacctcttttgagatggacgtattaaaccatctccgaatagccccttctcagcttcatccgaacagctgggatttgtgaggaccttcgaattattctgtgaagagcttcggatcccctgtacagttccactctttttttattattattacccgaacactcctaggacggggaaagaaccgcccgagcgtaagggatgggtcgccctgcggagtcagaataagcggaaattaattgttccgtttacagagtccttccggggatttaaagataaatattttaaagtcgcagccaatcccgggcagcgaccattttttctgcggggggatgagtctgctgacgtagagtggtcgtttcccttgtattggtcgcaagaccattatcaggataaagctaattataagttcatcgaagagtcattgtccgatgctgaagcctctgccatatctgtgatttcggagtatctcgacaccaagggccgccccatgcggccgtttatgtccgccgtgctcgcggcagttcctccgcttaccgtaattatagctctcgacgagttttgttcggtatgtatcttgaatgttatatctgatgtgtccttgtttatttcagtgaacatgggacaaccagctggttcagccgccaccgacccgaagccaaccgagcctgcaaataaagctccacaaaaagggcaaaagcgggtcctccctctttccgggcaatgttggagggagaaataaaagagctaaggttcagaaaaaatttgttgctcttagaccgtctactccaacggctgctcctcgggggatcccgtctgcagtcgtccccgtctctgctgcccgggaacgtgcttccccgtcgactgccgccttgcagaatgagcgagctgggtccttagccgcgacggggaatgtttggagaagggggtaaccgaggagctggtcaagcttaccaagcctcccagttatctcctcgaaccgggtgcccccgtgggagacgagctcgcggcattggttcgcgttgaagagaacgcttatcaatgcgcttctctagtacgggcctttgccactgttcggcacaggtaagtattcaccaacacttcatctgtattcttcatttttcaggttctaattgatttaatgtagatatggggtggcggtagaagagaaaaagaaatccgaccaagctctcatggccgcccggctgctcatggagaggacaaggaaaggtcttccgctgaaattaggaagttgaaggaggacctactctccgtgcaagccatagcggcgtcgctgcgagcagatctggggcgtgcccaaggtgacctcgaggcttctgatcagaagatagcgatgttatcctccaccatcgactctttgaaagccgagcacgaggaaaagctttcagaagtgaaggccgcccttgctgttgccgtcgaggactctttcaataacaccttagatcaagttaagtttttgaatcctgatgttaacctttgcacaaccgggatgcattacttagcttatgtagacgagggccgtttggttcccccatctggtgctgaagattcctcgatggtagccgccgaggaggcggtacacgtagatgaagcttcttctggtgctgcacccaccgtcctcgcgccgcctcctacagatcccgttcctgtcaccgaggatcatcctcaacaataaagggccgggatgccggtttaacttgtattttacttgtatttatttttctttgttgggcccggtgcccggaacaatttaatttcctttgttgggcctggtgcccggaacaattgtttaacttggtatatatttctattttcaagctctctacttgattcgtaaaatatcatgtgcgcacatctttttggttccaacgaccacatattcgaatgtattttttatttcgtatatatccgaccacaaacaactttgctaacgaggcctgatcagagccgggtagcatatcatttatagccgttatcacactttgaaatcgtcatgactcaaaacgtataataaaatgtttgcattgataatcgttgttacaataatatgtatgtccgagtaccgggtagggtcggatcgatactttagtcaacgatacaatttattcaatgataaacataatgtgctcggaaagcaatgtttccgagtgaacaatttcctaacaatgtcttcatcgtgaaaaaggaccgtatggactcggattactccgttccgagtccttaccctcgataacgaaatttcattgtcgagctgcctcgtacccctgatgaataaggaccatatgggttcggatacaacaatccggacccatacccctattaaaaaggaggtcgacgtcgttagctgtaatacttcttcaacttgtcagcattccatgttcgtttgaccgtcttgccttgtaatgtttccaacgtgtatgctcccttgtctagctttttagtgacccggtatgggccctcccagttagccgcgaattttccgtctcgggcattcttgtttccgatgtcggcacgtcgtagtaccagatcggtttcttcaaattcccgcgggaccacccttttattgtaggcgcgtgccatctgttgtttcagtttcagttctctgtcgtgcgctgctgcccggatctcctcaacgactgtcgactccaggctaatacttcattatttgtttcctccccggcttgcaatgtctgtctccgtcgccatgattgctgtccgacctcgacggggatcattgcttcgtttccgtatgtcatgcggaatggtgtctcccggttgatgattggaccgaagtccggatcccccatagacataatataattgttccacccaagtcgatccggcctcgtgcattcgtttccgtagggcctccagaattgttttgtttgcggcttcagcttggccgttggattgggggtgctcgacagatgcgaaccggtgtcggatttggaaattagccatcatctcctgaaatcctctgtcaatgaattgggttccgttgtcggtaattatttccccagggattccgaaacgggaaattatatttctttcgaaaaatttctgtactcgggccgacgtgattgtcgttgaggggctgcttcaatccacttggtataataatctacagccactatcagccacctcatctgtccttccgccggcttgaatggtcccaacagatccatgccccatttgtaaaatggccatggcgccgaaatggactgcaattcctccggcggggataaaatcctggtcgcgtgcatctggcagctttcacaagatctcacgtgatttgtggcgtccgcactcattgtcggccaaaataaccagcccgtaacgcctttctcgtcagtgcccggccccccatatgctgtccgttgattccttcgtggatctcggataggatatagtcgactcggtttgggccacgcataccaataaaggctatgtaacccccttcggtataattctccgtcgaccatagtgtacatggccgacgttcttgtcagacgcgggcttctatatcgtcgtctggcaagattcctctttccagaaaatttactatgggtcgcgccagtcctggtcggaggtaatcatcattacgcacgtcggctgcatcgtttgctgttgaattactgtgcggttgttcccgggctttttggtgctcgccaatttggacaggatatccgcccgagtattatcttctcgggggatgtgactcacagaaatgtcgtcgaactcggacatcaattcttttactcggctcaggtatttggccaacaaaggcccctttacctgataccgtccttcaatttgtgatgcgaccagtgggagtccgtgtagactttgacgttacgtgcctcctgctctttggcctgcacgagtccggcgatcaacgcctcgtactcggcctgattgttcgaagtcgggaaacctagttgtagggatatttccgtagccactccatctgggttctcgactataattccggctccacttcctttcttattggaggacccgtcgacgaacagggtccaccatcatccaccctcggattatgaggggtgagttctcggacgaagtctgccagcgcttgggacttgatcgcatgtcgagcctcgaatttcagatcgaactcggacagttggactgcccaatgggttagtcttctgccaagtccggtttgtgtagtacctgccggattggctggtctgtccgtacaacaacagtgtggctctgaaaatacggtcgtaactttttggcggcgacgattaaggcaaaaacaagtttttccaacttctggtacctcagctcggagtcgcgtaatgctcggctcacaaaatataccggcttctgtgtagtgtccacctctcttaccagggctgcgcttactgcttcttcgcctaccgacaaatacatgaccagcacttctcctgttttcggtcttgataatactggtggcgacgataacgatttcttcatgtcgatgaaggcggcctcacattccgggctccattctatgacggcctgcttcttcaacatcttgaagaatggcaatgccttttccgctgacttcggcataaatcgggtgagggcggctatccgacccgtcagttgctgaacctccttcttgttcgtcgggaactgcatgtccagtacagcgcgacacttatccgggttggcttctattccccggtgtgttagcatgaaacccaagaacttcccggctccgactccaaaggaacattttaacggattgaggcgtatgctgaatcgtcgtaatcggtcgaaagtttcttcgagatcctcgacgtgcttattgatatcttcagatttgacgatcatatcatcaatgtagacttctatatttcgtccgagctgtggttcgaacacgctgttcatcattctctgatacgtggcccctgcattcttgaggccaaacggcataacattgtaacaataattggccttgtcgccgatgaacgccgttttctcctggtcgtctgggtgcattgggatctgattgtatccggaaaatgcatccataaacgataatactctgtacccggatgaattatcaaccagctggtcgatattcggcatgggataggcgtccttcgggcacatcttgttcaaatccgtgtagtcggtgcataccctccattttccgttcggcttccgcaccatcacaacgttcgacaaccaagtggtatattgaacttcacgtatgaaacctgcccggagcagttcatcaatatgggcccgtaacgcctgtgccctctccggccccaatttacgttttttctgttccaccggcttcgatcccgggtacatggctagtcgatggctacagaaagctgggtcgacgccgggaatttctgatgccttccacgcgaatatgtcaatattcttcttcaggcaactgattagcctgtcccgtagctctggtcctaagtcccccccgatgttagtcacctggccggctgaatctccaattacgacctgttccactttctccacgggttctggccgccactcgtctggggcttctcgcatatcaagctctacgacattaacagaacgtactcggtttgatccgttgtcgtcaatatctttctcgcttctacggaccgtgtcgtagtaacactgccgcgactctttctggtcgccgcatatggtcaccacctgtttgttgttgcctacaaacttgagcttctggtgcttggtggacattaagatgtcccacctgtgaatggtcggtcttcccaatatcatgttgtactgggatggaaaatctgccacgacgaactccacttcttcggatttataagattctctcgttcctagtgttagacgcaggcggatggatcccatcacgcttgtgttgccgccattaaaaccaatgagcattgtcttgcaaggctttaagtcttttacgtccaacttcatcttacggaacgcagtcaacataataatgtcggcggaactcccattgtctacgtacattcgtcttacccgacagtttcccacggttgctgatatgaccaaaccatcttcgtgtccgggtactactccctccatatcctgctcggtaaagtataggagtggaggttctggctttccggcccgggctttgaatctaggttgtgcctggaccgacaatacttccttcaagtactttttccgttgagtggaggtgtcgccgccgccgcccatacctcccgagattacattgcattcaaattcgggctccgggaactcgtcattgtcttcccggggtttctttccttcttctcttcgttgactttcttctcctttgcgtttattttttcgcccctgtgttcggatgacatactgcttcagccttccttctcggataaacttttcaattgcgtcccgcaagtcccagcattgatcggtagtatgcccgggcccgttatggaactcacagaagcgtgacttatccagtccagccttgttgaacacagggcgagggcgttccactttcttcatttcagtgaatgcgacttccttccaaatttgtgaccgggacacgttcagtggagtgtacttctcatatttattctcgtatcttcctggccggggcttttgttcgtgattccgagtacgattctccgggtaacctctattttttgggggcggacttctcctatcatgtcgctcctttgttcgtccagggttgttgacaacctccatttgttctagctccaagtacttcttcgcgcgagcacggaattccatcaacgacttcaccgggtctttgtatatagacttggcgaatctcgacgaaccatcgagtccagctgatatcaaatacacatggactctttcctctaatccttcgacttgcagggctgcctctttaaacctatccaaatagctttgcaaggtctctccgggtagttgcctgactttccccagcgtgaactcggacttcggctgctttttgctggtcgcaaaattcaacaaaaacttctgtccgaagtcttcaaagtttttgatcgacctaggcggtagggtgtgaaaccacgtctgcgccgggcctgtcaatgtggtgacgaagatccgagaaatgatgggctcgtcaattccccggacgcacatctgcaaatcgaattcatcgatatgcacttgtggatcctgcgtcccgtcgtattttgatagaaaagatccatcaaagtcgtccaagtatcgagctttcacaatgtcgtcgacgaaagggctgttgttctgatgtccccgactgttcttccgacggtatatgggtcccgtcttttgatagaaagtctgttcgcccttcttgccatttccatcttcctgtagaactttttcaccattcattcgtcgactagggctgtcatcggggattcgtcccgtgccgacgtcatcacatgtctcatttcgtgcccggattgggctccgacctggctcatccgttctcctgtggtcttctgggtcggcgtcgcgtctctgagttatttgggtcctcaggtccagtggctgttctgtccgcctttggtcttccggatctgtactcctccgctggttcaaccgtgtcctcaaatcctgtgtctcgccctcaggattcgacgactgtgtgcggttgattaaggtttgtaattgctgctccaattgtgccattctctgcatctcggcacgtctccgttcttcattgtgttcctcgatttgacgagtgatgtttctgatgtcgtcttgtctctgtaaagtctgtcgcctctccatgttctcaattcgagtcaaaatcgaattgaggacattgccgactagctgtcctccgagctcaccctccggatacgttctccgtgtgactggagtcctctgctgatctgtttgggcgggcgaggaagcttcgtcggaaacggcttcagtcacgtgtacttcttctcttcgtgccacgttctgactctccggtaggaagatttccctattcggcatctcggagcgcggtacggaatggctgtttcttgtgttaaccattgttgcaaggtgtgggactcgaaatttatcgtccccacagacggcgccaatgttctgtatagtttctagaacacaaatgtacagcacgaaagcgctgtatgattactgtttgatcactctaactccgcaactacgaagatatcgatggtgaacgatatcccacagtagatgatcactgagatatacgaaattggggtggggtgtgtgctcagtgtaattgaaagagagagagagctagagtgtgtgtaccttttaagcgcctatacccgtgtatttataggcacattaccttgcggttagatactccaactgcaaacgcaatactccctatattcttggcctcaacctgcacgttcataactgctccagtagaccaagtcgtagtccacattcattgaatctgttaacacacgtggtattaaaggaaattgggcttcgatattaggcccaactattattccataacactctcaatagaaacaaattttcaatctagataaacattcagtgtgtaacttaaggctattagtaactacaatgattattatattgaccatttctcaaagcatctgggtgacataattaggaagtaattgcaatcaatttggtgattatcatgattgagactgcgagagcaaggaggggtgggagcaatgcatgcatatgaatgtaacttttaaggttatgttgttaatgtcctttttatttatataaaaaagatttggttagttgaatagaaagttcacaagagtcatgacacaatacttgaaaattaataacaatttttttatatattaataacaagatttaaacttgcatatatttataggatgagtcatgattttttatctaatgagcatatatcttacaagctaaaaaatatatcaaattatgttattggtaataaataattattaatgactaatttatgtcgaaaaaaaatttgtttgatcatttttagtaaggttgtttttttctaattagattttttttatttacaaatctcgaacttgagatcttaagaagactgagtcaaaaattatttggattaatgactttttaataaagattggattataatgcataagcacaaaacgtggactgcttattattgactgtaaacatgcatttaactactaataaatcataaatggtagtgaaatggagtggttaataacagagactatatgtgagctataatttgttagaagcttagctgattaccttcattctgttactggaattgtattcaccttccactttcatgttgtaagtacagttgtacacaaaattaatcaccgaatccaatacaatgacatcccatttctaatcctctgttaagagttatatgatatgtggtcacttttttcactatattttcttggataatacttttttcttttttacttaattggagcaatatataaatgatgaataactaatctttatttgattcatgttacctcctcaaatcttcttaatttctttttcttaaagtgtatgtaacagcaactgaactcacatggggagaagatcctgactcagaactcattgaccccacaccagatttctgtaataattctgtccctcaaccccttcactgcttcacagctcacagctaagagctaatgagctgttgcctgttggtgtgcctatacgtctgttactaaagtttcttgttataagtcaagcaaagtacaaagataaaaaattaatttccaaagcattcatccgcgtaatgataaaaaattaatttcaagtagaccatatcccccacttggaattcaacctcccttctgttcttattggcttgttgattcatttttttgaacttacactaaattctcgaggttttggagaaatgctataagcactgaacagaatagcagaaaaattgcccgtcccaattaaatttggacgcctgtcaactgactattaataaatttcaactttttaaaatgtttctaggtttaaagagaaaataattaagtaattatatgtagagaaaaattagaaaagtgttttataaaaagacaaataaaattttaaaaagagtcttataattaagagaaaaaagtattttaactaaattaaatacattacgatcatgttttgttttttttttttttaggtaaaaaaagaagatgctttaagcattgaatcaaaagtgtaacatttatttagtattggaattgattgatattcttaggtggaggaacttgtttatggagggtggtggcagataaggatctaaaaaccaactgtaatcgcaatagcatatttatttgataatggatgattctttcagaccgagattggtacaaaaatgcaaagtcaggcatcaactaatctcgttgcctacttttgggtttatgaggaaagacagcgaaccaagggatggaaacgcggcttgccattgatgagtacaaagggtaaatttcagaaaataatatttctttaatatatttaaattaactaatatttgattgacaggtttagcaatttcattggacaggccatatttatttgtatcaaagtttgatttgggaccaacacgccaatcatttattattataatccaataattattattataatccaactaagagtttctacgtcttcaccgttttttatttttgagtgatatgattgatttgtggagttggatccatgattaaagaagaataggtattagagtaatttttgtgagtattatttttactctttacatttttacaaactgaaaataaattaacaattaaaacttataaagtcatgtaagtttttttaaaaaaattacaacttttttaaatggtaattaaattttaaaaagctattaattttgttatcgttcattcataattgtatgactttttatttttttattctataatttaatatttatctttgatatgcacacagaaaggaaaatatagatttttcggttaagttgtttcgtgcaataattaacgttattttgatgggtccgcgactcggcataataatgtatgttttgtttggtattccgcgttcactttactcttgtcaccttcatattttaacgtgaatctggagacccaattaacaagcaatccacaatcatactaagttttcttctatatatataggaatttttattggaaaaaaaaagcataattctacttgaaatatgagatataagattgattgcatgattaaaaattatgaatttgatctctcctgttaataaaaattaagaaattaataattaatatttattgatataaaaaaattaccttttaagaactttaattaattggaaactcttataagattcatccactaaacaacttagaaagagagaagaaaaagagatatatccgcaatccacctaatataaagactctatgtccgcgtaacattgttgtctatcattcaaagtcaacccaccacccatccactcaaagttttatatagaatgacttttttaagtcatcattaaactttaagatattcttaattagatcattgattcgtagttatatgaatttttgtttttacttattattaattgtgcatgttttctataattttatatttacctatattattttattttcaggtaaacatacgttatttataaccattttttcaaacaatatactttggattgagtacagaggattctgactcgaaaaattaatatcccttattcaaaggatgttctaaaaaacactaatttcatcactggaaataactttatcaccaaaataatttcttaaacattcaatttcttttatcattcaaaaataaagtcaattttaatattttgatacaatatttataatgcaaatatatgtaatgataattaaatattactttaagaatacatgcatctactaataaaaaaattaaattcatctaactaagagtaaaacaacttattatatatttagatatgattaattttaggggcaaggatactttttaggataaaaaaatttaacaacaaatttgttgaagttcatgaataaaacttatcagcttattttttagttaacattcactagtatttttttttattgctaacaattaactttttggggggatgtaccattataaatagtcaattattttaaatatagtgccaattataaaaattgacaatatactttattaatttgtaatgattcattgcaaaaaaaaagtattttttgtaacacagtttattttatagaaattattgtgaaggaatctttctttatggttgtttgtgtggtgtagaacgtataccacgggttaggcacagtcaaaggttttcacttctaagaaagagagacgaaacagagagagattttccattaagttatatgtccatgtaaatgtaataatatatatgtttggtactgagtgtaattaacacttatcacgttcatatttattcaagtttgattttggagaattcacattcatactaagatttcttatcatggctttgggatcacgttcctcttcctgcaattacgatgtgttcctcagcttcagagggaaagacacacgtcatggttttactggccatctctacaaagctcttgatagcaagggaatccacactttcattgatgatagggagcttcaaggaggagaggaaataaaaccagcacttacgaaggcaattcaagagtctagagttgccatcactgtgctctctcaacactatgcttcttcctcgttttgtttagatgaacttgcaaccatccttcactgtgaccagaggaaacagtcgttggttatacctgtcttttataaggtggatccttctgatgtgagacaccagaaaggtagttatggagaagcattggcaaagcttgagaggaggttcccggagaagttgcaagaatggaagatggctctggagaaagtagctgacttgtctggctatcatttcaaagacgggtatacaaccatactaatctttttactttatagtttttgttggattaacttttacttgtctgattatttgacattaaatctaaagggaaaataaatgcttgttgaccttgacaatagacgtatcaagacttggatacatgcaaggtgatatgcatccagcatatggtcctttccaagcttctaaaagcctagaatcattgataaacaactcagaattgcacataattatgataattgttgatgattccattcctttcaagtgtcgtgctaatttgaaacttgttttgtttgaaacagagatgaatatgaatacaagtttattgagaagattgttgagcaggtctctggggtgattgatctttgtcgtcctttacctgttgccgattgcccagttggactaaagtcacgagtttcagatgtaaggaaacttttggatgctggatctgatgatggtgcccacatggtagggattcatggaatgggcgggataggaaaatcaacacttgctcgagctgtctataatgaattgataattgctgagaagtttgatggtttgtgttttcttgcaaatgtgagggaaaactcaaacaaacacgggttagaacacctccaaagaaaccttctttcagaaataattggagagaagaacatcaacttaacaagtaagcaacaagggatttcaatcatacagtctaggctcaggggaaagaaggttctcttgattctagatgatgttgacaaacacgagcaattacaagcaattgctggaagacctgattggtttggtctcggcagcaaaatcatcatcacaactcgggacaaacaattgctagcatctcatgaagttaataaaacatatgaggtggaggaattgaatgggaacaatgctcttcagttgcttacatggaaagctcttaaaaaggaaaaagctgatccaacttatgaaaagctcttgcatcttgcagtaacttatgcttctggccatccattggttttggaagtaataggttgtgacttgtttggaagaagtatagtagactgggaatctgtcatcaaacaacataaaagaattcccaagaacgaaattctagagagacttaaagtaagctttgatggtttggaggaagaacagaaaagtgtttttcttgacattgcttgttgtttcaaaggacgtgatttgcaagaggttgaacatatacttggttgtctttatggtgactgcatgaaacataatattggggtgttggttgaaaaatctctaataaaggggagttgggatggtgtagttaacatgcatgacttgattcaggacatgggcaggggaattgaccaacaagaatcgtcaaaagagccagggaagcgaaggagattatggttaacagaagatataattgaagttttagaagacaactcggtaagtgagagtatggtttcttatcttgatcttttttatttttgtctatcgtatctttatatcatagtcaagtttttcatgacaatttgtaaatttctttaaacaggtgaattgatgtcttacatataacttgtattgtggttgatttgtaccttttttcattaacagggatctagaaaaattgaaatcatatgtctggatttctccttatccgagaaagaaacaacaatagaatgggatggaaacgccttcaaaacgatgaaaaaccttaaaatactcattattagaaatggtaaattttccgaaggtcccaattattttccagaaagtttaagagtactggagtggcaccggtatccttctaattgtttaccatctaattttaatcctaaggaacttgtcatatgcaagttacctgacagttgcattacgtcatttgggctccatgactcacggaaggcaagtttaaggagtatattttcttcatcttgttaattaataaattcactttaaatttattcatttggttctttttttttcttttttctttttttttctttttttttttttttttttttgcagaagttcgggaatctaaaggttttgaattttgacgcgtgtgaatttttaacagagatatctgacgtatctggtctcccaaatttggaggaactttcatttaatcggtgtgggagtttaattacagttcacccctcaattggtttactaaataaacttaaaatattgagtgctgatggttgcagcaagcttaccacatttccacctctgaacttgacctctcttgcaagtcttgaactttcaaattgtttcagtcttgagaactttccagaaatattaggagagatggaaaacttatggaaactttctttgaaaaaccttaccctaaaagaattgccagtttcatttcaaaatcttggactcggctggttaaacctggataattgcgaaattggttgctttccaagtagcattttcgtgatgcctaaactgtttgttgtgaaagctacaaattgcaaggggttgcaatgggttaaatcagaaaagggtgaagaaaaagtgggctcaagagtatgttcaaatgtatttgaattcagtgtcgatggttgcaacctgtatgatgatttcttttcaacaggtttcatgcaggttggtcatataaaaactttatgcctaaggaacaataatttcacattccttcctgaatgcatcaaagaatttcaatttttaagaagacttgatgtgagtggttgcttgaatcttcaggaaattaggggggttccaccaaactcaaaagatttcaatgcaacagaatgtatatccttgtcttcctcgagttcaacaagcatgttgttaaatcaggtattgtcttgtttttaacgtatatatatgatttgataatatattgcacacttgatattaataaacttatgatatctttatgaaatatgaccaacagaaattgcatgaggctggacaaactgtgtttcggtttccaggagcaactattccagagtggttcaaacagaaaagtaggggaccttcaagttctttctggtttcgtaatgaattccctgacaatgttctttgtcttcttatagcacgtctggaatgcaaaacaaaatttggacttgaacccaacgtgttcatcaatggcaaacttcatgaaaaattctctcatcacactagcgtaaaaaaggtgaaattgtattatacatatctatttgacctcaaatcagcgtgtctgccatttgaagtggctttagaaaaggaatggacccatgtggaaattacatacgcaggtgtgatggagacctcactggttaaagcaaccggaatccatgtattgaggcaggatgatattcgatatgataatccttatggcaagacaaaattagaccatgatctcaacagctctgaatcacaaccactcattaaaaagcataggtatgtagacaagcaagtttcataattatgttatatatgaaaattatacttttaaattgtaataaagtaaaaaataccaatattataaatataaagtcaacatatgagatggtgtgactgaagagaagatataataggttgttttgcaggatatcgaggtgggttggccctgaaagaattagaaagcttctgtggaaagctgcagatggagctttgattcctaatgcccttactattaagaacttcccttgtcggcgatgtggcgtgttggaggagacatgtctgcatactcttcgtgattgttttgctgtgatagcgttttggagaagtgtgttacctaagcaattagcaccaaagttttttaaaggtgatgtaacagtgtggctggaaacaaatttatctttttcagaggcagctttttttggccgactttttttgggattgcagtggaagtggtcttggaattgcgcaataaccatgcgttctatcataaatacaatgtttacggttcccgtaatatgatgtatgttgtctttaagcgttataaagattttatgagagcccatgcttctcacaatttgatgacgaggaatctcttgaagtggaggagtcccgaacatgatgatgaggaatggttgttgaggttaagagtgagtggtgcatttgatccctcttctggtactgctgcatgcggaggtatattcacagacaattattatagatacgtgcttgggtattcggttaaggttggggaatgttgctcaaaagatgaggctgaaatatggggtatttatcatggtatgaagattgcaaggcagtatgatatttggggtgtttatcgtgataaactaaggcagcgtaggattccaatcagacctaagattgcaaggcagcatgattttggtgaaatttgggtggaatcggggtcgcagaaagctattgagtttgtgttagatggatgccctacatctgcatctacatctagatctagatcgctgcagcattgcttccctctctgtcctgaattgcaagctctgacctctgctactaatcacttttacttcttttgcagagcgagcaaggctgttgaatcgtttgccaaattcgggagtatattttcttcatcttgttaattaataaattcactttaaatttattcatttaattctttttttttcttttttcttttcttttcttttttttttttttttgcagaagttcgggaatctaaaggttttgaattttgacgcgtgtgaatttttaacagagatacctgacgtatctggtctcccaaatttggaggaactttcatttaatagttgtgggagtttaattacagttcaccactcaattggttttctaaataaacttgaaatcttgagtgctacgtgttgcagcaagcttaccacatttccacctctcaacttgacctctcttcgaagacttaaactttcagattgtgtcagtcttgagaattttccagaaatattaggagagatgaaaaacttatggatgcttaatttggataacattcacataaaagaattgccagtttcatttcaaaatcttgttggactgcaatttttattactgcataattgtgaaattgataggtttccaagtagcaatatcgtgatgcctcgactgtcttgtgtgtgggctgcatattgcaaggggtggccatgggttaaatcagaagagggtgaagaaaaagtgggttcaatagtatgttcaaatgtatgtgacttcagcttcagtggttgcaacctgtatgatgattttttttcaacaggtttcatgcagcttgatcatgtggaaactttatccctagtgaacaataatttcacattccttcctgaatgcttcaaagaatttcaatttttaagaagtcttgatgtgagtggttgcttgcatcttcaggaaattaggggggttccaccaaacttaaaagatttcagggcactagaatgtatatccttgtcttcctcaagttcaagcaagttgttaaatcaggtattgtcttgtttttaacgtatatgatttgataatatattccacacttgatgttaataaacttatgacatctttatgaaatatgactaacaggaattgcatgagtctggacaaactaagtattgttttccaggaacaactattccagagtggttcaatcaccaaagtaggggaccttcaagttctttctggtttcgtaatgaattccctgacaatgttctttgtcttcttaaagcacgtgtgggatatgaacttgattatctcatgcccacggtgttcatcaatggcaaacatcataaaattcactcttgtaacactctagtaagaaaggggaaattggattatacatatctatttgacctaaaatcagcatgtatgcatgatgatgtatttgaagtggctttagaaaaggaatggaaccatgtggaaattacatacgcaggtctcatagagccctcactggttaaagcaaccggaatccatgtattcagacaggatgatattctatatgatgattcttatggcaagagaaaattagaccatgatctcaacaattctgaatcacaaccacacattaaaaagcataggtatgtggataagcaagtttcataatcatcttatatatgaaaattatactgttaaattgtaatccatgtattcagacaggatgatattcgatatgatgatccttatggcaagagaaaaatagaccatgatctcaacagttctgaatcacaaccacccattaaaaagcataggtatgtagacaagcaagtttcataattatgttatatatgaaaattatacttttaaattgtaataaagtaaaaaataccaatattataaatataaagtcaacatatgagatggttggtagacgtggtgtgactgaagagaagatatagtaggttgttttgcaggatatggaggtgggttggccctgaaagaattagaaatcttctgtggaatgctgctgatggagctttaattactaatgcccttacttctaagaacttctcttgtcggcgatgtggcgtgttggaggagacatgtctgcatgctcttcgagattgttttgctgtgatagcgttttggagaagtgtgttacctaagcaattagcaccaaagttttttaaaggtgatgtaacagtgtggctggaaacaaatttatctttttcagaggcagcttttttttggccgactttttttgggattgcagtggaagtggtcttggaattgcgcaataaccgtgcgttctatcataaatacaatgtttacggttcccgtaatatgatgtatgttgtctttaagcgttataaagattttatgagagcccattcttctcacaatttgatgacgaggaatctcttgaagtggaggcggctcaaacttggtgaggattggttgttgaggctaagtgtgagtggtgcctttgatccctcttcaggtactgctgcatgcggaggtatattcatagacaggggttatagattcgtgcttgggtattgggttaaggttggggaatgttgctcaaaagatgaggctgaaatatggggtatttatcatggtatgaagattgcaaggcagtatgatatttggggtgtttatcgtgataaactaaggcagcgtaggattccaatcagacctaagattgcaaggcagcatgattttggtgaaatttgggtggaatcggggtcgcagaaagctattgagtttgtgttagatggatgccctacatctacatatagatggctgcagcattgtttccctctctgtcctgagttgcaagctctgacctctgctactaatcacttttactacatttgcagagagaacgggtatgctgaatcgtttgccaaattcggtttatccatgaaagagcaggctgcctctattttttctgagtggccctcatttttatgaaatctcctgtactgtatcaaaattttatatttttgtattttcaatttttatgtttgtaccaattcacttattttctgagaggccctcattctcttattttaatatttatatctcttatatctatgtgttaaaattcattatttttttttgacttttcttatatgtttattattattattattattattattttatatattgatttgaatttcttttatattttctcaaataaagtgtgtaactttttgtttcttatctcatattgttttataacatttttatcatattttacattgtaaaattatttattttttcgtttgggtctctaaaagatcattgatgttgcatcgaactgagtatccttatgtttgccaattgcaattgggcacgaaaacgttcaattgaaaacaacatttggctacatctccatcaacgttcactggatcagttagaggggtaagattttttatttttaatttcaacaacttcttccaacattacccactcaacaaccagcattaaaccataaatgcggtcatttttatttctaatattaattaaaatgtatttttatatgtacatattttaatatatttttttttgaaaacttgatatatttttattttataatgtaacaacaatttttaacaagatgtaataatatattatcaatttaagtatccatttttggtataaaaaaagagaaagataaaactaaattttctaataacttcccgtatgtatatttgtgaatataataagagatttataaaagggaagatttaggaagctttgattactaaataaataacttatctatgaatatttttctgtggtatgttttaattaaaaagtaatgaaataaatcatagtattatatttaaaattctattcaaacacttaatgtttaatttagtaattatataattaacttacttttcatccaaattatccaaacaagtttaattttgataaaagtacttttatttttataataaagtatctaaatatacaacaaattatatttaatttacttttatctaaactaaaaagttaaattacattttaaatttacaaactgtaattcaaacacatatcagttcaggaatctaagctccaaccacaatggacacattaccaaataagttggttgtaacccatgttttttttaattgttcatgaacgttttgaagtaaacatgaataatcaaattggtcgacaatcaaattataaaatataggatttgatatttttatataaattttaattttaatttttttattaatatatatatatatatatatagaatgataatatatattttaggttagttataattttgtattttaattaattttaaaatcattctgcttttcaattacagatcaattatttaattatattttttagttataattattatattttttcatattatgcattctacagttaatgttatattatatattaaaatattcgcaatgatgtttaaaataaattaaattaataatcttaaatagatattatatttttattgtgtcaattaacgtaataattaaaatatcttaaagtgtaatgttaaaataatataataaataatatggtattactcatactcgataagcctgtcaaaaatggtagaaacaaatataaatagtgtaatgtaaaataaatagtgcaagaaaaaaaatactttacttaaaaaaaggaaataaagagatttattaaatattttatgagtaagaaggaaataaatataaaaagataaaaattgtcattttgaaaattgtcatgaggtagcatctcaaattgttttcaaattattaaaaaaacttgtttgtcaaacactgtttataaagttaaacaaattttgtagttgttaaaacaattagaaactaactagaaatatttgtcaaacataaactaaaataatattttaggatcaaattatattgaccagtgtttcaaaaattataagtaacacgttagataagaagtagatctcataaaattttgtaatttttaataaatttaaattaattcatctccatttatgtgattgttgatgaaatgaatactctctgcttgtgaatgtttgttgggactttgttattattttatgatgttacattataaaattataactgatttttaacattacttttttgactctctttaataattggttttaagtgaattttaataataaaaaacctaaaataaaaaaaaaacagaagtaaaaaaatgtccaattaaattgtatttttgaattgaggttaaataaccttttctccttttgttgttttaaagaacttttagtacttataaaatgtgatatttttattttagttccttaaagatatattttattttaattcctgcaaatttaaaaatttaactttaatctctactcattgggaaatgtttatactcctagaacttggaaagaacttctaaatattccatatctaaagatagaatgaaattatttagttttagttatgcatctttattcttaaaacaaattatttgatgtagttgttaagagattagaagtgttattaggtaatttagactctttcacataagggatcatgattaggatatgttagcggatgaaggtaataattgtaataacgttaaatggtgaaaaatctctaccattgtatcaagagtagtttcggtaggtcaaacacttaacacgtccatgaaatcatgcatcaacaggcaattaacaccccaagcaaacatgttttgtctctttaatattctgcttaattatctttatttatgttgaattttacatttttcgcatcattactagataaatactgaatttagtcaattatctgcttaaaattagaaatatacaaactccaagtcgattagtcaaagtctttgtggacttgacactcaaacttactctagtaattactacttggatgctggatctgatgatggtgtcaacatggtagggattcatggaatgggcggggtaggaaaatcaacacttgctcgagctgtctataatgaattgataattgctgagaagtttgatggtttgtgttttcttgcaaaggtgagggaaaactcaaacaaacacgggttagaacacctccaaagaattcttctttcagaaataatcggagagaagaacatcaacttaacaagtaagcaacaaggaatttcaatcatacagtctaggctcaggggaaagaaggttctcttgattctagatgatgttgacacacacgagcaattacaagcaattgctggaagacctgactggtttggtcgcggcagcaaaatcatcatcacaactcgggacaaacaattgctagcatctcatgcagttaatgaaacatatgaggtgaaggaattgaatgagaaagatgctcttcagttgcttacatggaaagtttttaaaaaggaaaaagctgatccaacttatgtggaggccttgcatcgtgcagtaacttatgcttctggccttccattggctttggaagtaataggttcccacttgtttggaaaaagtgtagaagaatgggaatcttgcatcaaacaatatagctgaatgcatcaaagaattgcaatttttgttgctgtgttttatttgtttgtgcatgttttggcgattgagggatagagacgtgtgattatgtgcttatttatttatttgtaatggttgtgttcacattagtgctcagacggcctctactttaggttgtgccttttctaattgtttataacattttcttgtacgaagatctgaatttcaattaagattgccttaaaaaatgaatactcaggttttggtttaaatgcatgcaaggacaccctggacgtgtgaatttgctggttcttggtgaagttgaaaacacgtgtgatcagcaacaatgacattggctttgggacggctctagtagggaaaaagctcaagcgattggcagagctagatgatcaatttatatcaagagtgatgatatatagatattcataaatcataaatacctatttgatattatttttttacatgattgataattttttaattattaaattaaatgaatcctcgttgatgaggtatgtaatggacatgagatcatcctttggagagtgctgagtgcactgaatgcagcaagatagttgaaatcaatattttccgcgggaggtttagtcaatataaaaatgtaaaatatgcgaccatttgaaggacacttaattttctcattagtaaaaaaaaggaaatgctcataaaaaaatattaaaaagaagttaagaacaaaattaaatgtgtttaacttcttgaatagtgttagagggcaaggccatgcagaaaattcttcatcatgagaagtttagtgtcacgtgagataattcaggaatctggaagtgtctctagaaggagtgatcgaaattgaattgtgatggtgcatattctcgggcagccgatgttgcttcatgcggtgttgttctttgcactagtcgagtaggcaattttattcaaggaggcttggacattgctctatctatcctgaaagtggagcttttggccaactatttttgggattgcagtggaactgttgtgggaattcggcaatgaccctgagtcctatcttgttagccgttatgtttacaattcccgtgatatcaagtatattgtctataggcgttataaagattttatgagagcccatgcttctcagaatttgatgacgaggaatctcatgaagtggaggtggcccgaaattgatgaggattggttgttgaggctaaatgtgagtggtgtctttgatccctattctgtttctgctgcttgcggaggtatattcacagactacaaacgtacattcgtgcttgggtattgggttaaggttggggaatgttcatcaaaagatgaggctgaaatatggggtatttatcatggtatgaagattgcaaggcagtatgatatttggggtgtttatcgtgataaactaaggcagcgtaggattccaatcagacctaagattgcaaggcagcatgattttggtgaaatttgggtggaatcggggtagcagaaagctattgagtttgtgttagatggttgccctacaactacatctgcatctacatcgctgcagcattgcttccctctctgtcctgaattgcaagctctaacctctgctacaaatcacttatacttcatgtcgtctaatatttgggttggcgactatccaatctttagacagctggctgctaaatcgtttgccgaattcggtttatccattgaagagcaggctgcgtctattttttctgcttgtccctccttttgcaaaccttatgttcgggaaggattgtatgagttacattactttaaccattggctacttctccatcaaagtttgttggatccgttagaggggtaagtgttttttttcttaaaaaaaattcaacaacttcttccggcaattaaccctcaacatccaacataaaacccatgattgggttcatttctatttctaatattaatacattggttgtaacccatatttttttttattgttcaagaacgttttgaagtaaacatgaacagtcaaattagtcaacaatcaaattataaattataaaatataggattgatattttcatataaattttaattttattttattaatatatatatatatattgatagaatgataatatatattttaggttagttataattttattttctaattaattttaaaatcatttcacttttcaattacagatcaattatttaattatattttttagttataattattatactttttcatattatggattctactgttaattttatattatatgttaaaatatgcttattattgactgtggtaaacatatatgcgtttaattacaaataaatcataaatggtagtgaaatggagtgattaataacagggactccatgtgagctataatttgttagaagcttagctggttatcttcattctgttactgttgtattcaccttccactttcatgttcctagcacactagtacacaaaattaatcatccaatccaatacaatgacattccatttctacatcctctgttagagttctatgatctgtggtcacttatttccactttattttctttgtgaatatctttttttttttacttaattggagcaatgtgtaaatgatgaaagtaattttaatttgattcattttacctcctcaattcttcttattttcttttttttaaaagtgtttgttcaaaaccaaactagccctaaattgtctggcaaatggtaaagaattactattttttagtttgttcttactcattctatgatacaactttcttaatttttcttctttaattagttacattgcagcccttttgggtagtgaggccattgttgttactgatctgccagataggccgaggctaatgagaaagaacattgagatcaatatgaaacttacatgttctctgcagggttctgtaacagtaactgaactcacatgggcagaagatactgactcagaactcataccagatttcggtaataattatgttcctcaaccccttctcagctgacagctaagagctaatgacttgttggtgtgcggatacgtctattacttacgattcgtttgctagaaaagaaaatggaaagaaagaaaatagagagaaaaaaaaaatgaaacattttttatacttttttgagaaaaaataaaggcaaagttaatttttggataaaaaatttaacttttttctcctttttttcaatttaaatttaatttttttcttctccttctagccaaccaaacatagggtaaagtttttgttaataaggtaagcaaattacaagaaaaaaaatgaatttccaaaacattcatccgcgttatgtacgatatgtccgcgtacactttagtctattaatttcgaggaaatgctataaccaccaaaaaagaatagcaggaaaattgccagtaccaattaaatttggaccctgtctaactattgattaatttcaactttttaaaatgtttctcagtttagagagagaataattaagtaattatatgtagaaaaaaaataactaatatgtttagaaattagaaaagaattttataaaaaagataaataaattttaaaaaaagtcttataaataaagataaagaagtatattgactataaattaaagacattacgatcatgtttttttttcagggacaaaaagaagatacttttagcattgcgatcaaaagtataacatttatttagtattggaattgatttatattcataggtggaggaacttgtttatggagggtggtgggcgataaagatctaaaacccaagtgtaatagcatatttatttgataaatggatgataattttggaccctgattggtacaaaaatgcaaagtcaagcatcattatgagggaagacagctaaggaagggacacgcggcttgccattcttgagtacttaggctaaatttgagaaaataaaatttctttaatatattaaaataactaatatttgatttttaacaatttaattggacagaccatatttatttgtatcaaaggttttcacttttgaaaaagagagacgaaacagagatgaaacagagagacattttccataaagttaatacatatgtttggtactgagtgttattaacacttatctctttcatatttattcaagtttgattttggagaatccacattcatactaagatttcttatcatggctttgagatcaccttcctcttccttcaattacgatgtgttcctcagcttcagaggggaagacacacgtcatggttttactggccatctctacaacgctcttgatagcaagggaatccacactttcattgatgatgaggagcttcaaagaggagagcaaataacaccagcacttacgaaggcaattcaagagtccagacttgccatcactgtgctctctgaagactatgcttcttcctcgttttgtttagatgaacttgcaaccatccttcactgtcaccagaggaaacggttgtcggttataccggtcttttataaggtggatccttctgatgtgagacaccagaaaggaagttatggagaagcattggcaaagcttgagaggaggttccaggatgacccggagaagttgcaaaaatggaagatggctctgcagcaagtagctgacttgtctggctatcatttcaaagacgggtatacaaccatactaatctttttactttaaagtttttgttggattaacttttacttgtctgattatttgacattaaatctaaagggaaaataaatgcttgttgaccttggcaatatacgtatcaagacatggatacatgcaaggcttttagttttaacttgttaaaacttgttttgtttgaaacagagatgaatatgaatacaagtttattgagaagattgttgagcaggtgtctggggtgattaatctttgttgtcctttaaatgttgcggattacccagttggactaaagtcacaagtgctacatgtaaagatgcttttgaatgctggatctgatgatggtgtccacatgatagggattcatggaatgggtggggtaggaaaatcaacacttgctcgagctgtctataatgaattgatatttgctgaggagtttcatggtttgtgttttcttgcaaatgtgagggaaaactcaaacaaacacgggttagaacacctccaaaaagaccttctgtcagaaataatcggagagaacatcaacttaacaagtaaggaacaaggaatttcaatcataaagtctaggctcacgagaaagaaggttctcttgattctagatgatgttgacacacacgagcaattacaagcaattgctggaagacctgattggtttggtccaggcagcaaaatcatcatcacaactcggggcaaacacttgctaacatctcataaagttaataaaacatatgaggtgaaggaattgaatgcgaacgatgctcttcagttgcttacatggcatgcttttaaaaaggaaaaagctgatccaacttatgaggaggtcttgtgtcgtgcagtaacttatgcttctggccttccattggctttgaatataataggttcccacttgtttggaaaaagtatagaagaatgggaatcggccatcaaacaatataaaagaattcccaaccagaaaattctagaaaaacttaaagtaagttttgatgctttggaggaagaagagaaaagtgtttttcttgacattgcttgttgcttcaaaggacataaatcgaaagagcttgaacatatacttagttgtctttatgatgactgcatgaaacatcatattggggtgttggttgaaaaatctctaataaacgtttgggatggtgtagttaacatgcatgacttgattcaggacatgggcaggcgaattgaccaacaagaatcgtcaaaagagccagggaagcgaaggagattatggttaacaaaagatataattcaagttttagaagacaactcggtaagtgagagtatggtttcttattttgaactctttttttgttatcatatctttacttcatagtcaattttttcatgacaatttgtaaatttctttaaacacgtgacttgatttgttacatatatcttgtattgtggttgatttgtaccttttttcattaacagggatcttgtgaaattgaaatcatatgtgtggatttctcctccttatccgagaaagaagcaacagtcgaatggaatggaaacgccttcaaaaagatgaaaaaccttaaaatactcattattagatatggtcaattttccaaaggtcccaattattttccagaaagtttaagagtactggaatggcaccggtatccttctaattgtttaccgtctaattttcatccgaaggaacttgtcatatgcaagttacctcacagttgcattacgtcatttgggttccatggctcacggaaggcaagtttaaggagtatattttcttcatcttgttaattaataaatccactataaatttattcatttagttcttttttttttccttttttttgcagaagttcgggaatctaaaggttttgaaatttgacgagtctgaatttttaacagagatacctgacgtatctgatctcctaaatttggaggaactttcatttgatcggtgtgggaatttaattacagttcaccactcaattggttttctaaataaacttaaaatattgaatgcttatggttgcagcaagcttaccacatttccacctctcaacttgacctctcttgaaagtcttcaactttcagcatgttcgagtcttgagaaatttccagaaatattaggagagatgaaaaacttattgacgcttatgttgtttgaccttaacctaaaagaatggccagtttcatttcaaaatcttgttggactccaaattttatacctggctaattgtgaaattggttgctttccaagtagcattgtcgtgatgcctaaactgtctattgtgagggctagcaattgcaaggggtggcaatgggttaaatcagaaaagggtgaagaaaacgtgggctcaagagtatgttcaaatgtatatgaattcagtgtctatggttgcaacctgtatgatgatttcttttcaacaggtttcatgcagcttggtcatatggaaaatttatgcctaaggaacaataacttcacattccttcctgaatgcatcaaggaatttcaatttttaagaatccttaatgtgagtggttgctttcatcttcaggaaattaggggggttccaccaaacttaaaatatttcactgcaagagaatgtatatccttgtcttcctcgagttcaacaagcatgttgttaaatcaggtattgtcttgtttttaacgtatatatatgatttgataatatattgcacacttgatattagttaacttatgacatctttatgaaatatgactaacaggaattgcatgaggctggacaaactatgtttgggtttccaggagcaactattccagagtggttcaaacagaaaagtaggggaccttcaagttctttctggtttcgtaatgaattccctgacaatgttctttgtcttcttatagcacgtgtggaacgcacagatggatttgatattcccatgccccgggtgttcatcaatggcaaacttcatgaaaaatcctcttttaacactagcctaaaaaaggtgaaattctattatacatatctacttgacctaaaatcagcatttaggaatcctgataacaatctaagtgaagtggctttagaaagggaatggaaccatgtggaaattacatacgcaggtgtgatggagacctcactggttaaagcaaccggaatccatgtattgagacaggatgatattcgatatgatgatccttatggcaagacaaaattagaccatgatctcaacagttctgaatcacaaccactcattaaaaagcataggtatgtagacaagcaagtttcataattatgttatatatgaaaattatacttttaaattgtaataaagtaaaaaataccaatattataaatataaagtcaacatatgagatggtgtgactgaagagaagatatagtaggttgttttgcaggatatcgaggtgggttggccctgaaagaattagaaagcttctggggaaagctgcagatggagctttgattactaataccgaaaggagatataggcatctttctatggactcctcttgtccgcgatgtgggatgttggaggagacatgtctgcatgctcttcgtgattgtccagatgtggctgcgttttggagaagtgtgttacctgtgcaattacagccaatgttttttaaagttggtgtcacagtgtggctggaaacaaatttatctttttcagaggcagctgttttttggccaactttttttgggattgcagtggaactattgtgggaattgcacaatgaccttctgatttatggtggagactgttatgtcgagttccgttttatccagcgtactgtctttgagcgttatcaatgtattatgagtcgccatgcttctcacaatttgatgacgaggaatctcttgaagtggcggacgccccttactaaatgggattcgttgttgaggttacgtgtgagtggtgcatttgatccctcttctggtactgctgcatgcggaggtatattcagagactacgatgatagatacgtgcttgggtattcggttaaggttggggaatgttgctcaaaagatgaggctgaaatatggggtatttatcatggtatgaagattgcaaggcagtatgatatttgggctgtttatcgtgatcatctaaggcatgaatatgacattccaatccatcctaagattgcaaggctccagcatgattttggtaaaattggtgtggaatcggggtcgcagaaagctattgactttgtgttagatggatgccctacatctacatctgcatctacatctacatatacatccacatccacatctacatctacatctacatatacatcgctgcagcactgtttccctctctgtgctgagttggaagctctgacctctgctacatacttctcttggatgtgggaagagagcaaggctgctgaatggtttgccgaattcggtttatccatgaaagagcagtcgtctatttttgatgcttgtccccccttttacaaacgttttcctcctcggaaggaatggtaaaaagaaatagtgaaaaataattcattccaatcagtcctaagattgcaaggcagtatgattttggtaaaattggtgtgaaatcggggtcgcagaaagctattgagtttgtgttagagatggatgccctagatctacatctacatctgcatctacatctagatatagatcgctgcagcattgtttacctctgctactaatcccttatacttgtgttggggagagaacaaggctgctgaatcgttagccgaattcggtttatccatgaaagagcaggcgtctatttttgatgctgctccccccttttgcaaaccttttcttcctcggagtacatggaaaaactagtttcagtacccgttcattggatcagttagaggggtaggattttttaattttaacaacttcttccggcattaccctctcaacaaccaccattaaactcataaatgcgttcatttttatttctaatattaattcaaatgtatttttatatgtacatattttaataaatttttattattaacagtattgtctatcattcaaggtttattaacacattacttatccattcaaagtttagacttttatatagaatgactttttaagtggtcattaaactttaagaaattcttaattagatcattcattcatagttgtatgaatttttattttttcttttgaaaaatgaatttttatttgtatgtattattaattgtgcatgttttctataattttgtatttccctttgattaatttatttccgcataaacatacataggagttttttcaaacaatatgctttggattacataatgaggattttgtttcaaacaattaatatccctcattcaaaggatgttctaaaaagaaataatttcactgaaaataactttatcacaaaaataatttcttaaacagtcaatttcttttatcattcaaaaataaagtcaattttaatatttcgatacgaaatattacatatatatttaatgataattaaatattacttttacaatacatgtatctactattaaaaaaaattaaattcatctaacttaagagtaaaataacttattataaatttagatatgaataattttaggggtaacgatactttttaggataaaaaaaatgtacaacaaattttttgaaattcctgaataaaatttatctgcttactttttaattaatattcactagtattttttattgctaacaactagtattgggacccgtgcggacataggggtcacgcttcactacactctgctacatttttataaattaattttaatttttatatttaccataacaaaaaaatatttatatatgataatattgataaaataaattaacgtaattaactacgttattcttataactaataattaaattattattttacaataaatatagtaactaaaatgttattatgttggctatcgtaacaattgaattaaataaaagagtttaaaaatttcaaattttgattaaatttaaataataaaactataattttttttaatttatcaaaatttcaccattttattttacttttatttacccattatttgatatgacaaaaatttaaaaatgaatgatatatttaataaaaataaatattgtaaattgtttgacatgtaaatgtgtaaaatactgtaaaaaaaacattttcccatgacggtttactcatgatgacatagagaataattatctttcatacatgataattataatttcaaacattaaccaataaaattaaaacaaatttacaatatgatatagtgaataagtaattaaaagctgtcttataacaaaaatcatttttataatgaattattattttgatctctatcataaatatttttttatttatgatattattgataaagtaatttaaattaattaactttggttgtcttataacaaagaatcaaactattaatctttaataaatatattaactaatatcattatcttattatcgtaaaaaaagaattaaataaaaaatttaaaaattttaaatattcatttaatttaaatgataaaactaaaaaaattttgttttaaatgtcaaaatttaattttactattatttacacatttttcatatgttgaaatattaaaaacaaataataaatttaataaaaataaatacaattgattgtttgatatataaatgtgttaaaaaattttaataaaaaaatattctcataacggttaactcataatgacatatggaataattattttccataaatcataatcataatttctatccttaaaaaatgaatttaaaactaattcctattataatatagtgagtaagtaatttaaaactattttgtaacaaaatcacttttacaaattaattttagtttttatcgatataataattaatgataattttactaatgattgttgattatttgatatgtgactatgttaaatactttttgggaaaaaaattttccatgacagttgacccatgatgacatagagaataattaatgttggtaaatgataattgtaatttctaccataagaaaatgaaattaaaattaatttacattatgatatagttaataagtaatttaaagttttcttgtaacaaaaattatttttataaattaatttattttttatctctatcataactaaaaatatttttatttatgatattattcataaattaatttaaattaattaatttggttgtcttataacaaagaaacaaataattatatattattatgctggttataataacaattgaattaaataaaaagagtttaaaatttgaaattttgattaaatttatataataaaactataaatacttttattttttaaaatgtgactatttcattttattcttatttatttattttttatatcataaaaatttaaaaataaataatacattcaataaaaataaatattgttgatcgttttatatgtaattgtgttaaatacttctataaaaaatcttttccctacaacggttaaatcatgatgacccaaagaataattatttctagtcaatgataattatagttcctatgataaaaaaaatgaattaaaattaatttacattatgattatgatatagtgattaagtaatttaaaatttttttgtaacaaaaataatttatacaaattccttttaatttttatttctgtcataactaatcatatttttatttatgataatattgataaagtaatttaaattaattaactttagttatcctataacaaaaaataaaactatttttataataaatatattaactaaaggttattatgctaattatcataagaattgaattaagtaaaaattcaaaatattgattaaatttaaataatgaagctataatttttttaaatgtcactactttagtttatcatctatttaattgaaatttttttatcataggcaagctcaattttattaaactcaaatatgataatacaatgagtgtcaacgtgaagaataaaaaaatgtaaatatgttttttatttcttaaatatgatgtatgatctttttagtatctcaaattttaaattttttttatttcttaaaattgataattatttttttagtatttcatcacatatgacattaatataatatttttttgtagtccttatataatttctagggactaaaaataataattttaaagtaacaatattttgcaaagcttgttccactgtcacattatttggttaaaaaaaaaaatatgattcacagataccaacttacccgtgaatgaatgaagttatgacatcataaatgagaaacataatgaagaatttatataagattggtatttactatatagctagccccaatgatcataaaaacatgattggaatagtattataaataataaataaagtatgaatctctataatattaaatcaagtttatttggcatgattggaatttatccgatcactggccttgatagaggttcaaaacaaaaaataaatacacaaaaaataacatgaaatgcagaagctacatcctttatcacgcagaagttacatatgacagattccaaaacaccctcgatttcaaaatttgagttggatccagttagcctaaatcagaatgtccacaataacaggtcaatcactgtaaaataatagtatttgtgatattattgatttggttcattaaaataattaactttaatgatgttataacaaagaatcaaactattatttaataataaaaatattaaatagatattattatgttgctccgctatgctccgcatttttttaaaataattttaattttatatatatgataaataaaataatagtatttgtgatattattgatttggttcattaaaacaattaacaattaactttgatggtgttataacaaaaaatcaaactattatttaataataaaaatattaaatagatgttattacgctgctccgctactctccgcattttttaaaaatgattttaattttatatatatgataaataaaataatagtatttgtgatattattgatttagttaattaaaataattacctttgatggtgttataataaagaatcaaactattatttaataataaatatattaaatagatatgttgctccggtacactccgcattttttaaaatgattttaatttcatatatatgataaataaaataatagtatttgagatattattaattgcttcattaaaatgattaactttgatgatattataacaaagaatcaaattatctatactataataaatatattaaatagatgttattatgttgcttcactgctctccgcatcttttggtcattaaaacttttaagcttttaagtcagacataaaatattaattacttttggtcattaaaactttattttagtcctataagtttaattttttatttgctctcttataaaaaaatcatttgttattagtccctttgaaaaaatttaccaaagagtaaatacaaaattcgagtatttattagaaatcgaaaacatattttagccaattaagaaaaataaaacaatttcaagattggccagaaaagggtgaagctgtttcttggtacaaaatttgtagctttcgtttgccaagtcaaaacctgactcaacagaacaaaatgatggtgctcaatagcttagaatatctcaatagctttgcatctctatcatatgataggagctcaattaaataaagttatctgtatgtcctaataaactgattcatgattgatggaatgttaataggaaaaagaaatcgaagcctctgataagaaatcgaagtttctaattggtctatacagttattacagttaaatgatttggcgtaaccaagatacattgtggaagtacaaggttgtaggatatgatgatcctttgcatttggacaattcacaattgctatcaactcagtttttgtttcggaactttttagaggatcatttatattaggaatcagtaatactttgtcatgtgatataatgtcacaatatcaataatataattaaatgttccttgaaaatccttggcagtttgtttagttcttgcctagaagaaatcggagatggaaatggttttagtagacacgctttttagttccaaaatgcatcatcactttgctaagatcagctgcttttaagattagaaaaaaaaaaaaaaaactgagaagattgaggttttctcatgaggaattctgtttatcttgaaggaccaattaatatagagtataaatttattttcatgacttgtagaacatacttggtttggttacttaagatttgttgtggtgtggagcattgattcttttctgtccatgattttacaatataaactctgatttaccctgttatgactgacaacattaacatagagcctcatgaaaataactcaaattttattataagccatacatatttggtttcaaagtagactatataggctgagtttagagaacatcaaaatataacgtaatgcataggtgccctataatatcacttccatgcttcaagcatagacctcagggtttgccacaagataggcatccactaccttgaggagagccaaaccttcctcccttgcagccttgaaatcctcctctttgacatcaacccctgctttgggatgatacttgctgacattcttcatcttgcaacctccctcttcggtggcctcgaacttaacctcatgtgcaattgaatccactttttccagtgcaccatccccctcgatcactgcatagctgtaatttttttttgtagttactttggatttgttcagcattggcctcttcaggttagtttttgtttttgtgtatatttttttacatattggtaatttatattattaatttttattatatttttttatttatgtagtttttggttgttaaatattatttatattggcgatttaaaatattaggtttgagaatatttaagattagtttataattacttaatcagaggatacatgaaatataagagttttttttgttaaaatgcttcatttaaaatattttaataaatttaatttataggaaccttattcaaattaagtgtataatatagttggtaaatataatttgtaagatacaaatttattaaaattaattatatgttatagttgataaatatatattacttatgtagttgttttgtgttaaatagtatttatttggaacatttaaaacatgaggctaatttttttcattttttatttatattttgtatgaattggtaatttatatttgatttaaaatatatttttgatttatgtagtttttgatttttcatttgattttaaaattttatcataaatataatttgatggtttatattttaattttgtaataaattgttaatttattaaaaatacatgtttcgaaatttttgttgtgtgtatatttttaatttatacaggtacttatttacgagcaaatttgttacctgtcagatccacagatttcgctattgggtaaagctgattatgttgaccagtaattggctgccaagtcagctaatggaatccgctgcggtgacttgcgaactcttctccgtggcagtttgacaatttttccttacggcctggcactttcacatttagtttcttcaattgtggccttttgacgcttgtctcgcaagtgtttgatcttatcacctccattgaaggcattaccaataatgatctctttgttagtcatttcagtttgaaacctaccaaaagatatacggcattatggttagaatatatttagaaaacgaaatctttaggacataaaggtgaaaactaatgactggtgagctttacctcacatggtatgagaaattattatatgatctagaacaaccatgtgcctataatctcaattaatctgcacttgacatgtaaccaagtttttaaatttacgaaaaagagttaataaaactcgtagtgagaataagagaataacaagtctaataaaaaatgaccaaaacaataatacagtcaaacttgaaatttgaaaatggaacaacttgtagtgagtatttaaaaaaattcaactcaagtacttaatataaataaaacacgtgtaagagaattcataccacaagtagttcacgtagtccaaggggtgcagttacaatgtatgacacatctgggtgttcctttgctgcctctgcacttaaggaaggaatatcctgcataatagtggagtttaaatttttttgcctattttctatcttcataagtcaaagaatcattttgacaatttatagaaaagtaggagagaattctatgcagacctacctgactccaatgcctcccaggaaagagaaaaaagggactaacaataatgcaatgagcaccttgttaaacgcaagattgaaaagcatctcttattgatggttctgctaattcctgtaaatgtaaaatacaattatgaagcatcaagaatttgctccatagctacaattctctcatgaaatgaaaaggcaaagacatggctagatgcacaaagaaaattgtgttactaaaattgttatttctgccagccaaatctagattccaggtcagaccgggaaataaagggtaagcagctcaactatatttcctcatgaaggaaaatcatgtattattgtgcatgccaaacaacccaaggaaaatgcaaagaatcctaaaataatgccagacttgctcacatgctcgcaagttcttttttaagacccaggaagctttatccttaaattgaggcaagagatggcaaatagcctataggctgtagcagctcaagtatgaagtatctacctaccatcattcagatttcatttttcatcttcatatggtctttgggcacttgacatgatgaaaatctcaacagattacagaaattaccatatgagcaggctccacaatttcatacccagttgtatgcttaaacatctccacaaattcatctgacattcaaaaccagataacttttagacataaaatttaattatgccctagtaaccaattttaaaaaactcatctgtgaaagtaaactcatcagcttggggatgaggtttggagcatcaaggaccaaagccttgaacaaccttcctggctggacagtgctagtaaactcagtggtgaaagtaaaaacctacatgttaagtttggagtaaaatacaagatatggctagaaaattaagtatagagagcacttcgaattgcagtgatgtgagatatcagagatgtgtgtacttatgattgaagaggataaataagcaattaatgttacatttgacaatatttcaacaaacaaccactattgtgaaatggaccatccccttgcatgccttattaattccatatttccaatgaaagtctttgtttcctttacctatgtaaacatctaatcaaacaatgcaacctgtgagcctattactcctaatctatgcagtgataatacaaatcacacacattgtaggctaattaataatatactctggtctgtttttttaaactacttcgaaagctttgaagtctataatttaatttttctgtcagtactaaaaccttagggtctagctaatcacaacaaatgtgtatttatgagattctttttaatgaaaactttcaaatttttatttcgtaatctttggtctgaagctgaggagtgaagaatccaaacctgggagaagtcaagaagaagctgcagatgctgcgaagcaaggagaagcaacaaacgaacattgtttcattttataattttgctaaaacagaggtcagaaaaattcccaataaaactgataagagtgtaaatgttgaacataaagcagaaccatgaaacattaaaaaattgaaagttaaaatattaaaaacaaaaaagataaaaggaaatacaaagtatgagctatacaaagtatggattaaatatactattaggagtcaaattaacaaaaacattattattgtgtgtaacatcatttagcctgtaaattgaaatgggcaatgaactactgttcaagaattttttttggaagcaagtgttgatcacaaaactagtttggttataaaaaaaataatttatacttttgctcctatctttattataagatttaattaattatatcattagaattaattaaggaaataggttgatttttagttgagagcattaaatttattctaaatttatatttttttcaaaactatcccattgagaaaactaataaatattaataggtttcattgttacaccagtactctaaaattgaatttaattaaagattttttttaaagaaataactaatgcaaaagacaatttagattgattatataaaggatcgaattacacttttaaattggaataacaatttgtataacatttttgtatatttatctcttttacacattatttattacattttataatgatagatataaacacacacaaaatgttatacgaactgttatataaattacatactgcatatattacatctcataataaaacttgaacaaacttttctctgtttcttacattttcaatgtgtgtaccacttccacacatttattttccattgcaaaagaattggcctggcaaagtaaatcttttgctttgatactaaatttgagtcaatcattctccaaccttcaaaagcagttgataaacgtaaccaaattaacattaaagactcgttaagcaaaattaaaagagaaaactgtaaaatgcgtatttaaataaaatggagttttattttcgtacatggttaatctagagattttacattatatatcaactaataaaaaattgtcttaattataactttttaaagtaattaatacaaaaatccacaatgttactatatttgtacatgttcatgatagataaaaaatatttatactgtcgatgcattttaattaaatatatgaaaataatattacatgtttaataggagaaaagagtgggaagatttacattcatgaatacggtttaacagtatattattgcaactcatcaaatgtatcgctttcataataatttactcttatgttctgtttaactttgaaacttgagtatagatgaaaagaaattatccaaaaaagttgtcacagtcacacatgaaatacctctttataatgcatcaaacagtttcaaccaaagcccgtcgcaacctccctttactttctttggcacgttcaaaggacgtactgcatggtgtcaacatgtggaacaatatacaaacagagatagaaaaagatgtccattaatgatagcaacataaattgacgcttccatcaaataatattaaaagacatcacagaagaaaatcttattataaaatatgaaaataattttaagaactaatatatatatatatataatcatttggatgaacaagatatctctttgtcgaaagtttagaaataatcaagcataatactaaggtcgatgtaagaaattgatctttttcaataatacagagttaagaataaaattcatgattatatatttaaaagattaaattatctactaaccatgtttgcacattgatagtatctatatatataatcatagtattaatgaataaattaacgaaagtcatttacattacctgcaacgttgtggtacgctccaagtaagatttgactgttttttgtcaatttcagacaatgacatatacttcttccaatcctcaagcaaaattttaagatcattgactttgttgtctatgccaacacaacaattggcatgcattgttgagaccttgttgaagtccttgctaggctcacaaaaccctccaaaatagttagtgctaaggaacctaatcttcagcttcatgtgggaaattaaggggtgtattttgatcttgttgaacacagcctgctcacccaaccctgggtactctttgctagagttgaaccagaacttattaaaccaaatagttcggttattcgattttatatatttaaaccctccatttggatagttgtgtatgtcagaggagttgccattgaaagcatcacaagctatttggaaatctgcatcttcataaaattgcttgaagggatctctaagccacattatatcagtatcctgcaaaggaaaacaaagaaaaacaaaccctttaacttgcagttggcttgtgtggtagagtatgtgcattgtaaagatcttaagaagctttttttttttttttgcaacagaaagacatgtataattgtatatatatatatataatatatataccgtgaacacaaagttatatcccatctcaagaacagaggtgaggaattcagttcttctccacatcatgtgtaggtatgttggggtcatgaaaaatacttcaccggtgaaattggcatgcacctttagtttcaacttggtaacaatgtttgtgcaaagcaaggcaataagcatttgtcttttggtcccaagttattaccaccatgtgatttaaaagccattgtgtctcattccctaggcgaaaactctccagaaagaggtcaaatatggaacctggctttgcccatgtgatatgcatccagcatatggtcctttccaagcttttcaaagccaaaatcattgataaacagcttagaattgcatatgatcatgatagttgtcgatgatttcgttatttttaagtgtcatgctaattggaacataattgcagcaggaaaacacttcattcaagccaattttgagaagttcaggtcacccacgccccaagcttgaagacgcacgctccaggcgtgggaaggagcttagtttggcaattatgactggaagtccacgccccaggcgtggggagccacgccccaggcatgggaaaaggcctccatcactgattcttgctgccaagccacgccccaggcgtgggactctgctatctgtgcaatttcgaagctaatgaagggcagtcttggattttcacttcctacttcataaataccctcttcctcagacttgaacacacgattttggagggagaagacactattctagggtttagaagctttgggcactcttagtctaaggttggaggttgaagaccaaggtggggttcctccttcatcttcttccttcttgcttcagctaggaatgttcctttttgtaactcaaccacccattatgaggtgtggctgagcatttattgtggttagggccaaagcacttaatgtaaatctttattggatgtattgaatgctattgttcatttattacaagttattttactacactttgcatttctcttccttctcttgcctagacttagctaacctagttaagagcttagagctttagttcacaatagacatattgggactttagtttctgacctaagtgtggtaacttgctaacattgcctagacataggggtgggtgcttgcaactttactcatttatgtgtttgcttaatgcttaacttgcttaagatcactaagagattagggttggatggtaggttaaagaactaagtggaagagacatcaaagcttagtcaacataaggaaaacacattggttgaataacttggataatagaacgtagtgttcaatatcatttcatagagaggcacattgagtgtgggttgccctagctacatttccttacacatcgttattttctcacttgctttgatattaatttccgcttgtttttagttataatttccttccatcgattcacacacacacaaccacaacattacttcattattttggtatccaacttatcgatcgaaattatagtctatttggccaaacaatcctcgttgggaacgacaaatccctttcttccactttattacttgagcgaccggtgcacttgccgtgaacgcaacaagtttttggcgccgttgccggggattgttttagccaaattcattataactttttatccttaagattggacttattttgtttctaacctgcttccagagtatatgcgaggtactgttagccctgaccatcttcagtttgatcctgaaatcgagaaaaccgcaaggaggaatcgaaggctaacaagactaagaaaggaagcagaggggtctagttctcaacctcaagaagaagaaatatttgaagaggaactagacatggctgagaacaaccgtgagcagccaaggccagaggacgaattaatggagaacattcttgctccattgtttgtccgtccagctcccagcatagtgaggccaccgattcaagctcatcatttcgacatccacccatctcttatcagcttggtggagaagaatcaattcggtggtgaggatgatgaggatcctcacagctttgctgatcatttcatgatgatttgcgacaccatccgccatcagggagttacagatgatgccattcgactccgtctctttccattcgccttgaaaggaaaagcactcaggtggttacaacgtcaaccatcaaatagcataaccacttgggatgagttgatggcaagattcttcgctgaatacttctctatggagaagtataatcgtttggtgaatgagatcaccaactttacacagcgagaaagagagactctgtgtgcggcatggaagaggttccaagagttgatccgactttgtcctcaatatgacatgtcggttgggaagaaggtgcgaatcttcttcaatggtttgttgcctgaatccaaattggtgattaacggagcagctggaggaaccatcagatcaaagaccgctacccaaacatatgaattgattgattccttggcacgaaccgaaaatgaaagcttggcaagtcagccgaagagggaagtcattcatttgggtagcacggatgcaatgttggctgagcaaaaactcctatcacagcagctagctatcctcaatgctaagattgacaagcttgaagtctcaaaagcccaagcttcatcgatcaaggcaagcacagctgtatgtgaatattgccaaggggaccacgagtctaatgtgtgtccaaccttagtgggggctgatccaattcaagtcaatggggtatggtatgaccaaaggccaccacaaggttaccaaagaaactataatcaagcttctgggagcggaagcaactatccgagaagaccatatgggagtggtttggattacaagtccaacaattacttacaaccacctcccatccctcccaaagaaccatcggagcttgagaaagctatgttgcaattggccaagaccaccaataaccacatacaaaatactgatgcttttatgaatgagactaggtctcagttgaagaatcaaggagcttctatcaggaatttggagacacaaattggccaaatctcaaggcaactagctgagagaccaccaggccaattccctagtgatactgttgtcaatcctagggaacatgctaaggccatcactactaggagtggcattgttattgctccaaaggagaaggttcaagtggtaccaagagaagaggagaaggggattccacacgccaatgcagaaattgaaaattctgcagtagaaattgaaaattctgcagaatttgagaattctgctacatcagaggttcctcacaacctcaaggagcaggagaagaagaagggaaaggagaaagccacatctgagtctaaaccacctctggatttttccagatttgagaagcctccctatcccttgaggacgaagcagcaaaatcaaaaaaagcagtatgccaacactactacagcaagcattttttacgtcaccaaatctaagtcggttgtaatatagccgatgttaaatcaagttcagtggcaaaatcataataaattgtattttgtttgatagacaacgtcgggttttaagtgaccgtagttgttctttaagaaacgaagtcggtttgcaaaataaccgacttagaaaggattaacatttaaaaaaaaagattaaatttttatttgttttaaaaaaacctagtcggttttctttagcaccgtcgttgtattatgccttggcaaagtcggttttaattttaaccgactatgaatttaataatacaatttttttttaaaaaaaagtaagtaaaataaaacctattataagttggcccttttcccccggatgccctaaaagctcaaacgtgcccgtgccccttcgacctaagctcaagagttggtgttcaccactgaagcctcaaagcccccttcgacgccgcgattgatcaaaaattacgactattgcatcctcaaaggtaagttttaacttgtattcttcagatattgcggattccttcatcgtcattattgttgtttgattttatttgcagaagctggttcgaagagtgtaggttggccaccccgacaacgaatatcaacatcagtgccgacggcgagtggtttcgccatgtagtctgccgcaagtgacaagaggtcagggatccctggagctagggttcacctttcattcgaactcctgttggagtcagacgggttcatttgcaggtaacattctacacttagctgctcatctggcacttcaattgaaagcattgtccagttttagagcaaccattgaaatgcaaagataggtcgcatggttcaagctaggtcaatgttttttatttttaatatcttaactacaaacagtaattcgcaagtcatttcatacacacacagtaattctctgcaaataaaaatgaagataaaacagatcagagaagtaaaaagagatgaactcatgctgccaaaacttcaccatcctaaaagtgaaagaaaaaaactaattaagacctcattcggtgttgcaatgcatgatgtaagattgcattacacaacattaaatacattatatatatatatatatatatatatatatagcagctgcatccatttcctcgaaatatagtaaaacaataaaaagatttaattcaatcagttaaacatgatgtattataaacagactttaattcctatgatcaaacaaaaaatatagtaaagcaagaccttactaaatcataaattcactccttttgtacgatgctaattaatctacactaacttttagttttccccaatctaaatagttgatacttgtggtccagactaaatagtctatctaaagcaccttctttaatgatgacttaaaatcttcttcatattcaagttaaaatagagaaaaagatatattataactggttttcattttgatttgcttaatcataaatcatcagatgataaatatttcagtggtccaactagcagaaatcaaccaaactcttgactgattccaagatgaaccttccttattatttcatactaataaaaaatattgtaccaaattttaattagtgtaaggccatttcgaagagtacatagcaggcagtttcactaaaaatatatcaggagctacatgctatagactatagactatatagagtatatagtatagaccccaggaaaaagatctgttgggccaataataaagcatttataaattgtgagaagggtatgactctgataaattatatattaagatagacaaagtagcagaatgcgagtaaagttaatggtggatccaacccatttgagtttgttccaaaccacacacattattgtcatcttacacttcaagtctacctatttccctcatgccaccgtctctcacttttcttagtgtcccaatgctttctctttctgaactgtgtgaaaagggagtactttgcagccactttggggaaaaatatttccccaatgtggatgtggctttctcaacttttagtacaaaccctctagtttcctactgccgtgaatgattagtggaaggagatttggggaagatccctgtgcatgtttattactttaatctgaatagtttactataaaaatgtttgtagagctcattcttttttacatgaaccaattataaaatgagatatagttagctgtatagtgtatatattccaaccatgacctttcaccaaaagttttttttttttttttaaggatccccaaatgttttagtaatagattaatcaccattcatatgcatataaataggaactaccccccttcttcttctggggcctaaagagaaaggctatgccaaaataaacacatacacaccaactcttatataattactttagtttctcttttattccatgattatttcacatattatgtaccaaccaattagggttgttttgacaagtgtggaattaagcaagaagtttctcaatttatcagacaaaatctctctacgcgtttgaggtttttttatgtcaccgctgaggtgagagtttagtgattcaattgattaaccagctaatttttgtgcatggattattattattgtttcactttcatgaaaaaaccaaagactattgtcatttttaacaatcattataaaatcaagtctggccaagacggttatggtcttgatgctattttgatgtattatcgtcaagaaaatgatgggtcggggaccatgaattgtttcatcaatgaattgcctacctcgtgtcaaattctgtggtcaagaaaatgttggattatatatatatatatctcacaaattggcaaggaaaataaagtcctcctcggtgccttaattaggtggtagcattggcgtagcagaagggattgagagaagagttttggtaggattgggaaaagggttgggactcaataggcatagaagagggcaaaggagagaaagggaaggaagagggtggtgtcatgttggggttggtcaaggaaaggtttctggtataagaagatgggattgtttgggaggtgtttgtggcggtgcttgttgctgaacaaacttgcacaggctttcttgaacggtttctgcctctgtgcatgtgtctttcacagtacttggagtctggatatgcctcctttgagcatctccatttcttgccatctgttcttctgcacctccctggctctgggtctacttttctgccaaatcccatttcaaaacatccccacccaactgcagccagagaattatgacaacaaaccaggctctaaattttatttgtccctcataaaaagtagacatatataataataacaactagtgtattttatttttttttaaaaaaaacagaaaattatccatggccttaaaaaaacatgagtaacatgctagcaaaagcacttactgtcttacttggatgatgtgggaagagccttgaagaaattgaagtgtctacatttcttttaatagagtagatgagatctggtgggataggtgttcctgtaaccatgtacttaaaaacaagagcttgatgctcaagctcttgccactgagtttgcgtgaaaggagacctatttcttgcacttgcactcatcattttgagacaacaaaaacaaggaagagtgtgtgtctctctctaaaatagtggtgaagtgaagaacaacaagatataagatttcaaagagtgaaataaagactaaagagggtttaattttatttctctagatggggtgatagtaatttggactttggagggtcattttttttttcaagggtagatagagattcttctcctgtgcatggataacactaatggctctgagagtctgatgatgctttctggctttgctgccacctcctctctatttctctaatgtgctggatgatgggtgagtgagtgagtctgctcttataatgattgcacctctgtcgcttctgttttttcctctgcaattgccttggttgctgcccttgtctctaacatctttacagaaatccataaacaaatgtacaaaggaaaagaagaaaaattaaattcaaatgcatgttagtccatgcacctttggttttgctgtctccccatcacttcatggaaaacagtgtcatgccatccggttatgtgaagtgtaagctgcttagcaatagtggccattagtatatcaaattatcaatctctctttgcaatggtagtaactttttgaatgaaagtctcgtacgtgtcactttttaatcttttttggcttcaagcatgcgtggcgttatctcattgatagatttggaggccaaggctagagctgaatcctgctttttttggccactgattgatgctttctcctttttttcatttcaccccccaaaacccaaacatctcactttcatcagtggaattagggttacagtcaatttggcctttaactcttattgaccaccgtcttgtcaataggccatcataaccctttacatgtttctccttaatcattttcatgaccacaaaatgtcaaaaccaatattcatcaaacattatggtaattgaaaaacacagaatttcaatgtatcttttcatgcttgagttagagttttaactcaatgataatcggaataatgaatgttttctaagatgaaggtctaataatgtgtttgaatttacagtgaaaagtttaaagtcaggtgaaataattaaatgcctgaagataattatttatccttttttacatgtatttttaataatattatttaaattaaatatgattattttaaatgataaaattattttttcgaacattttaaatattcaggacttgaatccaaaataacttattaagttataataatttcatataaattaatccatattcgtgataataaaattggaattgattatgaaaaaaaaaatctaattcaaacactattttactttgtctttcgaaaaatttgaattgatgttgacaaaaataaagtcaaattaaacatgtcataattataatttagaaagcaacaatcaaaatatttcagataccgcatctgaatttctcgcaattaaaaatcccaaagaaatgattaactgtaacaatgattattcagcagtttaaacttcacactcccaactttttggcaactaaccacaataaaaaatgatagtgtattctatgtaattagaagtttagaatgacttacaaatagaacaattcaagtcaagcacaatgataaattaatcatgtcttcggagactccaatgcatgttcaaattaaaaatcagtcaagttaggattatgcaagcaatacacacatagttgtaattttaatgttatcataatttactattaatattaatatctatattgggttgattgaattaattggatatgaaactcataaattcaatatccagcctaattattattggataagttaaaataaacccaattcatctttctaatccaatccaattctgaaatgttatttagataggtagagtttatcagatttccaggtcgattcataccagtctacacccctgttatttgcatttattcccatattttcacagttttaaagatggcgacatcaccataacttaatacactttttttattatatgtaattcattgttggttaaagttgtatcaatattttgaattcttttccatggaaaaactaaactttagcatattctttgatggtgagatcgagacccattctagccggcatttgaagaaagaaaaaatatcttcaattctttgaccttaattatctcccaaggtgcgattttcagattttgcaatgagatttattattgtttcagtttatatagaattatatactaagtttctcttacattagaatatttttattttaatacctattatataagaaaaattagaaatgttttccaattcctattagtcacattattactcaactagaaatattgatgtcatagattaaaatgaaaaaaaaaaatattaaggaccaaaacagacaaacaaattttaaaaaaccaaggcgaaaaccattatatatttttgtcgcgtgatttgaatgttctcattattaaaattgtgtaagcaaaagttttcccaacattctctgttgatatactttttttgattttttaaagcatatactttaaatgataagaattcaaagaggtgaatggaaaatcttataaaaagccaaagaaaaaacgacttatcttttagttcatatattaaagttgcaacatcaattttttttatgatctacttaattgcatcacaattacaatagatgttaggggcacgagtaagtcagatttggtctattttatgatccaacctaataaaatagaattgagttcggttgggtcaaatttgttctcttttgtaaacaacccaaagcaaatctagctgtttaaggttagtttgggtagtttttcttttagtatgacaataaggtaagattacaaatgagtaaagagggtgcctcattcatatgcagcataagtatgaattatggcctctggacactaggagaaaacagtaaagacatgttgagatgaagagcctttctttactagaaaatctccatagaaattccttctcgcatagtgtgttgaaactttaattgtcaaagcatttgccattgtaaatgacaaataatttcacattcatatttgttgtaaaacctggacactcttctttttttttttttgtgttcttttcttgttgaaatatattttcttttcttattgtgatttgttaaaatctgttctgtcatagggtatgtgggatgttacttgcacccaatgcctgattcaatattgttcttcaaatcaaattacttatgtccaaattatacatcgctaccattttgcatctcacttaaaacgaatggcagttgttgtttgcattcaagattttttttcctttgtgaatgtttgtgggttgctcatttgtttagcagctatatatgcctttggatacatgcatgtttcccaattaggtccttcttgatttaagttgcttcttaggtattatgtactttgccttatagttaatgaatccatgagttgaggtttagacttcataacactctgtagtatcatatattttaggggttatggaatgctcaataatataagtgagttaggaagaagcaaaaatgatttgtaaatttttgtgcgaatctgtcagaacttcgatggctttgctagaaatctaagatgaaggtctgagttgtttcagctgttttgtatcttgaccagtactccttgtactgtttctatatatatatatatatatatatatatatatatatatatctatttttgctgatcaaaaaaaaaaaaagaagctattagggtaaccaattcccattaggattgtggacaaagaaacaagggtgagaagttgcaaaaagtagtggtattggccttctagtcccatgtgatccctagagtgaaggtggatgagaagaaattgttgtgcaaaagctatggctcctaacaaatgagttaactgatattgagctttggagcataattgtcaagaactatggcaaaggtgggatagaccaagaaggacatagccatggaggagtgttgaaagttgtggacatgatctgagggaatggatccatcagggttgaatggatggtgacaatccggagagatgaagagctccaaggcaatgaagattgtgcagcttgttattatgaagttgagctgcaagtatctagattttgtggtgggaaaccataggcttgatgtatgttaggtactggtacagaaaagaaaagagaacgaaagttttattcaccacacacttcttgcttacactgtcacttcgagggtcaccacctcctaaagaattccctcccctgatcccctctcagtgatcccctttatacatttctctctcccctgttagttataactaactcaacttagttatactaacaattaaattgctatctaaaccctctttcataagtttgaccccacctcctatcaatgtaggacttggaacaaagggcgtggagcttgatgtgcttgaacaagtgccataaaccaattacaaagaagccaaaccccaaaacttgatgtccctccaacatagtgcctgttaggccaacacaataaaaagaaacttaggttatgtttcgatcgataatagttaggaaaatgttttgtttagtcagtaaaaagtaaataaatataatgaatttataataattcacacattgtattcaaccaattaaataatatacatttacttgatacaaaaaaatacttttaagaatttcaatatatatttcaaatatatatttgggaataaaagtattttcaaatttttccgacaaaaataatctaaacatgtacttagttgtacttagctggtattcttgtcccacagcctgctcacccaaccctgggtactctttgctagagttgaaccagaacttgttaaaccaaatagttcggttattcgattttatatatttaaaccctccatttggatagttgtgtatgtcagaggagttgccattgaaagcatcacaagctatttggaaatctgcatcttcataaaattgcttgaagggatctctaagccacattatatcagtatcctgcaaaggaaaacaaagaaaaacaaaccctttaacttgcagttggcttgtgtggtagagtgtgtgcattgtaaagatcttaagaagctttttttttttttttttttgcaacagaaatacatgtataattgtatatatatatatatatataatatataccgtgaacacaaagttatatcccatctcaagaacagaggtgaggaattcagttcttctccacatcatgtgtaggtatgttggggtcatgaaaaatacttcaccggtgaaattggcacctttagtttcaacttggtaacaatgtttgtgcaaagcaaggcaataagcatttgtcttttggtcccaagttattaccaccatgtgatttaaaagccattgtgtctcattccctaggcgaaaactctccagaaagaggtcaaatatggaacctggctttgtccatgcatcgtttaaagttgtgattatcactgtcttatccttcatagacgcggttctaagaacactctctagcttcgattcataactaacctgacgcataaagccaaaactacatcaaacacttggtaacccaagttcatattcacagatgaaattttcatgagacaaatgcaaagttaagattaacaaataacaactagtttgccatatgcttgtcaaaaagataaaatagtacaatcccttagtgcaaaagcatcaagtgtgcaagaaatcaaattatctgagatttatgtaacaaataataatccacaatggttagaaaaaatccaaaaaaaaaagggcaaaagttgcaagacatcaaataggaagtgaaaagtaagtgatgtacacaaacttctaaacatcaatataacaaaatggtaccctccatttacatatataacaacaagactagtgacacatatagctattttgggtgaaaattgtatacaaattctacatttgtagtgacctccaagtcctcataattatgcaaagtatatatacaaatacagaatggtagcagacagtgtgaaattagcacgtaaattatcattattgatcatggcatccacaaaagaataacatctccaaaaggaaaatgcatatttattctttttccagttatgcatcaataatcaaacaattaatgcatcaataatatcagaaatcaaaggaactaatattataatttaaacaattaaataacataattaactaagtacatttccaccaaaagaaaaacctaaggtacgtttattctcatataaatgctgataattcaaaaacttacatgcaacggggaatcagacataaccgatcaagtagagaaaatttgttgtcgctatcttaaattacgaaaccagaatgtcaatgtcaatagttgaagtttgtgaatgtttgttcattaataaatgattttcttcaatgtgttatttaatttcgaattgattagctgtcccacgtcggatgaacttctttcttgagcatccttgaaagcttatatatatatatatatatatataagaaacttaagtaaggctttaagatctatcccatttatcttataatagctttcattgttttttctctaagagaaaaattcggagaaaaaatatagttttcctatgaggtcttttaagtattttattttcttatttttaaaagagattgttaatatatattctctcattgtattttaaagagaggtcatgcaatctctttcagatggtgaaaatctcttatattcttatatgtgggttttccacgtcacgttgttactcaaatacccaaataatacaacccacttggtcaatatagtcaatattttggtatatagtattgtttcaatatacagtatactatccacggtgtggatattgttcacgattactacgcacatgttctttagcagagattgtcaacgcacaccatattaacttgttatagtattgtatatacagttgaaaaattattttgtgttaattaaaggaaggtggaagttaaggcattaggataagaattacaagagaattaaggatgacaaccaatacgatttactatagaatttattctcgtgcgctgagctcgtttccattaagctggaattttatccattatgaatattttttacaagtacttataggatttagtaaactgtcatccctagacaataatataaactaaataattcattcttgacttttcaactaactgaccaagagagtttatatatgactttcttaggacttcaataggacttgcttaatcagtcaatttcctaattcatagaattttaaaactatcttaattgatctgattgtgacctactttccaaaatcaaactaactcaaaagcttgatcacagaatttgatttttaatcaagtttttcactaaaattattctttgaaggagtggaaatccaagatattctcatgaaaaaacaaattatatatatatatatgtataatttgattctttctggaagtaattactaacaacactttttaatttgattcttataaataagaaagggaagtacgtttatgaaaatgataaaaatgtcatttcatttttatttggttgattgcttttaagaatttacccaaaaaaagaattattcttttaaaagaaagatttttttatccatttgcatttttccataaactaaaatcatattaattcctaaaaatatctctttattcagtttcttatttttaaaggtttcttattaaataaaactaggttaaatttataaaaaaaaacaatataatgtctttgtaataatttaaaaaagtgtatcattaagaataaaatcataacgaggatcccataaaaaagtaaaatagataaagcacacgtcaattaccgagtggaataatatatatatatatatatattatatatatataagaaataaactattatataatttaaactttgtgaaagaaccaaattaaaagaaaaaatattttactgaaattaaaatatttagattatgaaaatgctaacatcaattattagggttgataatttttaattttaaaaattattttctaattatataaaaaaattggaaccggacttggatctttaataaggaagatttcagatttgagatggaaaaaattgttactaaaataagagacattgaagatagcaattatagatacttacaacactaacaaaggtgactaaaaaaataccaatatcaggagagagaaaaaaacaacaaaaagaatgaaatattagctctaactttgttttgaaaaaaattaccgtaaataaatatattggaaaaaatagcataacaacgtaacccacaaagcataaatatattgaagaataatccaatatgacccacaaaagcaaaaaagcttgatcaacccaaatcagaagcaagcttgaacgcaagagcaataacaaaagcatcaaaaccaaaaattcaactttttgattggtttgcaagataaataagcaaaggccaacacccagattcactcatttcattctcctctattttcaccacgataattgcaattgcaaaaggcaacttggcatgcacagactcacacaaacacacacatatatagtatagatagatagaataaatagagagagagaaagagagagagagagagagagagactcacctttgttgactgagctgtgaagtaatgtgagaaggtatggaattcaatggaagaggcagagttagagagaaacacccacaacacagcaagcccagcaatgaacatggttaattgcatcacccttctcaccaaaagctggtagctaccggaaccccatgccttgatgccaccggcattctccaccgcagaggtgtccttcttcatgttgtttcaagagctgatcaattgggttgcaaaaatagtctctctttgactattcttaaagaacttgcttctactttgtttcttcttcaacaaaacagcaactaatatggttgtactttttaagatacgttattgtttgactgcattcacaataactgttaatctattattacttttatatatctttcaagtatatattgtaaatcaatcttttatgtaaggtaaattaatacaatttatattatttcatacgtaccattaattgttgtgtattaattgttgtgtcttgtataataataaaaaaatcttcatcatatataaaacttcgttgtgattaatgctactgttttgatattaaataagttggttatttgtttaatctttatataataaaaaaggaaatttgaacacacttttttccatccagaaacactttagacatttttttagttattttttttaacaatagctcaattagagtgtgaatctcaattaagaacacttgagctttttttaacatttctcttgtacgaagatgtgaatctcaattaagattgccttcaaaaatgaatactcaggttttggtttaagtgaaaggacaccctggacgtgagaatttgctagttcttggtgaagttgaaaacacgtgtgatcagcaacaatgacattggctttggacggctctagtagggtaaaagctcaagcgattggcagagctagatgatcaatttatatcaagagtgatgatatatagatattcataaatcataaatacctatttgatatatttttttacatgattgataattttattattaaattacatgaatgctcgttgatgaggtatgtaatggacatgagatcatcctttggagagtgctgagtgcactgaatgcaacaagatagttgaaatcaatatttttccgcgtgagtttagtcaagccaaagggcatgcagatgaaagagtttttcctatcactaggctgcaattgcatacttttggtgtaacctatttactaagtattaatttactatatgtattaaaaacatgtcttctttttataaaataaatgccctctttaatacacatgtcacggttatgtactttatgttatgtactttattttttctcgccaaaagaatctctgaaagtttaccttgtttaaaatcctgataaaagcaggtatccattagcttgtgatcatgtcctaagtccaaccacaagtaattactattagcaaacaactcttaattggcacaagataaatggtctggacaatgcttcattgagttccaagtactaaatgcatgtacatggtaggcataaaattaaagttattacttcgtcttgcatttattacttacgagcaattcacgcaaaaaaaattctggtcaacttgcaacatctcatgcatacatcatatgatttatttttaatagctgatcttataaaataaataaatatatatataaaacgtaaaacacaccctattgtcgatatcctctatagtcaatcaaacttaataatcaacaagtcattcgtccaaccctttactatatgttcaggagttaaatcttgactggcaaaatgtaaattaaattagtcaaaataagtaaatatcgtttttatttaatttaattaggtaaaaatataaaaatgttaaatatgcgaccatttgaaggacacttaattttctcattagtaaagaaaaggaaatgctcttaaaaaaatattaaaaagaagttaagaacaaaattaaatgtgtttaacttcttgaatagtgttagagggcaaggccatgcagaaaattcttcatcatgagaagtttagtgtcacgtgagataattcaggaatctggaagtgtctcttgaaggagtggtcgaaattgaattgtgatggtgcatattctcgggcagccgatgttgcttcatgcggtgttgttctttgcactagtcgagtaggcaattttattcaaggaggcttggacattgctctatctattctgaaagtggagctgttggccaactatttttgggattgcagtggaactgttgtgggaattccgcaatgaccct
